United States Patent 9,441,224 (LONG NONCODING RNAS AND CELL REPROGRAMMING AND DIFFERENTIATION) - sequence listing, part 5

SEQ ID NO: 390 - DNA, 145855 bp, Homo sapiens
gccgcctcctcctgggctgggcccgcggtgtctcgtcccctcgcggagccgctcctgccgccgccgccgccgcctcctcattcatcctcgtgcaccataggcggcacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacccctgtatgaccttcgtattgaccaaaagatttacggagaactatggaagacaggaatgtttgaacgcatgtctctgcagacagatgaagatgaacgcagtattgaaatgcatttgccttatacagctaaagccatggaaagccataaggatgagtttaccattattcctttactggttggagctctgagtcaaaagaacaggaattcggaacttttcagtaaatatctagcggatcctagtaatctctttgtggtttcttctgatttctgccattggggtcaaaggttccgtcacagttactatgatgaatcccagggggagatttgtagatccattgaacatctagataaaatgggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccgggctcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttatggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactcaaaataaataaataaataaataatttaaaaaataaataaaaataaactgaatgaaattgaaaacatatcaatgtgagatgccactaaagtcatactaaaagggaatttacaccacttactgcctacattagaaaagaagtctcaaatcaatgcaaatcaatgacttctgcctttacagtaagaaaccagaaaaagagcaaataaaatccagtaagcagaagaaaggaaacaaagatcagaacagaaattaatataatcaggaaaagagagagagagagaatcattgtaaccagaagtttgaggaaaatcaaatcaattggtaaacctctagccagacagatcagaaaaaaacacgaaagacacaaaccagtctcagaaatgacaggtagcatcattaccaacattaaaaggataagggcatgttaaaaggataagggtatcaatagaatcaacaccttagatgaaatatataaaaaatttgagctctttctcagtgaccagggcctgtgcttaggcatagacgggcaagtggagccaacatgccagcggcccagagctgggtttgttgccaaacttatgtgaccctgcagagacccttcgagaaacctcatctcgaccaaaagctaaagctgattggtgagtatgggctccagaacaaatgtgaggtctggagggtcaaatttaccctggtcaagatccataaggccgcccgggagctgctgacgcttgatgagaaggacccacggcgtctgttcgaaggcattgccctgctgcagtggctggtccgcactggggtgctggatgagggcaagatgaagctggattacatcctgggcctgaagatcaatgatttcttagagattcctacagacccaggtcttcaagcttggcttggctaagtccatccgccacgctcatgtgctgattcaacagtgtcatatccgtgtccgtgagcaggtggtaaatatcctgttcttcactgtccgcctggattcccagaagcacattgacttctccctctgcttccctattggggtggccaaccccagccacgtgaagaggaagaatgccagcaagggccagggtggggctggagccagagatgacgaggaggaggaataagcctgcttgtcccctcctgggctggtggattgtctagttttcctgccaaatgataaaacaggatcaatgctttatttaaaaaaataaaattatgaaaaacagaaattaaggtcactcaagaagaactaggccaggcacggtgacacaagcctgtaataccagcactttgagaggccaaggagggagaatcgatgtagcccaggagttcaaccagtctgagcaacacagtgagactcccatctctaaaaacaaataaaaataaaataaaataaaaaattatccaggcaggccgggtgtggtggctcacgcctgtaatcccagcactttgggaggccaaggcgggtggatcacgaggtcaggagttcgagaccagcctggccaacatggtgaaaccctgtatctactaaaaatacaaaaattagctgggtgtagtggcagcgcctgtaatcccagctactcaggagcctgaggcaggagaatcgttggaacccaggattcggaggttgcagtgagccaagatcgtgccactgcactccagcctgggtgacagagcaaaactccgtctcaaaaaaaaaaaaaaaaaaaaaattatccaggcatgactgtggcacacttgtagtcccagctactagggaggctaaaggggaggatcacctgagctcaggagactgacgctacagtgagccacgactgcagcactgcactccagcctgggcgacagagaagaccctattaaaaaaaaaaaaaaaaaaaaaaaaaacagaaatagaaagcctaaatagccccatatccttaaaacaaggttccaaatgatctttttttttttttttgaaaagtctcactctgttgcacaggttggagtgcagtggtgcaatctcggtttactgcaacctccgcctcccgggttcaagcagttctcctgcctcagcctcctaagtagctgggattacaggcacgtgccaccacacccaggtaatttttgtatttttagtagagatgggggtttcaccatgttggtcaggctggtcttgaactcctgaccgcgtaatccacccgcctcagcctcccaaagtgctgggattacaggtgtgagccaccgcgcccggaccaaatgatctttaggagaaaaaagaaggaaatactgggggaggcacagtaggagatcacagcaggggcccacctccggaacctcaagtaaggacttgagagagaaggtagagtcagagtaacagagacacaggcgggttagccagctctgcatggaaaaggctgagtcgtgatgatgtcatggttctccccaaatctcaaagtcactgatcaaacaactcagtttacactgaagacgatggatgagactctaattttgtgcccacagcttgacacacctttgggaatttggtttaactttctttgccggtacacagatctgtgagaacatatgatcaatccagatctttatagatctatatcctccctggacaaacctaaatgcagacacttttagcacccgtaggagttaggtaggattaaataaaaacattccctcccacttgggggcacattcactgggaatcccagagcgatgtcgcctgcccacacctgctaagtgcgctcacagggcatctagttccctctcttgagttccttttaagcaagcaaggcaacctatgtccagagaagcagttactgtgtctaagtaagtcactgcatcttaggaaaaagcaaacattcgcattttgcagtgcatgatgggcgcacacccaagaaaattactcagcacttgtttttctcactttggggttttcccaaaataatttcttcagtccagttgccaagaatctggagcccccgactgacccatcaaggtccgatttggcttcggacacctcgcagatcaccccgcggctcagagcccggatcctgaagggcgcagcgtgggcagggggcgggcccgggagttggaacagagggcacagacggcccctcctcggaggggagggaccggagccggggcctttttctttaagactcgcagcactggatcccagaacttagtctgcgcggcggcattgacactagctgggctcctcggggcgcgccccaggtggtccgaagcccggtccgccctccacgcaggtgccccgcgctccccgctcagccatgtcgtcctgcagccgcgtggcgctggtgaccggggccaacaggggcatcggcttggccatcgcgcgcgaactgtgccgacagttctctggggatgtggtgctcaccgcgcgggacgtggcgcggggccaggcggccgtgcagcagctgcaggcggagggcctgagcccgcgcttccaccaactggacatcgacgacttgcagagcatccgcgccctgcgcgacttcctgcgcaaggagtacggggggctcaacgtactggtcaacaacgcggccgtcgccttcaagagtaggtgcagggcttgggttggggccccctggagcgctccgagggtgcggaggtggccagccgcaggctccccacccgtccacttgagtgaccgaggagggtggcgccgacccctagggatgcgctcagcccacgcctcccgcgaggcggttttcgctttccgtgattcgctgagccccaggcgggcccgggcgacaaacagcgcgccccgcccgccggcctgtgagggcctgtgcgcggcccggggccctccccgaactgtcagccgctgttgtgtgcaggaaaactggcctcctgggagggggcaacgccctgctagagttcatcagctttccttccaacgcgagaaacattttctctgcaaagaaacggtctccgctcgctttgggctttcgctttccttgaaagggcgcattcatagatgcccggaggcatttgctcgggaaaggaaatgaatcgctaaaacaggattagcgcgcgcttgcccttggtggacttgacaatttgtgtaatgcagagctttgataggctctggcaaaaaggaagcgagccttctcgttcccccacccccgcccggggagcttatgtttgttataaaatacgtgcgtgtggtcttaaaagcatcttccttaaggagaggggcggggatcaagagattgcttattctaactactactgaagaaaattacaggagggcgcagtggctcacgcctgtaatgccagcactttgggaggccgaggcaggagaaacgcttgaacctgggaggcagtgagccgagatcgcgccactgcactccagactgggagacagagcgagactccgtatgaaaaaaaaaaaaaagttactacggagaaataaacaggccggcttcacctccaacctagtggggaaaaaaagcctaagagggagtgaaatgaaggatgggggagcagaagtctccacccctccctttggccctaggcactccgcattgttgtgcatggggacctgagactttctttgacccgcacgggcaactcagcctgccggctttctgagagctggggtgcaggagtggggattaacaccccctaatgcagccctcagccatgggctgagagattggtggataaatacccggcttcctggacgacaggcggagggacttccccttgcctttcaaggtatggggaatggaccaccagcagctgcaaacctgggcgctcatggcaaggcagaatctcccgccttgccccacacctgctgaatcaaaatctgcgtttccgctgggcgcggtggctcatgcctgtaatcccagcactttgggaggctgaggcaggcagataacctgaggtcaggagttcaagaccagcccgggaaacatggtgaaacaccaactctactaaaaatacaaaaattagctgggcatggtggctcactcctgtaatcccagctactcgggaggctcaggcacaagaaccgcttgaacccaggaggcagaggttgcaggaagaggagattgcacccctgcactgcagcctgggcgacagagcgagactctgcctcaaaaaaaaaaaaaaaaaaaaaaaaaaatctgcatttcaacagaatccccagctccctcctacgcacctttaagtttaagaagtggtagtcaaagccaagtgttctcaaggtgtggctggagaccagtagctgtcacatcatctgggaacctagaaatgcaaactcaggccaggtgcgatggctcacgcctgtaatcccagcactttgggaagccgaggcgggtggatcacatgaggtcaggagttggggaccagcctggccaacatggcgaaaccctgtctctgcaaaaagtaaaaaaattagctgggtgtggtggcatgtgcctgtaatcccagctactccagaggctgaggcaggagaatcacttgaacccaggaggtggaggttgcagtgagccgagatcgcgccactgcactccagcctgggtgacagaggaagaaaagaaagagaaagaaagaaagaaaagaaaagaaagaaaggaaggaaggaaggaaggaaggaaggaaggaaggaaggaaggaaggaaggaaggaaagaaaatgcaaattctggagcccttactccagccctttgcaatcagaaactccaatggtgaggcccaggaagctgtgttttaacaggctctacaagtgattcggatgcagactaaagtttgagaatcaccgacctcgttcttaaaaattgttttaaaattaacttgtttttcctttagttgttaggagttaggatccactttgtcatgtgagtttcagggggaaaaatatgactttctttttgtttctttctctttttgaaaggtgatgatccaatgccctttgacattaaagctgagatgacactgaagacaaatttttttgccactagaaacatgtgcaacgagttactgccgataatgaaacctcatggtaagcccaacgtgtggacagtcgggttgcatccctcagtaagaagtgggctacaggcttcccggagcagggctaccctgcagaaatcactcaggggtgctatttctctgaagggggaaaaatagaaaattgcttcattttcccacagtgtttggcttctcactccaacattttagtttagtttagtttagtttagtttagttttgttttgtttggcagtggggtgggtggtgggaagaaattttgctcttgttgtgcaggctgtagtgcaatggtgtgatcttggctcactgcaacctccacctcccggggtcaagcaattctcctgcctcagcctcccgagtagctgagattacaggcacccactaccacacccggctaattttttatatttttagtagagacgtggtttcaccatgttggccaggctagtcctgaactcctgaccttcaggtgatccacccaccttggcctcccaaagtgttagaattacaggcgtgagccactatgcccagccttagctttaagttccaaagataagtgtgacatatcacaatgcttttgggatccatgtcatgaactcaatcctagaatgatagaatgctgtgagtccccaaaggccgcttgcctctggtcaatctcatgagtcctccagccctccaaggtgatgggcccacatctagctcatctctggaccttggtatctgttttagcattacaacttttcctatattcctttcttcttataccatactttctcaagttgattcagaaaacccaaaagaaattttcttttctttttttttcttttctttttttttttttttttttgagacagagtctcgctctgtcatccaggctagagtacagtggcacaatttcggctcactgtagtctccgcctcccaggttcaagcgattctcctgtctcagcctctggagtagctgggattacaggtgtgcaccaccacgcccagctcattttgtatttttagtacagatgggatttcactatgttggccaggctggtctcaaactcctgacctcaagtgatccacccacctctgcctcccaaaatgctgggattacaggtgtgagccaccatgcccgaacgagaaattttctttattaggaaatgtcttgcctatacctgcaggtattcaataaatgttactattatacttttcctacaaacattggagtgcctgccatattccaggcattatgctgggatctgggtgtgcaatggtgagcattatagacagggaccatctcattggtggagctgaaactctagtgggggagatatccattagcaaagaatctgaagtgtgaaatgacagctgtgctggggtacagggaagcttgcttccttgaggattttattccccaagaagttaactgtggattcttagaactgtggtttttattaaaaatgtgcttgctttttctttttttttttttttttttgacagagtttcgctctgttgcccaggctggagtgcagtgacaggatctcagctcactgcaacctccaccttctgggttcaagggattctcctgccttagcctcctgagtagctgggactacaggcgtgtgccgctacgcccggctaatttttatatttttagtagagacagggctttgccatgttggccaggctggtctcgaactcctgacctcaagtgattcatctgcctcagcctcccaaagtgctgggattacaggtgtgagctactgcacctggccagaagtgtgcttttcttaatttaacatttcgaatatggattattggccgggtgtggtggctcatgcctgtaatctcagcactttgggaggttgaggcaggaggatcacttgagcccacgagtttaagaccaggctgaaaaatatggcaagaccctcatcactttaaacaaacaaacaaaattatctctggatgcaaaaccttttttttttttttttttttttctgagacagagtctccctccgtcgcccagactggagtgcagtggcatgagctcagctcgctgcaacctccgcctctcaggtacgagagattctccgccccagcctctcaagtagctgggtttacaggcgagcaccaccacgcccagctaatttttttgtatttctagtagagacagggtttcaccatgttggccagcttgatctcgaattcctgacctcaggtgatccacccgccttggcctcccaaaatgctaggattacaggcttgagccaccgcactcagacgcaaaaagttcttaacctaagaaggtgaatggtgagagttgcacttgtactctgtcagtttctgagtgggatgagatcatagaaagcctgcagggagaactgcaggtgctttgaaggggatggagtttctaaatgcaaatctgagccaatataaacgcacattttaaaaactctcctttttacacagaaggtaacatttcatacaatgtttgccactttgctttttttactccttatgtctggggctctctccaggtttggtcagaaagcttttatcttttttgtggctatatagggacgcagccattatagggatgtcttttacccagtgttgggaagttttctcccgataaatttttgaatgggaacttgagagctgcaaggtattaagacacctttaaaactccatccccttccagagcacctgcagttctccctgcaggctttctctgatcccatcccactaaaaaactgagcaagtacaagagtacaagtgcaattctcaccattcacctttttaggttaagaagtttttgtggccgggcacagtggctcacacctgtaatcctagcactttgggaggccaaggcaggcagaccacgaggtcaggagatcgagaccatcctggctaacacggtgaaaccccatctctactaaaaatacaaaaaaattagccaggcatggtggtgggcacctgtagtcccagctagtcgggaggctgaggcaggagaatggcatgaacccgggaggcggaacttgcagtgagcccagatcgcgccactgcactccagcctgggcgacagagccacactccatctcaaaaaaaaaaaaaaaaaaagaaagaaagaaagaaaagaaaatatcataagaatggacttaatcctgagcaacatatggagaccccagctctacacaaaaaatgaaaattaaaaattagctgggcatagtggcatgttccagcttctcgagagactgaggtgggaggatcgcttgggcccaggaggttgaggctgcagtgagctatgattgtgccactgtactctagcctgggcgacagagcaagtccttgtctcaaaaaaaaaaaaaaatgcatttaacgcatctgacctaccaaacaccataggtcagcctcgtctagcttcaaggtgctttgaacgcttacattagcctatagtctggcaaagtcatctaacacaaagcctattttatcataaaatgttgagtatcttatgtaatttattgaatctgtactgaaagtgaaatgcagaatggttgtatggggcctccaagtacagattctgcagaatgcatatcgcttcctcatccatcagtgaagtcagtaagtcctaagtggaaccatcagagggcagggaccatctatctgtatttgacttgcttatttgttcaaggttctgagtcaataggacaagcaactactaagccactagagggcgcaacttgcctactctttctagagtaaggcagcaggtgtttcgggaccggtggggccacctggacctcagtggagggtggtgtgggtgcagcccttcccagggctgatgacgcatctggctgacgaggctgactgtcagcctctggcctctctcccagaggtgtgccctcagatcaaagaggacacctcctccccttaagaggatttatttcctcgaaggcacagcttctatgatctgtgtttttctttcttcctttcccattcacatttaattccttgtagccgccaagtttctgagaacaaagctgtttagaaagcaatgaagaacacaacatcactgatgtagtattcctggccaaaatattgatgtgactctcctcatgagaacagaccaattcactttgagagaaatactacaaaataatggtctacagtcttcaaaaaagtcattgccaactaccttacattaaaatatatgaaagagatgtgacaattaaatgcaatccatgggccaggtgcggtgactcacgcctgtaatcccagcactttgggagaccaaggcgggcggatcatgaggtcaggagattgagactatcctcgctaacacggtgaaaccccgtctctactaaaaatacaagaaattagccaggcatggtggcaggcgcctgtagtcccagctacttgggagactgaggcaggagaatggcatgaacccgggaggtggagcttgcagtgagccgagatcacgccactgcactccagcctaggtgacagagcgagactccatctcaaaaaaaaaaaaaaaaacgcaatccatgatcctactttggaccctggattaaagcaaacaaaaactgtaaaagaacattactgggacaatttggacacatttgaatatgggctgtattttagataatagtgttgtataatgataaatgcctggcatgtggtcataactgtagtaatgtaggggaatgcccttgctaccatatataatactaaagtgtttaagatgaaggtttatgatatcagcaacttggagagaaaaagggacagagagggaaaaagcaaacacagcaaaatgttaacaattagtgaacttaggtgatgggcatagggtatttatcgaactattcttgtaacttctctgtaacaggaaagaaatacatacatacacttcatctttgaaagtgagagagagaaggaaggaaagaaatactgaatagtactaggtacctggggggatgagtgaggtgctagtttccaaggacagagtgagggtatctcttgtgggattggggtccacaagaatgtgcagctcccttgcaatgggaacttgtggggaatgccattcagaaaatgaaataaaatctacagatccggccaggtgcggtggctcatgcgtgcaaccccagcactttgggaggccgaggaaggcagagcacctgaggtcaggagtttgagaccagcctggccaacatggtgaaaccccatctctcctaaaaatacaaaaattagctgggcatggtggcgcacacctgtaatcccagctacttgggaggctgaggcaggagaatcacttaaacccgagatagaggttgcagtgagctgagatcgcgccactgcactccagcctggacaacagagcaagactcatctcaaagaaaaaaaaaaagaccctattggacacagagaatatgcattcagaataatacataataaaagaactcactaaaattagtggggtttgatgctgatgaaatgtgtaaattaacacatttactggtttttggatttccaccagtacttcaaattgtaaaatttttggcctacatatttgtttctatgggcacaattgtctctttagtagctgtgaatcatgatcaacatgaatattaattcataatttaatgaatattaatattatcaaatagggactaaaaagtaatgaaatcaggccggatgcagtggctcacgcctataatcctagcactttgggaggccaaggcaggcagatctcctgagctcaggagtttgcgaccagcccggccaacatggagaaaccccgtttctacgaaaaatacaaaaattatttgagtgcagtggtgtgtgcctgtgggcccagttatttgtggggctgagacaggaggatcacttgagtctgggaagtggaggctacagtgagccgagatcatgccactgcactccagcttggctggcagagtgagattctgtctcaaaaaaaaaaaaaaaaaaaaagtgatgagataaaaaccaggatggaaaaacagcccattccacacgtgaagtgtccataatgaaggacagacagagtcatccccagggattccttactgctggttgtggcactaaggaattggggtggctgcccactgtcctaggacattgggtgtgcctaggaaattgagagctttagtccttagggtgagagcactgtccctcagaaagcaggtttataagtacttggagtgtgtatgctggggaggagcagttttataaaactgccagcgggctgggcacacggtggctcacacctgtaatcctagcactttgggaggccaaagcgggcggatctcttgaggtcaggagttcaagcccagtatggccaacatggtgaaacctcatctctactaaaaaaatacaaaaattagctgggcatggtggcacacaccttcatcccagctacttgggaggctgaagcagtagaatcacttgatcctgggaggcggaggttgcagtgagccgagattgtgccactgcactgcagcctaggcaacaaaacaagactgtctcacaaaacaaaataaaaaatttttaggccgggtgtagtggctcacgcctgtaattccagcactttgggaggctgaagcagtagaatcacttgatcctgggaggcggaggttgcagtgagccgagattgtgccactgcactgcagcctaggcaacaaaacaagactctgtctcacaaaacaaaataaaaaaattttaggccaggtgtagtggctcacgcctgtaattccagcactttgggaggctgaagcagtagaatcacttgatcctgggaggcggaggttgcagtgagccgagattgtgccactgcactgcagcctaggcaacaaaacaagactctgtctcacaaaacaaaataaaaaaattttaggccaggtgtagtggctcacgcctgtaattccagcactttgggaggccgaggtgggcagatcacttcaggtcaggagttcaataccagcctggccaacatggcaaaaccccatctctactaaaattacaaaaattagctgggcgtggtggtgggcacctgtagtcccagctacttgggaggctgaggcaggagaattgcttgaacccggaagtcggaggttgcagtgagccaagattgtgccactgcactccagcctgcgtgatagagcaagactgcgtcttaaaaaataaataaataaatttaagtaaaagtaaaaataaaactgcctggggaatctacaaatttactacctcacccatctctcagcgaatccctgagaaagggagccccccctgtcactgatggaggtgtgttcttccccttgggagaatagggccaaaaaaattaaatcccatgggtgcatagattttatgccttctatagtcacatttttaatctttttttaaatttgattattactttttgagaaagggtctcattcgtgtcacccaggctggagtgtagtggagtgtagtggtgtgatcatggctcactgcaatctctacttcctggattcaggtgatcctcttacctcagcttcctgagtagctgagaccacaggcacacgccaccacacccagctaatttttctattgttagtagagacagagttttgccacgttgcccaggctggtcttgaactcctgggttcaagtgatccactcctctcagcctcccaaagtgctgggattacagatataagccacagcatccagccacttttttgtttttaatcagcaattaaacctacacaatggccaggtgcggtggctcacacctgtaatctcagcattttgggaagctgaggcaggaagatcacttgatgtcaggagttcaagaccagcctggccaacatggtgagaccctgtctctactaaaaatacaaaaattagccagaatatggtggctcacgcctgtaattccagctactcaggaggctgaggcaggagaattgcttgaacctgggaggtggagtttgcagtgggccgagatggcaccagtgcactctagcctgggcaacagggcgagactctgtctcaaaaaaaaaaaaaaaaaaaaacctgcaccaagactcaatcatatgtttggtatattattcaaccagtggttgtacctctgtgatatgctttcatatatttatcattctgtttcagggagagtggtgaatatcagtagtttgcagtgtttaagggcttttgaaaactgcagtgaagatctgcaggaaaggttccacagtgagacactcacagaaggagacctggtggatctcatgaaaaagtttgtggaggacacaaaaaatgaggtgcatgagagggaaggctggcccaactcaccttatggggtgtccaagttgggggtcacggtcttatcgaggatcctggccaggcgtctggatgagaagaggaaagctgacaggattctggtgaatgcgtgctgcccaggaccagtgaagacagacatggatgggaaagacagcatcaggactgtggaggagggggctgagacccctgtctacttggccctcttgcctccagatgccactgagccacaaggccagttggtccatgacaaagttgtgcaaaactggtaaacgtctgcttcggagcttgctgcttaataaatgttggtggaatgaatgaatgaattgatgctgtggtttgattatttctgttctttttttttttgagacggagtctcgctcttgttgcccaggctggagtgcagtggcatgatctcagctcactgcaacctctgccacctgggttcaagctgttctcctgcctcagcctcctgagtagctgggattaccaggcatctgccatcatgcctggctaatttttgtaattttagtagagacggtatttcaccatgttggccaggctggtctcgaactcctgacctcaggtgatctgcccaacttggcctcccaaagttctgggatttcaggcatgagccactgcacccggcctttttttctctttcttttctctctctctctctcttttttttttttttgagatggagtttcgctcttgttgcccaggctggagtgcaatggcatgatcttggctcaccgcaacctccgcctcccaggtttgaatgattctcctgcctcagcctcctgagcagctgggattacaggcatgtgccaccacacctggctaattttgtatttttagtagagatggggtttctctatgttggtcaggctggtctcgaactcctgacctcaggtgatccacccgcctcagcctcccaaagtgctgggattacaggcatgagccaccacgcctggcctctttctgttcttgaaaaggaatgttcataagaatctccctgggagaaacgtgtctagttctggaatctggagctgaacaacattgctatgcccaactcttcagcctgagagggagaagaacatagtctcaaattttagtgggcatcgggaccacctggagggctgattaagccagattgccggttccactccccacaccaattcacttcatttctaacaagttctcaggtggtgctgacactgctggtgctgggactgcacttagaaccactggtgtagcaagtggtttcagaactatggagccattttctagctgttccttgctgtttccagttttttgattctgtaagggtgatgctttatcctctatttccttagctctgcaagctttctttgcatctcattctgttttgagtatatttttattggttgttttactttttttttgcttgagacagaatctcactctgtcgcccaggctagagtgcagtggcacaatctcagctcactgcaacctctgcctcctgggttcaagcaattcttctgcctcagcctcccaaatagctgggactacaggcgcccaccaccatgcccagctaatattttgtatttttagtagagatggggtttcaccatgttggccaggctggtctcaaactcctggcctcaagtgatccgcccaccccagcctcacaaagtgctgggattacaagcatgagccaccacacccggctggttcttatacttacaaagtagcagagcttgaaggactcaggaggaatatcttctttaactgggacatgatttcttctagatttttcagctgggttttgcattctgcattccttcccagaatgtttacgaggttgcccagccaccgcaactgtatctctttactgaaactcatgcagatgtcttctccttaacctatgcacactccctgtgaactacagcccagggtgattcttcagtaactccctaagcctttttttttttttttaatttgagacagtgtcttgctttgttgcccaggctagagtgcagtggcacgatcatgggttactgcagcctcgacctccagggcaagagacttccatgactaaaacctcaagtgatcctcccacctcagcctcctaagtagctgggactacaggcatgtgccatcatgcccaaataatttaatttttggtagagacagggtctcactatgtttcccaggttggtctagcactcctgaactaaagtgatcctcgctcctttgcctctcaaaacgctgggattccagacatgagccaccgcacccaccctctttcataatttttttttttttttcagacagagtcttgctcggtcgcctggctggagtgcagtggtgccgtcttggctcactgcagcctccacctcccaggttcaagcaattctcctgcctcagcctcctgagtagagtggctgggattacaggcgtgcaccaccatgcctggctaatttttgtatttttagtggagatggggtttcgccatgtaggccaggctggtcttgaactcctgacctcaggtgatctgcctgccttggccttgcaaagtgctgggattacaggagtgagccaaagcctcttttataatcattatgacaataggtgagttcacattctctgctttcaaatgggattggttttgcaacaggcctcctggcttctggttacaccttgtagaaaaaagtcttggagagcaaggagtcttctgaaatagaagaaatgtactcgcaaaggcttgcaagagtgtcaaggcttcggcaagaaggctaatcacacaaaaaaattcagtggaatttacattccggctggccacagtggctcaagtctctgatcccagcactttgggaggctgaggcaggaggatcacctgaggtcaggtgtttgaaaccagcctgggcaacacagcaggcctccatgtctgcaaacaaatcaaacaaaacttagccagacatggtggcacacacctgtagtcctagctacttggtaggctaaggtggaaggatcagttgaacccaggagttcaaggctgcagtgagctatggtcgtgccactgcactgcagcattctgggtgacacagccagaccctgtctctacttaaaaagaaaacgaatccattgaaagatggaaaaaaaccaaagggaaataactacaaatttgccaaggttaccaagtttatgataggctgctcactgtgtgaaattagaaatgttgtcacttgattatcaaacccacaaatgtcacatcatatcccctgacataggtaagcactgcagtcataagagataatgccgtttttccttagggaatcagtaaagtatgggaatgctcaagtttcttttatttgggggaactgaactgcacaggatgacctggttatttctggttcatcacagtatgtagctatttgtttttcttaactctctgatttacaatggcagcacctcaaagtgtcagtttaactctcacagcctgcacccactttttcatccacttggggtagggggaagtctgaatcccacctagactgcatttaacatcttgaggccagatggagtggctcatgcctataatcccagcattttgggaggccaaggcaggcgggttgcttgagcccagaagtttgagaccagcctggacaacatagcgagacccctctctacaaaaattcaaaaagatcaggcagacgaggtgcacacctgtagtcccagctactcagaggctgaggttgggaggatcacttcaacctgggaggtcaaggctgcagtgagccatgattgcgccactgcacttcagcctgagtgacaggacaagaccctgtctcaaaaaaaagcctaaaacaacaacaaaaacttcctttagcctatttgtatgtcactgattaaatccaacatgctcttatggtattcatctcaggctacagctcctaagacattttaatgtctcctttcctggctctaaaaacaatttaatggctttcaatcagcttcccgagtatcttttgtactctcgcctccctctgcagccaaactccagtcctgctaatgccgggcaatagcccaggaaccacagagcacttcaggctctgcctgacaaagttacagacaggaagttcagaagaaatgagccagtcccttttatttcttcttcctcttttgtctctaaccaatcctttttggataagtgtgtaacccacttcctcttttgtctctagccaatccttttaggataagcatgtagctcatttggatgacccttaactgtcaactgctggtcagaatgacatttctcattcttagagaagggctgccattagcccttattggatggtctgcccagcaccctcttccaaaatatgatctcctgccctcccctgccccctgcttccttcccatgtttgcagctgcagctgccacaaggtgaccttgcctctgttgactgctccagctataggtttttcctctaaaaagaaccagctggattggatcagagttgttactgtgcatctcaccccctgtgcctgaggagcagagggagccagccattgccagagaaagaggccaaccatcaagaggagcatttaagccaggtgtggtggctcctgccagcacaatcccagcactttgggagatcaaggcaggtggatggcttgcgctcatgagtttgagaacagcctgggtaacatggtgataccctgtctctacagaataatacaaaaattagccaggtgtggcagtacatgcctgtagtcccagctacttggggagctggggcaggaggattgcttgagcctgggaggtgtttacagtgagccgtgtttgtatcagtacactccagcctggatgacaaagcgagaccctgtcttggggaaaaaaaaaaaaaaaaagaaaagaaaagaagtggcccaaagagaaactcccttccctgtcctcagatcattcctgaaatcttgaattctcagagatgctccaagatacccttgtatccttaaaatatattttctttttcataagctatattgaattgggtagttgttgcttgcaatcaaaaggaacctaactaatagaagtgcattaacatgttttatagtattgtgaaaggaaaataaatcttggggccccaaaatcactaagctaaagggaagagttaagctgggaactgcttagggcaaacttgccttccattctattcaaagtcaccactctgctcactgagataaatgcatatctgattgcctcatttggagaggctcatcagaaactcaaaagaatgcaaccatttttctcttacctacctatgacctggaagtcccctccaggcttccagctgtcctgccttcacctggagctgtcccacctttctggattggcccaatgtacatcttacacatattgattgatgtctcatgtctccctaaaatgtataaaaccaagctgtgccctgaccaccttgggcagaagttctcagaacctcctgaggctgtgtcatggttgcccatcctcaaccttggcaaaataaactttctaaattaactgagacctgcctccgatgttgggggttcaccctatgctgtaggaaaaaaaacaattgggcttggaatcaaaaggagaaaaaaatcatgaattgagaacctatggcaaattagaccatatgtcctgcttaatgctttcccaacatggttttaggtaattctgactatagtcctttgccttagttcattttgtgttactataatggaatatcacaaactaggtaatttataaagaaagtaaatttgcctgtgcacagtagctcatgccaataatcctataactttgggaagccaaagtgggagcatcacttaaggccaggagttcaatgccagcctgggcaacatagagaaaccctatctctacaaaaaataaaaattgaccaagtgtgatcatgctcacctttagttctacctacttggtaagttgaggtgggagtatcacttgtgcccaggagtttatggctgcagtgagctatgatcatgccacttcactccagcctaagcaacagagactctgtcacttgtctcaaaaaaaaaaaaaaaaaaaaagtaagtttatttctcacaattctggaggctgggaagtccaaaagcatggcactagcatctggcaagggcctgcttgtgtgttctaccatggcagaaggcagaagggcaagagaatgctcacaaggtgcaaactaaactcatccttctatcaggaatccactcccctgataaaggtattaatccatttatgagggcagagtcttcactcatgatcttaaaggttccactttgcaacactgttgccttggggattatgtttctaacacatgactttaggggacacattgaaaccactgtatcctttaaggtaggaatcaatgtcatatttgtcatatttcgaacgaagaaataaaggtttggagaggttaattaacttgcccaagatctcagagctaaagccaggatcatatctaggactgactacaaagtcctgtggtctccagtgcttggcaggtccagcttcactgatgagtctagagagtagtaactctcttggtgtaagaactaagggagatgatacattaaatctaagtgtaaattagattatgcttaaagtataagtcatatggttattattaatagatccccaagttagcctatatgtgaacttttccatagagaaatgaagcatggtttcaatgcagcatattttaaatggattatctcatacaatgtgttttttgtttgttttatattgtttttgttgttttctgagacagagtcttactctgttgcccaggatggagtgcagtgacatgatctcagctcactgcaacctccaactcccgggttcaagtgatcctcctgcctcagcctcccaagtacctgggagtacaggtgcatgccatcacacctggctaatacaatgtgttttttttagacaccagagggagccagtggttctttccacatcagcttttctgtgaaacatttttcttttttttgaaatggagtttcactcttgttgcccaggctggagtgcagtggcgccacctcagctcaccgcaacctccccctcctgggttcaagtgattctcctgcctcagcctcccgagtagctgggattacaggcatgagccaccaggcccagccttgtgatagatttttctagactgttgcatgtgtggtacacccacatacaatatcagctttagactcaaccctttgactttgccttcacctactgaacagcaacaaggattgtgacagaccaagaatctgaagaaggatgcagtgtggagacgaaacaggtgtcaatgacaaaggtttagttgttatttcaagtcaactgcaaagtggatgcggtatcaagtatagaaactgcacaggacttctccactaagaacatggggagggcaaagggaatggatgttttgagaaaggaggcagaagccaacagagaacagtggttattaccaagatgggtggagtagaagttagtttatagaagacattggcttaggcctggtgcggtggctcacgcctgtaatcccagcaatttgggaggccgaggctggcagattacttgagggcaagagttcaagaccagcctgaccaacatggtgaaaccccatctctactaaaaatacaaaaaattagctgggcatggtggcgcacagctgtaatcccagctactcaggaggctgaggcagaaaaatcgcttgaacctgggaggcggaggttgtagtgagccaagatcacaccactgcactccagcctgggcaacagagctagactccatctcaaaaaaaaaaaaaaagaaagaaaaaagaagacactggcttagagggtcaccaatatctgcatatcaaaactaagaatgaatttacttggccaatctctctactgggtgatcagcctgagccagataatgcagtgggttctgatttataatgccttctttactgtcaagaggggtaaggattaaagttccggtttaaattaaagttgaaatgctttacttggtttgagtattattatgaaaggaccctgaccgtttctgcatgtcttaaactgatgaaagtagctaagtagacttttaagttgtgacaagacaacttgatccaagaaaacatatttcttgtcagaatatgcaattttttttttttttttgagatggagtctcactctgtcactcaggctggagtgcagtggtgtgatcaaggctcactgcaacctctgtctcccaggttcaagcaatcctcctgtctcagcctccccagtagctgggactacaggtgcacaccactacacccagctaatttttgtatttttagtagagacagggtttcactatattggtcgggctggtctcgaactcctgacctcaggtgatccacctgcctcggcctcccaaagtgctgggattacaggcgtgagccactgcgctcggccagaatactcaaatctcaatgttgtacatttactgtcaatcctgtcagtatcagtatattgtatacagtatacagtaattgacagtatactgtcaattataaattgagttttttaaattatgatttacaaatgaatttgtcaaaattaaattaaacccccccacacgcacacacacctggaatcctttacagataggtggtatatgaatacaaggcacagattgtatgtgcatggtggctttggcacaaacagactacttcttttttcaatgttaagtgtaaagcagttctttcatctctgttcagtgcagtgttgagtgtgactaggatttgaagaacctaaaaaaaaaaaaaactcacctgcttgccatcttcttgttttttttttgttgttttttggtttttgctggttttgtttgctgcttttgtaaaaccagtttatcatattctcattaggaaatcaattttcatgaaattaattttttttcctgctaactatggctcaatcttttcgtttctctctgcttctatcttaagaccattcctcaaattgaccatgagaggatttacatctggggcacttggtatatgccaaatggagacaaaatcagaatcagcagcctggctgggccacaggtccagcatcccaagctattaaaatattcttagtgtttccagggaagtgatagatccactttggaagctgataatatacccctcccctagaaacatgcatatacacaaagtgttctaaacaacttccaggtgctcatgacctcccccacctcccaagctcattgaccactgcctcgccttcacgaactccagacctggtctgaacatttctaaaggacgctcgggagttaaaaggagcgaggccactgcagaaatgacagccttcatccacaagtggcccacttcgggttggctggagccacagctgggtggggacagggcctgtgctcaggtgagcactgcctaccgcgcaccctccaggtgcgtcctaccctgaagcggtcggactggaccgtctaggtcccagcgctcgagaggatggcaggcaggggctggtgattgtctggagatatgaatgctttctaaggttgacgtcaaggtctccttcctgagccacagtccacgtgataagctctgtccaggtagaaatgatctcacctctcctgtcgcccagggtcggaaacctgaggcccgtgcgggctggggcaacttagcaggggtcccaagcccgccgcgccccctgcgccccaaacgtgtgtggagggcttggacgtggtccagagggaaaagatggggtgaaccaggtgccgcgcacccttcgaggagcccccgcttctccgtttctgtgagtgactccaaagcacctccgagggccgacacacgcgcggacgaccttgggcgggcactgaccaatgtccccttccactcggttgtgtcgggggtccccaggtgaggcgcgaacgccgccccgctcacctgtacgaggcctttcccggagcagcccggctacgaagcgacacccatggcggagaagctaaggaagactcccgctccctcacaccgcggctgaggcgactgaaccgccccagtacgccggggccctccccaagccctgctcccaagccgaagccccgcccccgcgtctaaggcccacctccaggccccgcccctgaccccgactccgtgagtcaagcctggcctttcagtccagcccagcccgtcgaggccccgcccctgttgttatggcccgcctccaggcaccgcccttgatcccaccttcatgagtcaggccccgccttccagcctagcccggccagccgaggccccgcccctgtagggacagcccacttccaggccccgcccttgatcccgcctccttcggtcaggccccgtcttctagttccgccccgcccgcggaaaccccgcccccgcgcgcctatggcccacctccaggtcccgcccctgagcccgcctccaggcgtccagccccgccttccagccccgccccaagcgccgaggcccggcttccaggctccgccccgacccgcgcggtggggaagagccgctgccgctggttctccggctcttcctcggcggttctggctcccggccgcgccgcagccctgcccagtctctctcccccagcccggagggctcctccgcgccgcacgtgagcgcgcccgccaacagggccactgccgcggtaagtcgtgcctgcgccctgtccggcgtccagtcctcagccgctgggcgaagccggaggagccgggcatctcctccccgccggcccgcgggtccttctccgggtccagagggcttgggcggcgccgtggggcggcccggggtgcaggtggcttaccggcgcgcggcccgggcctgcggcgcgctctgctgcagtgcgggggcggagagctcggggccggagaccgggagggcagcggggagactgggtggggtcccctagggttacccgaccctggcgcggaggatatgatgccggccacgccctcgccgagcggggcggcaggtgcaggtccaggggtgggtcgcggcccgcgcgccctcccggggccggcccacgaagagacgctcagcctttgtttgctggtgccctggctggggaggaggctggggacgcagacctgtgagaactaagggctttcctcgttggggaagaccccagtcttccagccagtccccaggagaagggatccgggccgcagtgcgcgctctgccagcctggcccctgcgccctgcagggttcccggctgctcgcggggactgttacccgcagtgttgccttacactcgcgactgcagccccacaattgggaagactttgctaggatttttttggtaaggcgagggaagaccgtccccccggccccacaagtctgctgccattaggtggcttaaattttttccagtacaatttaattgccactttgaaagaccacattcaaaacagtgtgtcccagagttgattaagcccattggtgatgagtgtttctgtgctgtggactaaggatcattatcaattttattactaatagtacatatctgttatctgttgctaaatgtttttgcttatgtggtagggtcactgtcctcattttcatcgaactgagaaatgttccttcatatagacatatttacagtgaacttttttgggatctggcagttggtttttctcttgaacttgtttttttctttttctaaattattattattattattattttgagacgaaggtctcattatgttgcccagtctggtctcaaactcctgggctcaagcaatccttccacctcggcctcttaaagtgctgggattacaggtatgagccacagtgcccaaccctgaatttgattttctatgaaattaaaaatgggtaaagagagagatttcttgctgacattttcgattttaaggtatctgagcagatacacttcttgtgtgattacttctttctgtgtctagttatttatagcctgtataactgtcggttttactgaactcttcaatctctcacaggagacatatccaggatagattgcaagatcattggcaaaagagctatttgagaactgaaccaataattttatcagtagcataatgtagtggagacctgtactatctcactgacctgagctcgaatctggttctgctagctgctgggtgtgtgacctgggcaattttccgaatggcctgacttctaatatcctcatcttgggcctaatacccatctcacaggactcgtgtattgcagtaaagaaatgcatgcagccgggcgtggtggctcacacctgtaatcccagcactttgggaagtcgagggggtggatcacaaggtcaggagatcaagaccatcctggccaacatgatgaaactgtgtctctactaaaaatacaaaaattagttgggcgtggtggcatgcgcctgtagtcccagctactcgggagtctgaggcaggagaatcacttcaatctaggaggcgcaggttgcagtgagccgaaatggcgccactgcactccagcatggcgacagagcgagactcttgtctcaaaaaaaaaaaaaaaagaaaagaaaaaagaaatgcatgcataaggccaggtgcagtggctcatgcctgtaatcccaacactttgggaggccgaggtgggcggatcaccttacgtcaggagtttgagaccagcctggccaacatggtgaaactctgtctctaccaaaaatattttaaaaaattagccaggcattgtggcgggcacctgtaatcccagctactcgggaggctgaggcaggagaatcgctggaacccgggaggcagaggttgcagtgagccaagatcacaccattttaccccagcctgggtgacaagagcgagactctgtctcaaaaatcaaaaaccaaaacaaaacaaaacaaaaaagagactgggcgcagtggcttatgcctgtaatcccagtactttgggaggccaaggtgggtggatcacttgaggttgggtgttcgagaccaggctgaccaacatggagaaaccccatctctactaaaaatacaaaattagccgggcgtggtggcacctgcctgtaatcccaggtactcaggaggctgaggcaggagaatcgcttgaactcaggaggcggaggttgtggtgagttgagatcgcgccattgcactccagcccggtcaacaagagcgaaactccatctcaaaaaaaaagaagaaaaacaaatgcatgcataaatggtgaatttaccaagctcacccagaagacttgcttggtagcataccacgtgccccatatttcgaaataaaggagcttgcatgaatgacgatttccaaacttctctcgtgtgctggtagttacaccaaatagcactttcttcatatggccaaccataacactgaactgctccagctactgctcttacctggctgatgcccttcttgccatgagcagtggcgtcccttgccaccccaccttctaaatacacaccttatcgtcaatacacaccttatcacagttctcttcctggtaactctagctgcccacacctctggactttgaggactcctctgccggtggctgagtttcctcttggtatcatcagactctgtcattttgtccaccctctgtcacttatgtgtgttaaaaggagcaaggccactttgtccaccctctgacacttacgtgtcccacattaaactgaaattatgtatttaggtacttccacttttattaggctatgaactatgagagtagggaccttgtcttatttatgtttctttcccccatgtttagacacttagtagagtgaacagactgtgcaccattggagtattgcggtggtttagagatgctgggtttcagaactgaattttctggaaaaaataataataataataataatatggaccattttggatatatcaacttcttagtctttacttggcaaaaggaacaaactaccagctctcattaccatcttttccttaatattttcaaaatgtgtgaaggcagttatttcagaaaaagggacaggccttcccaggattgagtaggcggtcttattttgtgggtgggtgtgcaaggtgcagtatatttttgcagagaggcacgcatatgcagaggctctgtggcaggatgggtccgtcttggggttggagggtgcagtgacaagtgggtagagtcttgtaagctggaaaaggggttgtttggttctattttaagttttcttttttttttttttttttgagacagagtctcactctgtcacccaggctggagtgcggtggcacaatcccagctcactgtaacttccacctcccaggttcaaactattctcctgcctcagcctcccgagtagctgggatcacaggcatgtgccaccacacctggctaatttttgtatttttagtagtgacggggtttcgccatgttggccatgctggtcacgaactcctgatgtcaggtgatccacccgcctcggcctcccgaagtgctggggttacaggcgtgagccactgcacctggccttattttaagctttatggaaacaattttaaacatggcagttgtatgcattgttttaaaaggattcttggagcactgtgtgtaaaggcactggaaaggggcaagtgtgggagaatcattgggaagctcctgcaaacatgcaggcaacaggcagcccacactgcggtgtggcgatggagagcaattgagtcaacaggtgtttaggaagaagaggcaaacaggactggggttgagcatggcaggagaagagaaggaagagtctagaataatccaacaggtaaaggggctactttctgagaaggaaaagatgggagaaggagcatgttgagcagatggaattgagagtttactgttgtttttttttgtgtgtgtgttttgttttttggtggggacagagtctcactatgtcacccaggctggagtgcaatggtgcgatctgagcccactgcaacctccgcctcctggattccagtgattctcccgcctcagcctcctgaatagctgggattacagccaccatgcccagctaatttttctatttttagtagagatggagtttcaccatgttggccaggctggtctcgaactcctgacctcgtgatccacccacctcggcctcccaaagcgctgggattataggcatgggccactgcacctggcctagttttattttttttaacagctttattgcactataatttgcagctcataaaattcattcaagtgtataattcagtgttgttgttgttgtttttgagacagggtcttgccatgttgtttgtgacccaggctggtcacaacctccggggcagaagcaatcctcctacctcaacctctggagtagctgggatcacaggcatgagccactgtgcccagataatttcagtgatttttcatacatttacagagttgtgcaagcatcgccatcatcccattttagcacgtttgccttacctgagaaagatcgccgtgcccagtggccattactccctgttttcactgcaccccaggcagccactaacctacttgccttctctctagatttgcctgtggagggcatttcatatcaatggaatcatacaatgtctggtcttgtgtgtctggcgtcttccactaagcgtgtgttttcagggttcatccaagttgcggcgtatcagtatttggttcctttccattgcctcagcgttcctttgtggatagaccatattttgtggatggatgcttgtcttagttaattcaggctgctccaataaaatagtgtaaactaggtatttctgttataagtgacagtagtgtattcctatagttctggaggctgagaagttcaagatcaaggtgctggcagattcggtgtctggtggggcctgcttgctgtatcctcacagtggaaagaacagccaggctcccttgggtctctttaatttagtttatttgtttgagacagggtctcattctgttgcccagactggagtgcagtggcatgatcatggctcactgcagcctcaacctcccaaactcaagtgatcctcccaactcagactcctgagtacctgggactataggcatgtgccactacaccctgctaatttttgtattgtttgtagagatggggtttcaccatgttgctcaggttagtctcaaactcctggactcaagtgatccacctgctttggcctcccaggatttcagatgtgagccactccgttcagctggtgtcccttttaaaagagcactaatcccatgacataatcacctcccaaagtcttcactttcttttttttttgagatggagtcttgttctgttacccaggctggggtacagtggcgcagtctcacctcactgcaacctccatggctcctgggttcaagcaatgctcatgcctcatcctcccgagtagctgggacaggtgtgtgccaccatgcccagctattttttatgtttattttttggtagagatgggttttcacgatgttggccaggctggtctcaaacatctgacctcaagtgatctgcccgccttggcctctcaaaagtgctgagattacaggtgtgagtcaccatgcccagccgccagggaatgtatttagcagttggtagaggaggaggaaagaagttcagagaggtagatgggaaacaagctctggtgctggaggggccagaggagtgtgtgggccaagtggaggctgctaggctgcttaaagaagtggtctgccgcagagtgctactgagaggtaaagtgaggaaacagaaaggacctctgccattggtgacttgaaagtagtggtggttgccaggcgcggtggctcacgcctgtaatcccggcactttgggaggctgaggtgggcagatcacgaggtcaggagttcaagaccagcctgaccaacacgtgaaaccccgtctctactaaaaatacaaaaattagctggacatggtggcacgtgcctgtagccccagctatttgggaggctgaggcaggagaatcgcttgaacccaggaagcagaggttgcagtgagccaagattgcgccaccgcactccagcttggtcaacaagagtgagactctgtctcaaaaaaaaaaaaaaagaaagaaagaaagtagtggtggcctggtgaagattggattgggtctggagtgatcggaaattgaagtatgagatttcatgaaatttttataactgtactggcctgtaaatgaaagactcaagcttaaagaacgtgttgtaccttcagttcagtttcttccatttaccatatttgcctttttatttgattgactacatccaacttgtttagcaatctacccagctaaccgcgttcactcacgtttaactatatagcattgctctgtatttgtctttcctttcagactgagcagtactggtgaaatactatttgtcctcatatatcaattaggattgtggttggctataacagaaaacctgatagaacagtggcttaaacaaattagctgttatgtgcagaaaacatacaccagacattacagcatccggggttggcatgtggtgccttcatcatgccatctggggctgcaggggctctgtcgttccactcagccatcgttagtttgtgactttcgtgcatgtttcatgacaggtgcaagatgtagcttcactccaacatcatgcctttgttctaggcagaaagaggaagaaaggaggacaaaaggcttatgccaggaagtctgcctcctttccaacagccttttgacccacagcttctactgacatctcattgtcaagagctgtcacatggccacctagatgcaagggagtctgggaattacagtgttaccatgaacaaaaccagtgctcctttagtacagaaaaggagaacaaggcatgttgggtagatgcctgccacactttaaataaaacagccaggcatggtgatacatcccaatagtcccagctacttgggaggctgaggtggaaggaaggatcacttgagcttaggaggtcaaggctgcagtgacccgtgatcgtgccactgcactgcagcctgggtggcagagtaagaccctgcctccaaaaaaacataaaaagtttagaaatgccatatgatgggaggggctgtgctcatttaaaattaccggctggcaacaacatatagtctagcagctttggagctttgatcctggaattaattttgtcagttacttggagccctagcacttctatgctgtctgctcctgtttcctgttctcccccagaatccacgagggcgggaactatttatctttcatctcccacagtgcctggcccagaagccttgctaaatatttgaacaggattgcccagtgagtttgtgcacagttgtgtttgtggacacgtgtcttctgtagctctgggttgggaatgatttgtatccccaaatggctctctcatttggttattttttgatttgcttttagatacttttctgctgtgagaatgtaagatggatccagaagagcaggagctcttaaatgattacagatacagaagctactcttcagtgattgaaaaggctttgagaaattttgagtcctcgagtgaatgggcggatctcatatcttcacttggcaaactcaacaaggtatgtagggtgtatcctatttggattgcatggaggtggggacgtaattgtctttttattattataagaaattacatgattatattatttgtattttataatctttatatcattacatattatacagtataatctttatattatttcaaggaaataccattatatatacaatgatgattacaataattagaaaatatagaaaagaaaaaaaccactcataattctgtcctccagtgttacccactgttaacctatcaatgtatgtacctccttccagctttttctgagcataaaaatatatatagtgttcgtatagttgaagtctttttcttaacaatgttaatgtctagacaagataaaatttaaaatggtcaaattaggtattcaaagactgttctttgtatactccttaggatttttatttatttttcttctttgatctacttttttgatccttttactgctgtctggtaactcctagaagaataaaagttgaaataaatattgaaatctgcccaaaacttgtgtgtgtgtgtgcatgtgtgtgcatacgtgtgtgcatgtgtgtgtatggggtcagatctaggaaaaccaaaactggtcacacgtgggcttgaccttgtactctatatcaggggtccccaacccccaggccgctgaccggtaccagtccgtggcctattaggaaccgggacgcacagcaggaggtgagcggtgcgagcgagcattactgcttgggctctgcctcctgtcagattagtggtggcactgggttctcactggagcataaaccctatcgtgaactgcacatgtgagggatctaggttgcatgctctttaggagaatctttttttttttttttttgagacagtctcactctgttgcccaggttggagtgcaatggcgcaaccttggctgactgcaacctccacctcccaggttcaagcgattactcctgcctcagccacccaagtagttgggattacaggcacgtgccaccacacctggctaatttttgtatttttagtagagactgggtttcaccatgttggccaggctggtctcgaactcctgacctcaagtgatccacccacctcggcctcccaaagtgctggggtcacaggcgtgagccaccacacctggccactctttatgagaatctaactaatacctgatgatctgaggtggtacaacagcagatctacagtttcatcctgaaaccaaccatgcgccctcccacccatctgccaccccatctgtggagaaattgtcttccacgtggccagacgtggtggctcacacctgtaatcccagcactttgggaggccaaggtgagtggcggatcacaaaatcaggagatcgagaccatcctggctaacgcggtgaaaccctgtctctactaaaaatacaaaaaaattagccgggcgtggtggcgagcacctgtagtcccagcttctcaggaggctgaggcaggagaatggcgtgaaccagggaggcggagcttgcagtgagctgagattgcaccactgccctccatcctgggtgacagagcaagactccgtctcaaaaaaaaaaaaattgtcttccacgaaactggtccctggtgccaaaaaggttgggaaccacatctctatataagtgacatatagatgggagcattatattttcccatcctttctttcccagaaagaaagtgacacagggactttcaagtgctcagatgaccactacaacatgtaggtagatgatatctgggcttagataagctgtacctggctctgttgctgttcagacaggacctgagtttggagcccaagtgctaggtgggagttaggagatgtctaactctactctgcagatctcagctccccaggccaaacacaccaggggaactggggtgagtgaagaatttcagcagcctgaccctccagccctgacagatggctatcaggcacgctgcagatgggcagttcttacagctcgtggccagtaagctgctggtcttttgcaaggtatatttacgacctgtaaatgtcacggctccgtgctggctggggtggataaatgtttctaaggtctttaaaacaggaaataagagcttgcaaattctttggttttacagctctatctcaggaattctctaggtgaatgcagattgcattcgcagacttgctctgaaggtggattgctttttgaggggaaagggagaagcagtagaaccgcattgagtcccacattcttctggatgtttcacttttcagtactcagccctcctggagtctaagaacagcctactttttctttcttttctttttctttttgaaacagtcttgctctgtcacccaggctggagtgcagtgacacgatctcggctcatgacaacctgagcctcccaggttcaagcgattctcctgccacagcctcctgagtagctgagattagaggtgcccgccaccaggcctggctaatttttttgtatttgtagtagagatggggtttcaccatgttggccaggctggtctcgaactcctgacctcaagtgatccgcccacctcagcctcccaaagtacagggattacaggcatgagccaccgtgcccagccgaacagcatatttattgttggggagggcacagtcttcattatttctgttttttctttttctttattgagataaaattcacataacacaaaattcaccatttacccattttaaagtgcacagttaagtggcctttagtatgtttaccatgttgtgtaacccttactatctagttccacacattttcatcactccaaaaggaaacccgtacccattcagcagttcctccccattcctccctccccccagccccggtaaccacgaatctactttccctctctacggactttccatggaaatggaatcataccacatgtggctttttgtgactggtttatttcatttagcataatgttcttaaggttcatccatgttatagtatgtgttagaattaccttcctttttacagctgaataatactctattgtatgggtaagtcacattttcttttcttttcttttctttttcttttttttttttttttttttcgagatggaatctcactctgtcatccaggctgaagtgcagtggcacagtctcggctaactgcaacctccaccttctaggttgaagcgattctcctgcctcagcctcccgagtaactgagactacaggcgcacaccaccacacccggctaatttttgtatttttagtagagacagggtttcaccatgttggccaggctggtcttgaactcctgacctccagtgatctgcctgccttggcctcccaaagtgctgggattatagacatgagccaccgcgccgagccacatttttctttatccattgatcagttgatggacatttagatttttaccttttggctattgtgaatagtgttgctatgagcattcatttgcaagcttttgtttgaacctcagttttcaattctttggggtgcatacttaggaggggcattgctgggacatacggaaacgctatgtttaacttactgaggagccaccaaattgttttcccagcagttgcaccattttacatatccaccaaaagcaatgcgtgagtgttccaatttcctaacatcctcaccaatacttattttcaagtttttttttttttgacactcgctctgttgcccaggctggagtgcagttgtgcaatcttggctcctgcaacctccacctcctgggttcaagcgattctcatccctcagcctcctgagtagctggggttataggcgttagcgaccatgcctggctaattttttatttttactttttaatacagatggggtttcaccatcttggccaggctggtctcgaactcctgacctcaggtgatctgcccgcctcaacctcccaaagtgctgggattacaggtttgagccactgtgcccagcctattttcagttttttaaaaatgataaccatcctagttgtgtgaagtggtctctccctgtgggtttttttttttaattaataattttaaaaaataacttttattgagaccccaccaggtgcaaaacctgttcctggcgttaagctccttcttcctttgcaattcggtctttctcgagtggtcccatgaatgctttcttctcctccatggtctggaagcggccatagccaaacttggaggtggtgtcagtgaacttaaggtcagtcttctccagagcccatcgtctggtctgcaccagcaaagatgtgcagagaatgagcactcgcttcttggttcccaccacacagcctttcagcataacagagttattggtcacttcaccatagtggacaaagccacccagaaggtcgatgctcttgtcagacaggtcatagtccgtggaggcattgttcttgatcggtttgctgtcctcagtaaggtagccctggtcaatcttacagatcttcttgttgatctcagtgtggtgatggtcgcctttctgcccagcacatgccatggagaaggccacatggtcaggatgccatgccccaatccaggccaccttgcacaggcctcggtgggtcttgtggggcagcttcttggtgtgccaacaactggtgacccctttgtagcctttgcccttggtcaccccgatgatgtcgatcatctcgtccagcccaaacgcttggttcacaggtacctgctgctgtagcccctcctgggctcagtccagcttctcagccatggtgcctccgttcacttggatctccatcagctgggccttcttctggcgcagaggaagtaggcgcgtctgggtgtgggcagcgaggcgggtgacttggcagtgcttcctcatgctgctgaagtcttctccagctgcttcttgccatcctcatcctgccatttcttgcagtacttggtaaaggccttcttcctagatttatgccggttgttagagaaacaccttttgcactcatcgttgatgtgctcagcaaagatggccttgaaggtccggaggcctcaaggggtttccacgtagcccgcaatgcccacaaccaccataggtggtgtctccacagtagtcatggcctctaccacctccttcactttcaccttggatcttggcctgtcgacttcccgtgtgatgtgggtcatgccagccttgtatcccaggaaggctgtgacgttgaccagcttggaagggtcatccttagggaagctcttcaccttcccacgttgcctatttcttcactcctatggcaggaagcagagggacccatgtctgggagtggagaactttctgtgagacatcacacaatcaaattccaccggtagagctctccctgtggttttgatttgcatttccctaatgactaataattttgagcaccttttcatatgctttttgggcatttgtgtatctttttggaagaaatttctattctaggcctggcgcggtggctcatgcctgtaatcccagcactctgggaggccgaggccggcagatcatgaggtcaaaagatggagaccaccctggccaacatggtgaaaccccatctctactaaaaatacagaaattagctgggcatggtggcatgcacttgtagtcccagctacccaggaggctgaggcaggagaattgcttgaacccgggaggcagaggttgcagtgagctgagatcgtgccactgcactctagcctgggtgacagagtgagactctgtctaaataaataaataaatatatatatataaaattattatttatttatttataattatccagccgtggtagtgcttgcttgtcctcccagctacttaggaggctgaagtaggaggatcgcttgagcccaggagatcaaggctgcagtgagcatgatcatgccactacgctgcagcacgtagtgctgagtgacagaacaaaaccctgtttcaaaaaaaaaaaaaaagacataactttgttagagttgttacctgaggattcccatcccaagggtctcctcttggatctcatttcttgttccctgctgctgtgattaactgttgagtttaagcagccaccttgaagaatttgcaagatacggttgggacaaaggtgatgctgtcagtccctacctctgctttgcctgaggccgctgacattcatggagagctcactgcgtgctaaggagttgacgtgcattattgtataatacttaaaatgtatcttgagatccgtctcaggttcaaccacttgtgcaaggccactgccagccagtggcagagagagggctcagaccccgaccagcctggttccaaggcccatgctcatgagcagagcctccagccttcttcatgtcagtatctgtatagcttacgtaaggggaaagggctgtgcttctttgctgccagggaccctgtctccatcacccaaatgcagtaggcgcaattattaggcccattttaccgatgaaggctaacctacttgcccagtgtcttatggcaactgagtggttattatggattgaattttggcctccgtgaaagaaaccctggagtcttaacccttagtacctcagtatgtaacttgatttggaaacagcatctttacagagctaatcgagctagaggaggtcattagggggtggccctaatccagtgtgactggtgtcctgatgaaaaaggggaaatgtagacacagacatgcatgagggaaggcaccatgtgaggatgaaggcagagaccagaaagatgcatctacaagccaagaagtgccaaagaatgacagcaaactcctagcagcggggggagaggcacgggacagattgtctatgcagccttcagaagaaagccgctctcttgacaccttgatttcagacttaacatgagagaatacatttctgttgttgaagccacctggtgtgtggcacttcgttatagcagccctagaatgctatgacagtggtaggacaagatctgttaacacctcagtgctggggataaggcattgaacactaagcccctgctctcatggaaagaaatgacgctttcttggcgagagacagacgacagatgactgtgtgatgtcagatgctgaatgctaagaagaaaaataaactggggaagtggggtatggaggaaggaggagggagtgctattttagacagagaggacactgacagcgtgaccttaaagcagaggttggggtgaagtgagcaagctggtgggaagggcaatctggggcatgggcctgtgtccaaggcatgggaaggggacaggagtagccagaggacagagtgaccagagatacagcagggtcaggccactgataggattttgctctggcggggaggggaagccactgagcttcctcccagggaggctgtgagcaagggaacctctgcctcacccattccaagaattccccgggccgtcagcaagcacaagagccagtgtggatgcccgcaccattaggcctgagatcagttcctgccgttactggatgtggagggtttggatggtgctggagggagcacatcttgatcagcatcaggaatacttggttctgtgaaacttgcaacttctgcattcaagggtccctgataggagttggtatgaataaagaattttcttcactgggtgcagtgatgcatgcctgtaatcctagcactttgggaggctgaaggcagaaggatcacttgagcccaggagtttcagaccagcttgggcaacatggcaaaaccttgtctctccaaaactacaaaaattatctggccatggtggtgcacacctgtagtccagctactcagaagcctgaggtgggaggatccctggagcctcagcctggagctcttgcaccactgcactccatcctgggtgacagagtgagaccctggctcaaaaaaaaaaaggaatttttttaaggctttggtgatcgtcacatttcttggacttatgcacagaaattcagtgagtaagagttgagagttgggcggggcgcagtagctcacccctgtaatcccagcactttgggaggctgaggcaggtggataacctgaggtcaggagtttgagtccagcctggccaacatggtgaaaccctgtctctattaaaaataaaaaaaattagccaggcatcgtggcgaatgcctgtagtcccagctacttgggaggctgaggcaggagaatcgcttgaacctgggaggcagaggttgcagtgagccaagattgcaccactgcactccagccttggggacagaggaagactctgtctcaaaaaagagttgagagttgaattagcaaaattctttataatacagatttaaacaatgatataggacacaaaagcttagggtcaacattcttttttttaaggtaggtaactaaatgttataatgcataaaacttagatttggaggagaagactcatccagtcaacccttttttcaactaagaaaactggttcccagaaggtcttggtatgtccagctgtagacagattctaatggtatcattttcaaacttgctcaatgtttcagcatcatttttagaatttttctgtgttagagaatagtttatctttttttttttttttgagatggagtcttgctctgtcgcccaggctggagtgcagcggccccgtcttggctcactgcaagcttcgcctcctgggttcaagcaatcctcctgcctcagcctcccgagtagctgggactacaggcgcccaccaccacacccggctaattttttttgtatttttagtagagacggggtttcaccgtgttagccaggatagtctcgatctcctgacctcatgattcatccgcctcggcctcccaaagtgctgggattacaggcgtgagccgccgcgcccggcccaagaaaaacattttcatcaagtgcccttttgagccctgaacccaggtgctctaccaagcctgatttacagctttgattttggaagtgaaggctaatagaaataaattaactctggatttaaaaatcttatcattaaagctctttaaaaaaaaaaaaaagttataatggtcctaaatgaaccagttttttttgttttttgttttttcgctgcttttatctgatgacacactacggtttcacagagcagccatgaacaggaagggcagcatgaggtctgtggtgtcacacagttcagcttccggagtcttcatcagttagctacaagcacctcctgtttaaagcagagcctcctgatggtgtgtttcagaattagtgctgcagtgtggtgggaagaacacgggttggagcttggagacctagtgaactactccagccctttacagatcggctgcaagaactctttacctaaaaacttggtgagaggccaggcgtggtggctcacgtgtgtagtcccagcactttgggaggccaaggtgggtggattacttgaggtcaggagtttgagaccagccttgctgacatggcgaaaccccgtctctactaaaaatgcaaaaattagccgggcgtgatggcaggcacctgtaatcccagctacttgggagactgaggcaagagaatttctggaacctgggtggcggaggttgcagtgagccgagattgcaccactgcactccagcactccagcctgggtaaccaaaaaccaaaataataaataaattaataaaaacttgggtgagtccaacagaatccttcttctttttttgaggctggagtgcaatggcatgatctcagtttactgcaacctctgcctcctgggctcaggccatcctcctgcctcagcctcccaagtagctgagactacaggcatgtgtgcgctaccatgcctggctaatttttgtattttcttttcatagagacagggtttcactatgttgcccaggcaggtctcaaattcctgagctcgagtgatcctcacaaagtgctggaattataggcgtgagccaccgtgcctggccgggatcctgattttttacccctgcctgaatcaactcctcttccctgttgactagtattagttcacataaatcctcttcagcctggagtctgtgttagtctgctagggctgccataacaaaataccactggcagagtggattaaacaacagattgttttgtttcacagttctggaagccagaagtccaatatcaacgtgtcggcagggttggttcttctgaggcctcgctgcctggcttggagatggtgtcttctccctgggtcctcacaggatcatccctctgggtgtatctgtatccagatttcttcttcttcttcttttttttttttgagatggagtctcactttgttgcccaggctggagtgcagtagcacgatcttggctcactgcaaccttcacctcccagattcaagcgattcttctgcctcagcctccaaagtagctgggattacaggtgcctgccaccacagccagctaatttttgtatttttagtagagatgtggtttcaccatgttggccaggctggtctcgaactcctgaccttaagtgatccgcccgcctcggcctcccaaagtgctgggattacaggcgtgagccaccacgcctggcccagatttcctcttcttacaaggacaccagtcagactgcattagggctcaccctaactgcttcattctactttgattacctatttaaaaatcctgtctccggccgggtatggtggctcatgcttgtaatcccttggcctatgggaggccaagatgggtggatcacttgaggtcaggagttcaagaccagcctggccaacatggtgaaatcctgtttctattgaaaatataaaaacgagctgggtatggtggcgcatgcctgtaatcccagctactcaggaggctgaggcaggagaatcacttgaacccagaaggtggaggatgcaatgaaccaagatggcactgctgttctctagcctgggcaacagagtgagactctgtctcaaaaaaaagaaagaaaagaaaaagaaaaagaacctgtctctaaatacagtcccagtctcaggtggaggtcaggaagggctttgccataggagtttgagagggatacagttcagccatgacagaatgtgatgaggaggtgcaggctgtctctccacctgtcacctgtttacaaagctgatctctggtagaagcccagatggtcttttatcacacaccttgtggaggaacagaggaagtgtgatttctttagtcttgttcttgatccaggagcccagtgaggagcttcgactttggggtgtgtgtgcgtgtgtgtgtgtgtgtgtgtgtgtggtgatacagttaagcacccagaactgctgagtcaggaaagcgttccaggtgatttgtgccccctccaccgcatgccaagagctctgcaccagcttatttatggggcactgcattgtgggggtatcctacatgtctgctgggggtggccctttcagccttcctcccccactggagccttggtgctgctgccacagttgactctgcactccttatccctgctggccagaccctgcatgctcagtgcctagaacaaggctacgagccctgccagcctccttgtgtatgagctgcatctttcagcctgcagggtgcctggtttcatctcagcatctcacttgtagggcatcctctgttagagcgtgacacctaaatttggggctatgattttagccattttctagcaacctttgttctgatgacctctgtggctatgaccgtgagggtggaggtggccaggtaagtgcagggccagggtcatcgtggaatgataagggcctgaattgccttctgagaagacaccaaatggaaaggatgctgttgatgggaattcttgactggcttcacgttaaactagatcctgtacctctgcaggagaggggccagcccagcatccatttgtctctggcagtgtcctgatgctcttggcaccagtatttagaagatgcagatccaactcccgtttttttccctcccctcccctttcttttcttttttgagacagagtctcactctgtcacccaggctggagtgcagtgacccaatcttggctcactacaacctccacctcccaggttcaagtgattctcctgccccaggctcctgagtagctgggatcacaggcatgcgccaccacacctggctaattttttttgtattttttgtagagacagggtttcgccagactggtcttgaactcctgacctcaggtgatccgcctgcctcgacctcccaaagtgctgggattacaggcgtgagccaccgtgcccagtcctaactcccatttctaaggtgtggcaaaggctgctgaatcctttgctgtcgttctgttgtgggtgccatgctggggctctgatgatgttgcagcttcaccccttaccccaggttatctgaaggagctgagggtgttcaagagcactgctaccccaggcttcacagcagcctcagtgagggccactcacactgtaagatcgagatggtctttttgaaaagagcatttctctttgctgaaaagagtctgatatgcttttcgataatttgtagccaggatagtctatttactttgtgtttgagtgaaggaatatttttgccattcttcctttcaggtctgctgtggggctggaggtagtccagatttagagatgaattattcctccagtgctgtgatttgaatggctcttccaaagtccatgctgaaacttaaccccaatttgacaatattggggttgggggggcctttaaaaggtgaccagaccatgagggctctgttctcataaatgagttactcgacgtatggattaatgcattgataggttatcctgggtgaggaactggtagctaaataagaagaggaagagaggcctgagctagcattagcatgctcggcctccttgccatgtgatatcccacaccacttcgggactctgcagagagtctccaccagcaagaaggccctcaccagatgcagccccttgagcttggcctctgtaactgtaaaaagtaaatttattttctttataaatgacccagtttcaggtattctgttataagcaacagaaaatagactaaaatatccagcaatctaacagaattgagtttatagataagggaaagggtttgtgacccacctacactatataaattctcccaagaaagttaggagctagaaactccatgtcacgccttggtgtggaaggtgctgtggactgaattgtgtttctccttctcccctcaaactcatatgctgaagtcttaaccccagtgtagctgtatatcaaggtaggatctttggcagatggtttaggttaaatgaggtcatgaggatgagaccctaatttaataggactgtggccttataagaataggaggagggcaggcacagtggctcacacttgtactctcaggactttgggaggctaaggcaggtggatcacttgagcccaggagtttgagaccagcctggacaacatggggaaaccccatctctacaaaaacaaacgaacaaacaaaattagcctggtgtggtagcatgcacctgtagtctcagctacttgggaggctgaggtgggaggtttgcttgagtccaggagtctcttaagaaaaaaaaaaaaaggaagaggaagagacagacttcctcccacctcccaccatgtgaggacacagtgaggagatggctgtctgcaagccaggaagagagctgaaactgctggcaccttgattgcggactcccaacctacagaactgggagaagtaaatttctgttgtttaagccgcccactctgtggtattttgttatggcagcctgggccaactaatacagaaggaactaagttaaacttgtatttttcagaaaaaaagcaactgtttgaacaggaataccaacattcaagcttgtatttgagtcacatacaggcattcccatttacctatcttttaaaaatagtcttttccttttaaatttctttccaactttattgggcatacaataaactgcaagcatttagaagtgtataatttaaagagttttgacataacgtttatccctgtgaaaccatcaccacaatcaagacaatgagcatggatctgtcacccccagaagtttcctcctgtccttttgtcgtctccctccctcccttgtccccagacaaccactgatctgttttctgtcaccatagatttgtttgcattttctgaaagtttatataaatggaatcccacagtatgtgccgtctctctccttttctggtctggcttctttcactcagcaaagctacttcgagagtcattcaggctgttgtgtacatcaaagtttccttcttttttactgctgagtaagagtccatggatatatacaatttctttatccatttcccattagtggacatttgggttgcttccagtaggtatatgtttaattttttaagaagctgccaaactgtttgccaaagtggttgtatcattttacattcccagctgcagtgtatgaaagctccagttctcccccatcctcttcaacacttggtatggtcagtctttttcactttggtcattttaatgagagtgtaatactctcttattgtggcttttgcattttgtacatgacagatgattagaaaatcagtaagtggtcattgtaactttgttttaattccatagacacataacataaagatcactgtaagaatcttcactgttttattgtaggtaatagcaaaaaattgggagtgaccacccctggtaggggagtagttgtgaagtgagtcatggaacgacaatataatgcacacacagccatggaaccaagtagactggtagttactaacatgaaaaatgcttattataaataagggggaagaaaggacaggcgaacagtttacatatagcccactcaatcttgtgtgtgtgtgagagaaagggagggggtactgtataggagtggacaagatctcgaagccccttattgtaggactagtgtatttccagtttttcacgactctgaataaagctgtaatgaacatctttacgcacgtggctatttttgttaagataaattgctagaggtggagtagctgggtcagtggacgtacagtgaagcctctggacacaggggtatgtgctggcctgcctttgcccctctcctctgcctgcacagatgccagagccacagcctgtcacctgctgtactttgtcatgtgtttatctagcaggaccacattctctatcccaatcttgtcactcttctgattccagaatttctccactattcccatgttgggaacattaggataatttataaagttaaaaaaaaactagagggggttattgatattaaccattataggtaataacaatttagattattctgggaagaagtgacatctttacacacttgggcccttccatatagaaatgtggtagtttccatcattcattaaaatgtactcactttgctggccgcggtggctcatgcctgtaatcccagggctttgggaggctgaggcaggcagatcacctgaggtcaggagttcaagaccagcctggccaacatggtgaaacctcatctttaccaaaaatacaaaaaattagctgggtgtggtggcgcacacctgttagtcctagctacttgggaggctgaggcaggagaatcacttgaacccaggaggcagaggtcacagtgagctgagatcaggcctgggcaatagacggcgctccagcctgggcaagagtgaaactcggtctcaaaaaaagaaaaaaaattgtggctgggcacagtggctcatgcctgtaatcccagcatactgggaggccgaggcggggggatcacctgaggtcaggagttcgagaccagcctggccaacatggcaaaaccccatctctactaaaaatacaaaaaatagctgggcatagtggcgtgcacctgtaatcccagctacttgagagactgaggcatgagaatcgcttgaacccatgaggcggaggttgcaatgagccgagattatgccactgcattccagcctgggttgtcagacagagtgagactgtgtctcaaaaaaaaaaaaaagtattcacttatgtccttaagagttcttcttaaataagaccttcctgttcctcaagtatattaagtattttatacatgtgtttttgctattgtgaatgggattattttcctcaggtagacaggtataccgtcaaccaatactgatttgtatttttttctaatattttgctagcatttcctggaacagtgttgaatagcaatgttgctatcagtgtgttaaccacggtaatgttggctgctataacaaagaagtccaaaatcaatgtcctcgatgtaattgaagtttatcctcactcatgtatcagttaagcatgttattcagatgggtgggcagctctcttctacacggtcattccagaaactcaagctaggactctgtcttcttttttttttttttgagacagtgtcttgctctgtcagtcaggctagagtgcagtggcacgatcttggctcactgcaacctccgtctcccaggctcaagcaattctcctgcctcagcctcccgagtagctgggattacaggcgtgtgccaccacgcccggctaatttttgtatttttagtagagacggggtttcaccatgttgaccaggctggtcatgaactcctgacctcatgtgatccacccccctcagcctcccaaagtgctgggattacaggcatgagccaccacgcccggcccaggactcttgtcttcttgaacacgtggctttcacagttcctcttttcattgccattctgtcccacaggaaaagggaaggacacagagaagcacacatactgaggttttaaccagccaggtcctgatggcacgtgttatgtccacccatgcctcccagggagactgggcagccatggcccagctgcagccctaactgaagaagaagggagccgtgatttgggtgggctgggcccagtgcctgcactcaccttccatttaatggaagggtctgtagtgtttcaccatcatctctaccctgtgacctccctctgtttcttgtgtcataaaggatcagtttattccttggttactaactttaataactacttatctttatatggcaagaaaggcatgtcatttcattacctgatcaacatgtaaagtattgaattgctttttaccaagcatcacagttctgccttatatattactcttgtgtttgggggtcattcttgtacttaggctagattttcccaatgcctaggatgtgcctgggaagcaaatatgttggaggataatctaattccgatttgtggaatgcaggaaggagcccggaattggagcacctggggtcatgttcagactcaccatttctgagattggggcagatgcactggttacccaccgataaccattctgccctcttctttcttgccaatagagaaccccagttatatttggggatcaggtggtgatgcgctgcagggtgggggccccagcagtaaatgttattgttctaggacttcatcctaaaaatcctgctttccttggcagggattaatttcgaggtgggcacatgacctgctctagcccaatgagatatggcgggaaggctgcagggtggcttctggaaaggtttttttctcatacaaagagacaaaaaggaacacacactgccacgacagggaaagataggttaagagtcaattcactggcagggcgtgctggttcacatctataatcccagcacttggctgaggcgggaggacagcttgaggccaggagtttgagaccagcctgagcaacatagccagaccccatctctacaaaaaaagttaaagttagccaggtgtgacggtgtgtacctgtggtcccagctagttgggaggttgaggcaggagaattgcttgagcccacaaggttgaggccacagtgagccatgtttgcacaactgtcctctagcctgggcaacagagcaagaccttgtctaaaaaagaagagtcaattcatcattgacagcatgtaaggcaccagaatgcttggatcttttggggatgtcactgagcccttgcaggaaccaaatgcagaaatgagctcctttagccctggtttcccagccttggcatgctgtggcatggcagacattctggctgcgggtgggtggtggtctgtgcactgtaggatgttttcttttgtttaagaggcagggtctcactatgttgcccaggccagagtgcaggagctgtttacagatgcagtcatagctcactacagcctcacacaatcctctcgccttcgcctcctgagtagctgggatcacaggtgcgcgccactgtgcccagctctctgtaggatgcttattcccatcctggcctccctgacttctgtccagtagatgccagtatcaccccctcctccacccaaagttgtaacagccagaaatgtttccacacattgccaaatgtcccctgggggcaaaatttccccagttgagaaccactgctgtagacctttggttttgtgaggcaatacattgcttcatttaaacctgtatggcttgatggtctgttctttacagccacacatgtcctagctgagctcacaaccctggaccatcctcaacccgagagccagagcctgtttcttctgcaggctgacgtggacgtacttgtctgttgacagtaaaggtattttgtgcatccttaaaagatgcagtgtcttgcagctgttggagtggtttctggctgggagcaggacgcctacagagcagttgcagaggaccttctgtctccccatggcggaggcaccattccaactacggaacctttgttgtgttttggagggggtcgtgtgcttccagcacctgccgcctctgccagccacagcactctgcctctttgttctgagtgcccgggacagagttgtatagctgctgccttttggagagaggagtcagctttgggcttgaatgtatctggagatagcccagctttcatgccatcttcacatttcctgtgtacatggtttcttttttttttttttttagatggcgtctcactctgtcgcccaggctggagtgcagtggtgcagtctcaactcactgcaacctctgcctcccaggttcaagctattctcctgcctcagcttcccgagtagctgggactacaggtgcgtgccaccacgcctggttaatttttgttttttgctttttctattttatctttttttgagacagagtcatactctgtcgtccaggctggagtgcagtggcgtgatcttggctcactgcaacctccggctcccaggttcaagtgattctcctgcctcagcctcccaagtagctgggattacagatgtgcaccaccacacctggctaatttttgtatttttattagagatgggatttcaccatgttggtcaggctggtctcaaactcccgacctcaggtgatccacctgccttggtctcccagagtgctgcgattacaggtgtgagccaccacgcccggcctaatttttgtatttttagtagaggcgggtttcgctatgttgcccaggctggtcttgaactcctgacctcaagtgatccacccacctcggcctcccagagtgctgggatcataggcatgagccaccgtgcccagcccctgtatacactgttgcggccccttcccacccagctgccgagagatggttctttcacaggtctcctgcttccgtgcaggtagcttattccagggacagggaagcaggaggaaaaagcactaggaggaagaccgcagactggattcagaacaggctatcgtggagagctgtgtgcttcgctgccggcctgaggctctgcgttcccctccttggtgctcaggctgcccggcatacgcagcaagtgctgacccagcaggcagcccacgtgcgcttcaggtgtgggaggctctgcgggctgcggggaacaggatcgctgtgggaggttgagcctggagctctgaacagccactctgcgcccaatctgctgtagcgctgagggtcaggaaggcctctgggagttctctagaagaaggcgctggggaggaggagttaacatctcatttcattagagcatgccagttctgttctgggtgtgacttttgaagaatattgagttctaccagtagaactttggggactgaaacctgttgaggatttgtagtaagactgtgtcccgaaggcgttcttccttttcttctgtctctgactttaacaagcaggtttccctataagctttggtgtttgttaaacagatcatttgtatgtgcaataaaatatgtttaaaaattagaaaaataacatctcccgatactatgttattttatatttttaatggtatgattacttttatttgattttctggtttgtgatgataaatgcataagaatggcagtgttctctgcatcatgtacatttcaaggtgtagactgtgttctgaagggagagtcggccccacatccttaccttcttttcctgtggtttattgcagaactcagctgccttcacctcctcctgccatttttcatcacttctgagactgttagctcttagaccccccaaatagaacagtttcctttgtgagcccctattatatgcttgccaccattgtttttcaaacctaggatcctccaaactcagtgccactcagcctcttctactgatgaagaaactggagttcaaaggcttgcttgcagcttcccaggtgtatgacgagtatttcaggtcggccagcgccttgtgaagcccacactccagggttgagggcaacatgtaacaatgtcagggaaggctgaggaagtgctgtgccatcgcaaaagaataaaatataagtctagaaatgcggaaggtactgtacagcatcacagctacctaaacttcctctatgggaagacagggaaagtaggcgttagtggcaagacagagtggctttgagtctaagtgtcataataaactctgacggggaaaaataaggggcagcatttgcacatgtgtgctgcagattacccgctgtgaggcagcggtgagtttgttgccttgtgttttaaaaagtaattttctgggccgggcgtggtggctcacacctgtaatcccagcactttgggtggccaaggcaggtggatcacttgaggtcaggagtttgagaccagcctggccaacgtggtgaaaccttgtttctactaaaaatacaaaaattagctgggcgtggtggcgggcgcctgtaatcccagctacttgggaggctgaggcatgagaatttcttgaacccaggaggcagaggttgcagtgagctaagattgcgccactgcactccagcctgggcaacagaacgagacttcgtctcacaaaaaaaaaaagaagtaattttctgatctagcatgtggattcttgagtcatcttaactaagagattgggagcagcctgtgtggctgacaggccctattgctcatgacttgtgtatgtgtacacgtgtgggatgtgtgtatgcatgtgtgtatatgtatgcagtgtgtatgtgtggagtgtgtgcatgtgtgtacatgtatgcatgtgtagagggtgtgtgtgtgtatatgtatgggaagtatgtatgtatgtatttgtgtgcctgcatgtgtggacatgtgtacgcatatccagtgttaaccctgacacactggggaagtggaaatagaatgaataccctgtatgtttcagctcctttttgagtttatcctgcacgaccagcttatgagtaggtgatggtatatttttggtcacctacagcacttcctcagcctcccctgacatgtctacatgttccacccccacccccggagtgtgggctttgcagggcgctggcggacctgaaatactctgcacacctgggaagctgcaggcagacctctgagctccagctcgttcttcagtaaaaggggctgaatggtgctgactttggaggattccaggtttcagaaataatgggtgagaaagcagagcctcagagctatcaggtgacttgtgacaggcttgctcagatgagagctggagcccggactcggacccaggcctgccactcagagcctggcctctgtcacagttcccctcccattgactttcggggcccgtcttaggagctcgaccggcggccagcaaaacattccctccacagcagagccacctctgggtaaactgataaaaatgagcttctgaacctgccaaggtgccagggctcaggccttggcttcagcaatgtcattcccccagcagacggtgagtgggtgccagccacagtcaagcacccactgtgctcttcccccaaggcctggcctgggttagctggctgtcctgcccctcccctcccctcccttcccctcctctcccctcccttcccgggggagggtgcttgactgtggccagcgcccattcatcgtctgtggggagaatgacattgctgaagccaaggcctggctttcgacaagagttttgctctgttgcccaggctggagtgcagtggcaccatctcagctcactgcaacctccgcctcccaggttcaagtgattctcctgcctgagcctcctgagtagctaggattacaggagaccactaccacatctggctaatttttgtttttttttagtagagatggggtttcactatgttggctaggctggtcttgaactcccaacctcaggtgatccgccttcctttgcctcccaaagtgctgggattataggcataagccactgtgcccagcctatttattttattttttattttatttttgagacagggtctcactttgttgcccaggctggagtgcagaggtgcgatcgtagctcgcccacagccttgacctcctagttccaagtgatcctcctgcctcagcctcccaagtagctgggactacaggtgcacatcacatgcccagctaatttttgtattttttatagagacagggttttgccatgttgctggtcttgaactcctgggctgaagcaattcacctgcctcggcctcccaaagtgctgggattacaggtgtaagccactgcgcctggcctgcttcttttttttctgagcatgcttttaaaatctctagtaggtgatacacccagccttcagttctactcctactcaagcagcatggtaattttaagaaaattttaaaaggaaaaaaaaagcatattctaatgtgtcttcttacctgatgcagaagatggagttagcctgagtgacccattccttgctagcagctttattggaagctgggatttgggtatgtggataactcatgctgagagctgattaatcacgtgcatggccctgttagggttcaactgacttaggtaaatacaacacaatgatatttcagctgtgacctttcagagaaggaagctccttgtttacataggagttatagcagcactgctctcccagttcaacaaaaactggtctcactggttacctgtggaaccccgactccctgagatggctctcggcagccttgccttctgcctgtttctccagcttatctcttgccaccgccactccctcaagctggcaaagcaaccgggtcatgccatttcagtcaaggtggaatgccacaccatgagcacttgggaagtcctggccaagtgctggtctgttccattttcgtcctgtctaaagggcactaacagtgccccctggcaggtgcttcactgagcgtttgagcctgtgtcacctggcctccctgactcactgtgccactgtgcagcttcctttcagtggcatgaaaagaacacccttacaaagatgcctgacttccagaaggaagacatgtcagtgtttcaccgtgaaaaatgcaactcctcgtttgcttggtgggagacgtgcttttaaattggctgacttacatttctttctagacaaagacatctggcattctgaagtcagcattgtactctgtgcaaaagtagggtgactgtctcttctaggaacttttaaaggaaacatttaacatttttattttacgggctaaataaagcgttttaaaaatgaaacataattctgtccactccccacccatatggttaaattactccttttttaaagcattttaaattgtggtaaaatacatataaacaaattgtggtaaaatacatataacataaaatttaccatcttaaccatttttaagcatattaacttgtgtccatgtgtagccttttggaatttttcatcgtgttccctacacagaatgcttctaaatcatgccgtgtcctggggactgtcatactgtcaggttgtgtaaagtcaaaggaaacaaagatattttcttgggtggagcaacagtgacacttcctgatttctattaagcttggatgtagtttgaatctttttttttcaaacatactttatacttaacattttagtattttcttttaaggtcagcctactgagcctatgcatataatgaggtcaaaaatgttacaattatgtcctaattatagctcaaggaatgcttttagaacagtgtagttcctgagtgaaataaataagaaagtttaatttcctgtttaatcagtttctcctttttaaatttttttagcactttaaaaagtgattttgaaggctgggtgcagtggcttacacctgtaatcccagcactttgggaggccaagacggtggatcacaaggtcaggagttcgagaccggcctggccaatatggtgaaaccccgtagctgggcgtgctggtgcacgcctgtagtcccagctactctggaggctgaggcagcagaatcgctagaacccgggaggtggaggttgcagtgagctgagatcacaccactacactccagcctgggtgacagagcgagactctgtctcaaaaaaaaatgggattttgggttaggcacagtggctcacgcctgtaatcccagcactttgggaggctgagacaggtggatcacgaggtcaggagtttgagaccagcctgaccagtatggtgaaaccctgtctctactaaaaaatacaaaagttagctgggcgtggtggcatgcacctgtagtcccagctacctgggagactgaggcaggagaatcgctggaacctgggaagtggaggttgcagtgagccaagatcacactactgcactccaacctgggtgacagagcgatactccgtctcaaaaaaaaaaaaaaaaaatgattttcagctgggcacagtggcttacacctgtaatcccagcactttgggaggctgaggcaggcagattgcctgaggtcaggaattcgagaccagcctggccaaaatggtgaaaccccgtctctaataaaaatacaaaaaataaaaattagccaggcatggtggcacatgcctgtaatctcagccactcaggaggctgaggcaggagaatcacttgaacccaggaggcggaggttgcagtgagccgagattgcaccactgcactccagtgttgggggacagagtgagactctgtctctaaataaataaattaattaaattaaaagtgattttgaaaacatggccatttttcctggccagttcatctctttcttttttttttcttttcgagatggagtctcgctctctcactcaggctggagtgcagtggcgcaatctcagctcactgcaacctctgcctcccgggttcaagtgatcctcccacctcagtctcccaagtatctgggattacaggcctgtgctactacgcctggctaatttttgtatttttagtagggacagggtttcgccatgttgcccaggctgatatcaaactcctgacctcaagcgatctacctgcctcggcctcctaaagtgtgggattacaggcgtgagccattgtgccccacctcagttcatctatttctctgtgatatttattctatagttgcagaagaatatttctcatatgatacgtatattaagcttactggccagccagtttgggtttctggatagtgaaactgtcctggaagtgtttgctgagcttttcttgctggagaagattcttggcaaagcctggatggaggatggagatgagaaaggtagtgtgagggtggcacacctgttttgtgctaattccagtcttggcagccctggacctgccgggagagggatgacagtgacatgtggcccagtttttgctcagagaaggaaaagtcaccaagaccgaccatgagggcaggagctcttgcttctcctcctagatgagagttagaaggaatttgagagcaaggcttctttcttgggatccaaatacttcttaccttggagttttcctagccgtggctagtgggtcataatgtcagcgacattgccaaatgggagcggaagagtgtcgttgggggaagggtgaagacgctgtcagagaataagacataccccactagaactttaaaaaacaagtcagaaaaaaaaaaaaacaaaaaacagaaaaaaacccacatacccacacatacaccctgaagagggaatcaggagtttgcaagccctagaaggtagttattgtggtaattaaagattgaaagctcactctcaagagagctgcaccaaatccctgggctgcctcagggtttgctgaaatgagtcccactcttctctggtcagttcagtccaggaggggctggcgtgcaagtgtcactcaagaattcatggctaggctgggcgaggtggctcacgcctgtaatcccaacactttgggaggccaaggcaggtgaatcacttgaggtcaggagttcgagaccaatctggccaacatagtgaaacctcgtctctactaaaaatacaaaaattagccgggcatggtggcacgtgcctgtaatcctggctacttgggaggcggaggcaggagaattgcttgaacccggaaggcggaggttgcagtgagccgagatcacaccactgcactccagcctggcaacagagtaagactctgtctcaaaaaaaaaaaaaaagtttatggctcttacagccttagccagcaagagcaattgccatgaaacagcattatttcttttctctttatgctattgtggtaaaatacacatggcctaaagttgaccattctaaccatttttaagggcacagttcagtggtattaagtacattcatattgtgtatcctgccatccatctccagaaccttttcatcctcccaaacagaaacttccagatggagtcctaccgaattgcccaggctagtctcaaactccttaggataactttcattcttggctgggcatggtggctcatgcctataatctcagcactttgagaggctgaggtgggtggattgcttaagctcaggagtttgagactagcctgggcaacatggcgaaaccccatctctacaaaaaatatagaaatcagccaggcgtggtggtatacgcctgtagttccagctactcgagaagctgaggagggagaattgcctgggcttgggagattgaggctgcagtgagccaagatcacaccactgcactccactgtgggtgacagggcaagacactgtcaaaaaaaaaaaactaccaaaaactaattttcattctttttttttttttttgagacaagagtcgcccaggctggagtacagtggcatgatcacagctcactgcagcctcaacctcctgggctctggtgatcctcccacctcagcctcccaggtagctaggaccatagccatgtgccaccacacccagctaatttctttgtatttttttagtagaggccggtttttgccatgttgcccaggctggtctccaattcctaggctcaagtgatctgtccttcttggcctctcagagtgctgggattacaggtgtgagccactatgcccagccactttcattcttttttttttttgaaatggagtctcactctgttgcccaggctggagtgcagtggcacgatctcggctcactgcaagctccacctcctgggttcacaccattctcctgcctcagcctcccgagtagctgggactacaggcgcccgccaccacgcccggctaattttttgtatttttttagtggagatggggtttcactgtgttagccaggatggtcttgatctcctgacctctgatctgcccaccttggcctcccaaagtgctgggattacaggcatgagccaccatgcccggccccactttcattctttagaacaaggaaattcatactgttttatctaagaaagaagctttcctaagtcctgtacttggacgagggcaccggtgttgtctttgggtacagggcattagcaattgtaaagaacagtgttgaaggggtgaataagtaatatcttttcctcatccattgcgaggttcatggctgagacccctataacgaaagagagattaacgagagaaaagcatgcaaattaagttttacatggcatgagagccttcagaaatgaagacttggagaaacagggattccaatctgtgtctctgtgcttgggtttgatgaagtgtgacagtcgcgtagaatgactggatgcgggctgtgatgattcaggaataccccggggggaatttagcaaggcctgtttgttcaggttcttcttggtgcctctgggagacattccttccctctgggtatagggcaggacgcctgtcacagggcgttcaggggagaagggagggagatcttgatctccctaggctttatgagctgcctaggctttatgagctgccacagggaggaaggtgagagtatccttcctgcttctgctgttttctcagtttcccaggtaccatattttggggtagcatttcctgcaccccattagtatccaccagagaagtttgccctaaaaatgtgctgtccctcttgtgtctggtgctggccttcagtgagactgaagggcatcacggaaaagtctcgtaaggtggaattgcggggagcccgagtgggaacctccatggtggcctttaccactgatccaagcaactggttctcccttctccactgggctacagctctgagcttctgcacaaagagtggagtctccatctttaaatattctgcttatttttcaatttgtcattatactaagaggtcatgtgtgtggattacttactttgtgctgggcagtatgctaaattctttatacatggtaactctttatgcttgtaacttcgtgaggtatcacagtcctcatttttacagatgaaacttcagcccagaaaggtaatttgcccgaacagcaaattctgaaactggaattggtggctctggtgcccaagcttgcatatttagaccaggcatcagtaatagcctcagttttgtttattgctttgttaagccttagttttgaagcacttgttaagtgcgaggctccatgtagagtgtataaacactcaatctctgtgtgacgacagctccaaggagcagtccagcaagttctgtctggccaaatctagacctggttttgattaactttgttcatgatctctagatcactctgctctatgcttgaacctgtatgcttgagtcaagcttacctctctgatgggtgaagaaaatgatatttcactgttatattaattttatttttcttaccacaaaggaaggatatctcttcatttttctaagtcctgttggttcattgcctttgcttttgctgcatttctctctctctctctttttttttttttttttgagacagagtctcactctgtcactcaggctggagttcagtggcacaatctcgactctctccaacctccacctcccaggttccagtgattctcctgcctcagcctcctgagtagctgggactgcaggcgtgtgccaccacgcctggctaatttttgtatttttagtagagacagggtttcatcatgttggccaggctggtctcaaactcctgacctcaggcgatctgcccatcttggcctcccaaagtgctgagattacaggcgtgagccactgcacccagccttcttgctgcatttttaaagaagacaactgcagcttgtctctcttgataagcagtctgagtttgcctttagtgcaccttttcttcaacagaaatcagttgcctgtctcagatgggccttgctcacattattcacatgggctgggtacagtggctgacacctgtaatcccagcactttgggaggccagtgcaggtggatcaattgagcccaggggttcgaggccagcctgagcaacatggcaaaatcccatctctacgaaaaaataccaaagatgctgggcatgatggctcatgcctgtaatcccagcactttgggaggccaaggcaggtagatcacttgtggccaggagttcaagaccatcctggccaatgtggctcaacttgtctctactaaaaaatacaaaaattagccaggtgtggtggcacatgcctgtaatcccagctacttgggaggctgaggtgggagaatcacttgaacctgggaggtggaggttgcagtgagctgagattgcaccactgcactccagccttggtgacagaacaagactctggctcaaaaaaaaaaaaaaaaaaaaaatccccccaaaacaaaaaaaaaatcagcagggtgtggtggtgcacgcctataaccctggctactcaggagactgaggtgggaggattgcttaagcctgggagttagaggttgcagtgagttgcaatcacaccactgcattccagtctgggtgacagagtgagaccctgtctcaaaaaatcaaaacatgataaacatggtcaacatacagtgaacaagttcattccacttttactggttacagcctcagttctgggctatgtgtctttttctatgtctttttcacattaaatgaagtgaggtaacacatgtaaatgagaaaaaatagcaatcagttctattaatttgaaatgagtggttgtggttccttgcaattgcgttcatatgaaaagagatctatcagtcaggatagggaaagttatgcacagtaacaaacaatcctcaaatcatggtgacttttacaacatggtttatttctgccttactggatcagaaagtagtttctgctttctgaaatttctcaggggctttatctcaacctgtgtttccataatcttagaggcagggaaaagagaagtgataagctatgagttggctttgaagatctgtgccagaagtgactcccataattctattcatcttgttggccccaagtatgtcacgttgccgtgcctatactcaaaagagcagaagaaagggatcctgctgtgtgcacagactgagggaacctcttaggaatcccagatgctccccatgggaagtacttaacatcttttttgtcccaaatagcagaagtcttagagtataatgagcaaaaatgagatttggtagtgttaaaaagagaaaactctgccttgacaaaaataatggtacaggtcaagacagcttttagctctcctgctcttgaatccatggagaaagcttgttagcctgtgatcagtaagccatgggagtcgtggaaatgttttctgcgggctggctgggcattgctggtggtgaagctggatgttggctgcctgaccgttctatgtgtttgaaattgcccatgagcaaatgtactgtttgctatccattatccacgttcattccttctctgctgctaccgtcagtctgttttcatcctttgtgacagtgtggaagttaagtggcctctcctctgttctttttttttttttcctttttggaacataagcacattttttcacattattttattagcattccctttgttttaaggtatcacattcttcataaatgatgttttaagggctaggcgcagtggctcacacccataatcccagcattttgggaggctgaggcaggaggattgcgtgagcccaggagtctgagaccagttgatcattctgagcaatgtagggagaccttgtctctacagaacaatctttttaaattagccaggcttggtggcatgcacctgcagtcccagctattcaggaggccaaggtgggaggatcactggaacctggaggttgaagctgcatggaaccatgatcgcacacttgctctccagcctgtgtaacagagtgcaacccttttttgatgaccactagttatatctgatttttttttttttttgagatgagatggagtctcaccctgtcgcccaggctagagtgcagttggctcactgcaacctctgcctcctgggttcaagtgattctcctgccttagcctcctgagtagctgggattataggcacgcgccaccatgcccggctaattttttgtgtctttagtagagacagggtttcatcatgttggccaggttggtcttgaactcctgaccttgtgatccacccacctctgcctcccaaagtgccaggattataggtgtgagccactgcacctggccatatctgattttttttaaagatgtcattttattgaatttgagaattcacttagaccacagatatctgatgaaaaatattcttgttttccttgtcttcctttcatgtcctgcataacctgagtgtgctttagaggtgggatcgtagtgtttgcgtacaagaggaaagttgtcatggccctgtggtcatgaggctgagggcccacgattctgatgtggatggaatgcagctggcattgcacatgtcttagatgctcttcccaactgcccgctttgttctaggcactgtgcagggtgctggagacagcagagaagagtgagatagtccctgccctcgcactgtagagggaaggcctgttctgcctccctgagatgggggcactgagctaaatcacacgtgaggaagagttagcaaggtggccggaagggcatttaggcaaggggcagtgaaaggaaggctggagccgtgcttgggagaccttttaagaaacgtgaacttggccagatgcagtggctcacggctgtaatcccaacaatttgggaggccgaggcgggtggatcccttgaggtcaggagttcgagaccagtctggccaacatggtgaaaccccatctctactaaaaatacaaaaaattagctggatgtggtggcgtgtgcctgtaatcccagctactcaggaggctgaggaaggagaatcgcttgaacccaggaggtacaggaggtggaggttgcagtgagccaagatcatgccattgcactccggcctgggcaacagagcaagactccgtctcaaaaaaaaaaaaaaaagaagcgtgaacttttaccctgtaggccttcagtaaatatttgtgtgagcaaatgaactacttatgcagatcattccctgataacatcagacactgtgttataagattaagccggccaggcgcagtggatcacatctgtaattttagcactttgggaggccgaggcgggtggatcacaaggtcaggagattgagaccatcctggctaacgcggtgaaaccctttctctactaaaaatacaaaaaattagtcaggcatggtggcgggcacctgtagtcccagctacttgggaggctgaggcaggagaatcgcttgaacctgggaggcagaggttgcagtgagctgagattgcgccactgcattccagcctgggtgacagagcaagactgcatctcacaaaaaaaaaaaagaaaaaaaaagattaagccatgaggggcctcccacgcacaaagttctgcccatggttactctgtgccacgaaggacagcatcgatctgttcacactctcgaccttgcttctcgggtacagcaagcactctgggatgctttcccgcagacgtgtcgtgtatcctgcttatggaagcctagcttgggactaccattgctccagcccagtggggtggtgctgttttcctcctggagaacacgggttcctcccagcaccatctccaactggtagaaatgtcaggcgtcacagcctggaaggctttaatcccaatccatatcttctgagtgagcccctactcatggcttcctgagatggagaagcacacggccctcacccatcacgggctcagaggtgtgaccgagaagctggccacctactaagaaagtccttgtgcctgcctcatctccagcgctgccagagctgctgtggactctcgccatgcagtccctctgcccctttgttgtgtatgtctctttcttacagccacactgggacatggctgcagtctctctggcttcagcagatccactctccattgtaaatatcgctgccttcttcctcatgtgttttttttgtcttgtttgacaggctcttcagagtaacctgaggtactccttgttgccaagacggctcctcatcagcaaaagattagctcagtgtttgcaccctgccctgcccagtggtgtccacttaaaagctctggaaacctacgagattatctttaaaatcgtggggaccaaatggctggccaaggacttgtttctgtacaggtgcgattgcttctctgctgtgttcctttttattacccaagtaaccggtatttcagctcacaagatgagaaaatgacaaacaggcaaaataagcgtagggctgtgtgtgcaacagtttatcataaagccatcaccaggagacgtcactgggcgccttctggagtctatccgtcctaactttgctttctttctttttttttttaaatttaagttctagggtacatatgcacaacgtgcaggtttgtcacacatgtatacatgtgccatgttggtgtgctgcacccattaactcgtcatttacattaggtgtatctcctagtgctatccctccccactcccccgaccccatgacaggccccagtgtgtgatgttccccttcctgtgtccaagtgttctcattgttcaatccccacctatgagtgagaacatgccatgtttggttttttgtccttgcgatagtttgctgagaatgatggtttccagcttcatccatgtccctacaaaggacatgaactcatccttttttatggctacatagtattccatggtgtatatgtgccacattttcttaatccagtctatcatcgatggacatttgggttggttccaagtctttgctattgtgactagtgttgcaataaatatacgtgtggatgtgtctttatagcagtttgatttataatcctttgggtatatacccagtaacgggatggctgggtcaaatggtatttctagttctagatccttgaggaatcgccacactgacttccacaatggttgaactagttaacagtcccaccaacagtgtgaaagtgttcctatttctccacatcctctccagcaccccattttgactttgctataagggaactttagcatctgaacgtgcggacagcttcattgctggcttgttacgtaacagtgttttgtgaccatctcatgtcatacccacacatcgaaaccagcagtttaaatggccagctgtttgcttgtgaaaactcccctcggctggcttgtcacctgggacttctgactgggtatcttatttctgccccgctccctctcgttctttctcgaagctgcgggttatttcctctcctggcacacgcggcggtgtcggtgaggccggtgctgctcaccctgtacgagaagtacttcctcccactgcagaagctgctcctgcccagtctgcaggccttcatcgtgggcctgctgcccggccttgaagagggctccgagatctccgacaggtgcgtgggcgtcttgtccaggctgtgtttactccactgctttataagacgcggggagggggccgggcgcagtggctcacgcctgtaatcccagcactttggaaggccaaggtgggtggatcacaaggtcaggagatggagaccatcctggctaacacgatgaaaccctgcctctactaaaaataaaaaaatttagccgggcatggtggcgggcgtctgtagtcccagctactcgggaggctgaggcaggagaatggcgtgaacctgggaggcggagcttgcagtgagccgagatcgcaccactgcactccagcctggacaacagagactctgtctcgaaaaaaaaaaaaaagacacggggaaggaagtgcagagacatgggaagcagcagtaggtgtggaggtcgggttgctctttcacatttccttggtggttgtgatttcaaattcctcccgggaatctctcttgtctctttaccaaaggggaagtcccgagcccggagagatgagatcctttaggcggagagaaatgtagctcattaataagggagaccatagtgcagggttcccatgatgtcctgtcccgttacggagttacccacagagtcaccatgtgtggagggaagacataccctcttagggcgcctagtgtggaggaaatgaagggaccctttcctgggcacttgcagcgtgcattacacacatgatcacattgtgtaatgaattcctctgctccaggagttacctccatttacaggtgagggtcagagggtaagaaggtttcccagtcgcacagtcagtgagccccacagctgggattctattccactgtatctattggattcttttttttttttttttttttgagacagagtcttgttctatcacccaggctggagtgcagtggtgcgatctcggctcactacaacctccgcctcctgggttcaagtgattctcccgccgcagcctcccaagtagccaagattacaggctcgtgccaccacacccagctaatttttgtatttttagtagagatggggtttccctctggcggccaggctggtctcaaactcctggcctcaagtgatccgcccacctcagcctcccaaagtgctgggattacaggcgtgagccaccacacacggctcatatcagattctaaagtccttcttctttccattaaactaggctgcttctaaattaaaaagcaaagccagggcagggcttgagaaggcaatttagtgtgatgtgaagcagaatatcttgacaggtttcagtagcaccttggagaaatctatagcactcatatgcacaaaagttcatgtagctttgtgtgtgtgtgtgtgtgtggtcactgcttaggaatgggagaaagtgtgaatctgttccgactattgagtatggccgggcacggtggctcacacctgtaatcccagcactttgggaggccagagcaggtggatcacttgaggtcaggagttcaagaccagcctggccaacatggtgaaaccccatatctactaaaaatacaaaaaaattagccggacatggtggtgtgcgcctgtaatcccagctacttgggaggctgaggcaggggaatagcttgagcctgcgaggtgaaggttgcagcgagccgagattgcaccactgcactccagcctgggtgacagagtaagactacgtctcagaaaaaaacaaacaaacaaacaaaaaccagactgttgagtatacacagtgacctttgtttccggagaagtataaagtaagaactcacttccagcttattaactcttctgagagatgccacagtgattcacctctgttaatgggacctgttttaagagcccatgttcagtcactggtgacttttgtgcttgtaaaagctgccatgtgattacacaacgcgctgctcatattaccctgtgctggaggccctagtcaggtcaccctttcctgtggtgtcagctgtgactgaggggtgcaggaggctggagtctaacccaggaatcaatccaaggtccatttgcacggctcccccagccttaagtaaaccaagtaatcagaatggtttgaagggttagttaggaagtggccaagggtgcatttcgtgagctctatatcaggacttgacagatgtaactaaaacattgcactttaaccatttcaagctctcacatagaccaggtgttggctctccatttcccaaaggagaatccacctttacagtttctaccttaggaggcagaatctgtctcgttgcggttttaagcccagcgccaggccctgtggctggtacacggtgagactcggtaagtgtgtgttgagttaacgagtggtccaggtcacataggaggcagctggaggacattgccagactccatgccaatggactcctaatcccaggccctttctagaagttctgctgtgtttgtgttctgatgacagatatgtgagtatacatcctacatgatttttccatcattggacagatgaacacattagttccctaaagcttactgtgatcttttaaatctgtgtgaatcacactagaagtgtaaatagttggagtgtttttgttttcttagttgataaataaaggttcatttgaacagttgctaaagttgcttaacattgattttttttctgaatattgtgatttcttgacattgaaccaagagccaagtaaagcttcatgaatcaccgaatctatttagctgtgacagaaaaccaaatgcagtgtggcacccagaagtgattagttatcagctctccaaggtggatgcaggtgaaaggttatacaataatctctgagccagtgtgttgcagccacagtaattgaagtgactgtacaagattttttggttgctatatccatttcagtctgagacggtttggtaactgttcccagaagtgcttgggtagccaggtgtggtgacaggcacctgtaatcccagctatttggaagactgaggcagaagaatcacttgaacctcggaggtggaggttgcagtgagccaagatcgcaccactgcactctagcctgggcaacagagcaagactccatctcaaaaaagaaaaaaagtgcttgggaattgagtgaaacaccccaacaaatgtgcagagagcagaaagggagggtgcagtggggggggtcatgatgagcacgtgggtagaaattgcaaagtggtgagttaggttgagctggtgaaggctgggatgactcacaggtttcatgtaggtggaggctgtccctggtgtgtgctttttagtgaaccataaggaatgaaacttttggcccctgttagaacttattatccaccctggctttctaaccctttggggtctgcagataacctatgactggtcagaaatcctttttttttttttttaagtgcccatgaaatagctacatagctgtgttttgctgtactaagaaaacaagattagaacagggaaagcactaaactcttcttctcaggagatgaggagaggtgaatgttttaaatggtttgtaagaaggcaacaactagctcaccagatatttccatttaaatcagtaattttcaatgtagtagtaattttgcctctcagggtacatttgacaatatctggagacagttttggctgtcacaactgggggtggggagggtgctactgatatttagtgggtagagtccaggagctgctgaacattttacaatgcacacaggtgccccgacaacaaagacttacctggtcccagatgtcagtggggtggacgttcagaaaccctggcttaaagagttgaaaaatatttattgacatttcttttcttttggagctcattaataagggaggccatagtacagagtttccatgatgtcctgtcccattaaagagttacccacagcgtcaccatatgaagaggggaagacgtaccctcttagggcccctatcgtggaggaaacaaatggaccctttactgagcacttgcgacgtgcatgacccacatgatcacattgaattccagggtcttgctgtgtacccaggctggagtacagtggcaggattatagctcactgcagtctcaacctccaaggataaaacgatcctccggcctcagccttccaaagcactgagattacaggcatgagccaccccttttggctgacatttctattttttttttttttttgagacagtctcgctctgtcgcccaggctggagtgcagtggcgcaatcttggctcactgcaacctccacctcccgggtacaagcgattctcctccctcagcctcccgagtagctgggactacaggcatgcaccatgacacctggctaatttttgtatttttagtagagacggagtttcaccatgttggccaggctggtcttgaactcctggcctcaagtgatccacctgcctcagcctcccaaagtgctgggattacaggcgtgagccactgcacccagcaccaacatttcttttggttggtttcaggcactgtgatcatgatctgtgctggttcgaggctttttttttgccccctctttagcgctgtttctgacctgcagtttacagtacagggtgctgttgtcactgccctgcctcttcagtttcagatgattgtaccaaagcggtgctgtcttgtgacagcttggctttccatggttgtccttttggcaagcagctgcagaaccaaagttgtggagtgcttgggatttgcggtgcccggcccatgccactcacctgctctcagttgtggagtggagcatgccagtgtcatttgaaggagctgcgtttgcaggaggcatgagagagcataagctgggatgagttaggaaggatggaaatacttggggtttggaagttgggtttttttttttaatgtttgttggttttttgtttgtttttgttttgttttttgagatggagtctcactctgttgcccaggctggagtgcagcggtgcaatcttggcaccctgcagcctccacctcctgggttcaagcaattctcctgcctcagcctcacgagaagctgggattacaggtgcgaaccaccatgcccagctaattttgtatttttagtagagacggggttttaccatgttggccaggctgatcttgaactcctgggctcaaatgatccacctgccttggcctcccaaagtgctgggattacaggtgtcagccactgtgcctggcccgtttgttggttttgaattaaaagtttagggttcccagtggggcatggtggctcatgcctgtaattccagcactttgggaggccgaggcggggggttacctgagctcaggtgttcaagaccagcttggccaacatggtgaaaccccgtatctaccaaaaaaaaaatacaaaaattagccaggcatggtggcggctgcctgtaatcccagatactcaggaggctgagccaggagaatcacttgaacctgggaggcagaggttgcagtgagccaagatcgtgccattgcactccagcctgggcaacaagagtgaaactccgtctcaaaaaaaaaaaagtttagagttctggactgtaaactgcacactaatattggaatttaacaaccgagatgatcatagtaactcttgttgagtaggaagttatttcgtttttaaccccgtttattttgctctctcataccaaaggtttgtcatagttgctgttgtttctactatgatgtcatttaaattgttagtatgcatccattttttttagaataaaatgagacttaaaaaacaaagctggctgggcacagtggctcacacctgtagtcccagcactgagaggccatgcagggtggaccacttgaagccaaaagttcaagaccagcctgggcaacatggtgaaactctgtctacatataaaatgcaaaaattagcccagtgtggcagcatgggtgtgtagtcccagctactcagaggctgaggcaggaaaattgattgagcccaggaggtcagggctgcagtgagctgtgttcatgccactgcactccagcctgggtgacagagtaacaccctgcctcaaaaaaaaaaaaaaaattatttctttaatagaaagctagtagccagttttcagaatattgaagagacaacataggcagcgtttcccatactttttgagggtggaacccctcttctgtggaacatctctagtggccagtgttccatggaacatactttgggaatatgcagttctaattaaagggggactgtgacaccacgatgtgtgcattatagtgtttgtgatgatttcagagctaggcaaagacaagctctatttgtttactcagcctttaatagaagaccaatcaataacctcagccattaaatcgccctgcctacttcttctatacacttagccattacttatgtctcttcatttttattttttctaagaagacggtaccatgcattatttcctgcaatattttacaggaagttcagactaattttaaggagaacaaaatgtacttttaatataacgcgatggtagatatttttgaaggaaatacaaaaaaattaaccgaggggtttttcgagtgccaacctggagtcacttgctcaaataggcactggggctgtgacagcaaacagagtggacctagtagtaattgcaggcggcatggcccaagcattaggtctgttcttctgggttgagttttttttttttctttttttcttttcttttttttttttgagacagagtctcactctgttgcccaggctggagtgcagtgacggcctctcggctcactgcaaactccgcctcccggcttcaagcaattctcctgcctcagcctccccagtagctgggattataggcacctgccatcatgcctggctaatttttgcatttttaatagagatggggtttcaccatgttgtccaggctggtctcaaactcctgacctcaggtgatccacccgcctcagcctccccgagtgctgggattacaggcatgagccaccacgcccagccaaacagttttttttgttttttttttttttttttttgaggggactctcacttcattctcacaacatctccacgaggtcgaggctccttcccctgtcttttagctgagcacgggcgtgcacagatgttaaactggtcctaggtcctgcatctaggaggcatcacaaccaggatctggacacgggagggccaactctggcaagctctgtgaaccaacacattccaccgggttggtttttctgattgttttttgtggtctttgcagataggaagcatgtgagaaactgaatcctttcaggtaatgagtcagatccttcgtggggtgatatcccttagggggaatgtgcctctgctgttttactggtagatgctgtcacccagcctgcagattgtgtgcactgaggacagggaaagggccgcagtcagctgcagggacaccaccgaacagacatgggcctggccttggtcagcgtcaggggaaaaacgagccctgatccactggtgacgctgcttctcttaaaaggatgcatgagaaggtgctgactttgtatcacgggagacctagataaagataagaggcgaacaaatgcccggcctcagcacaagagcccctgggagcgggagtcagcacatgcaggtgctgtgggcagactgaaaggaaacaccactccaggctgatggaatttgcagggtcgtgggaggccccaggcagatttgcccctagcatttctaaaggcagatgtcacttggcacatttttggctgtgctcaagttggtggcatctaattgcttaagtctttgatcagtctcctcagcatatgcttgtttttgatacaccaatggctccttccgcttttctgtgaagtggctgacctgcctatccctcttatggtggaacctcccttccgtgagcacctaggcatccgtggcacggccagggtggagatgggtctctgccctgccacgcacgactgcttagccactttccattggccaagacaccgcgctgcctagtgacattggttttggcaaatccagggtcagtgtgacagccagcaggtggacacacacagcagggtgagagatggcagcggctcccggcgatgaggaaggtggggcttccccagccaggcgaatccgctgtggttcttcatgcagcattcgcagagcagtgtgcagtgggactcgggaagatggggcgagcccttgaaccctatcctctctcatcaacagaacggatgctctgctcctgagactgtcgctggtggttggcaaagaggtgttttacaccgccctctgggggagcgtcctggccagcccgtccatccgcctccctgcctcagtcttcgtggtgggccacatcaacagggatgcccccggccgggagcagaagtacatgctggggaccaatcaccaactcacggtgggtgctgtgttcctcacagggcatggggaggaggcgacatgtgggcacagcatcctcatgggcaggttgtcactgaagctgcaaagggacatccaggaaagggaggtgcaccaagcttaagtctgggtaacgaacggctgagcaaggcgagaaggaggccttgtgcagttgaggctggtggtggcttttttaacatatgcattaaggttttttttgtttttgtttttgttttgagacggagtctcgctctgtcgccgaggctggggtgcagtggcacaacctcgactcactgcaagcttcgcctcccgggttcaagcaattctcctctctcagcctcccgagtagctgggattacaggcacccaccaccatgcccggctaatttttgtgtttttagtagagatggggtttcaccatgttggccaggatggtctcgaactgcctgcctggcgggtgatccacccaccgcggcctcccaaagtggcattaagattcatacattcaaataagtgttcacaccctcagaggtcccttctggaggcccctggctttgcagaaatgtgcttagctgcacacggcgctcagacggcctctgcacgcagagggtctgctgcattggcgggtctttgtttccttcctctgtcctgtgtcacgggggccactgcccactcacacatggaaaccccctcctcccttggcgtcctccccctcctctcttgtctccattggctgctctcaaacctaaattattggggtcccccaggtatccatctccaggcccttcaagggaagctctcttccctggtaacgacatcccttctcgtgcccttagaaatggtaacctcccagatctttgtctcttttccccaaacctgcctcttgtgcttttgtgtcttgctgtctttcgccacctggtggtgttcccacactttgatcttaaagtgttcagattgaattcgcaggtgagaagatctgcagctgagtgtgaattaccctctggttccatttctctttgcaaaatgggggttgtagacctgcttcacaggatctctctgatgacaaggtggaaaaatggatgaaaagcgcctcgcacaatgatcaggacacaggcgaccccgatgaacacgtccctttcctgccccgtcagtatcccctttgtctctttctctccatcgtctcagccctgctctggcttcttgtctcttactcttggatctgactggtttcttcccatcccaaatctgctaagagatttgggatggggagaaagcctagctttgctcatatgtatcctgtgctttaaaaatgtctgacttcccggctgggtgcggtgactcatgcctgtaatctcagcactttgggagccctgaggcaggtgaatcacttgaggtcaggaggtcaagagcagccgggccaacatgatgaaaccccacgtttattaaaaatacaaaaattagcctgggcgcagtggctcatgcctgtaatctcagcactttgggaggccgaggcgggtggattacctgaggccaggagttcaagaccaccctggccaacatggtgaaaccccgtctctactaaaaatacaaaaatgagctgggtgtggtgatgggcgcccgtagtcccagctactcaggaggctgagacaaaggaatcgcttgaacctgggaggcgggggttgcagtgagctaagattgcaccactgcactccagcctgggtgtcaaagcgagactctgtctgaaaaacaaacaaaaaaaattagcagagcatggtggcgggcacctataatcccagctactcagctgtctgagacacgagaatcgcttgaacgccggtggcagaggttgcagtgagtcaagatcacaccactgcactccagcctgagtgacagagcaagaccctgtctcaaagaaaataaaaaaataaaaatatctgacttcccattgccaacagctatagtccaagctcaagagcattctaaccatctgctcccagccacagcacctcactcttccctgcaggccctgcgctcccacacgactgccacagggcctggcctcacagtgcctttgctcccggctgttcccttctgtccccctggctgtgcattcctgcccttcttcgaggtctcagtgtagctccttcctgttcttcaagcccagctttcccgtggagcatcattgttctctgcagttgaaagagctctcctcttctgaactctgagcgtttgtctgtggctctaatttcttatgcatctctagtctacctatctgtattcagaaaagacactcagaatatctactgaattgatcaggaattattttcccatgtgtcttcagagctttagtttaaggttcctgttggatcctttctgggatcgtagaatttgagatcatagaacccggccatctggtccaaacccctccggctctcacgtggaacagtgaggtctgcagctgaacgtcttctccgatgtcacgcagcctgtggcctcgagagctagaacccacaccctcctgacctgtggctgctggttctcttctgagtgatataacgcaggagtttcaagattcccgggaaaggttactttcgtttttatgaccataaagagtagcctgaaaatgctagtgccgtttgatcgtttacaggtgaagtctttgcgtgcctccctgttggactcaaatgttcttgtgcaaagaaataatctggaaatcgttctgtttttcttcccattttatacctgtctggtaagtaatttgtactcttctggtaagtcactggtgtttcccaaggggtgggatatagatctcaagcagttctgtcgtacgaggacagctcagccactcatgggcattatttgctggtagccagtgaaaagtccttgttcatttttgcaaggatagcgttttcattgcacgtattgaatagcttctttccatgggtaatgtgtaaggaaccagcccattttgagatagagctttgcagaccagcaaggaagggctgcgtgtcaaaaagtcagcaatctgccctatcattcccttgcagtaaatttctctgtccttctaataggattccaatgagagagccatccccctcctcagatctgacatcgtgcgcattctctcagccgccacccagaccctactgagaagggacatgtccctgaacagaagactgtatgcatggttactaggtactgagcagtatacacccttttaaagtcaaagttaatatgaaaccttttagtgctgacttctggaataagatttggtcttggtgatgtatctctgaatcatgaagtatggaaagataccacaatgactaaatatggcactggtcagttgaggtctgctgcctacacatagcttggttattttgcagtttcttttttaaaaaaggggaaataataagtgggatttttaaaatgccaactgaattccatttaagagcttgaaataccaccaaaaagtggtagcaaaaccttattcaggtagaagcctgttgctatggagaagttccatgggatgagggtgtatcgtggagaaaacttacaaatattgtggaagatatgtagataaaggaggaggttttgtgtaagtgtaaatgttttgggagacatttggataactttggagatcacgagagcccctgggccatgtttctgtgtgtcagagtgtgtggactgcctataaatttgttggcaaagggcccttgactattggttggaaggcctcccagggacagagcctaggaaattgcaactttaaagataacacgttcatgaattttctaaagtcccatattcacgtacctaagaaaacgtatacaaaacgattgtgacaggacttaacagctctgatcaactctcaacatttagatcttttttttcctttttgagatggagtttcactccgtcgcccagactggagtgcagtggtgcaatctcagctcactacaacctcggcctcccaagttggagtggttctcctgcctcagcctcccaagtagctgggattgcaggcacccaccaccccggctgggtaatttttgtatttttagtagagatggggtttcgccctgttggccaggctgatcttggactcttgacctcaggtgatctgcccacctctacctcccaaagtgctggaattacatgccaccacactcagcctagcattcagatcttatcaaagatcttaccaaagtcaagaagtcctcttcagtccttcctgctgttctccctagttataaaactttagaaagtcattgcatggaagcttactaaggattttaagaagactatttgtaggctctttaaggatttgtatgtaaaggatgattttgtcaagggcacagctctgctcctacgggacttgatatgctgtgtggaggacactgggcctgaccacagtgccagctctggctcacttacttgcggccccaggagccccatattctttgcccataccatgaggatgcactttcttgccctgagaaccttgcagacttatccagggctccagctgatgggagcatgtgcatgagaataccttgatctcacataatgctggacaaaaaaacactggttttaaaaagtgatcctcagccaggcatggtggctcatgcctgtaatcccagcactttgggaggccgaggcaggtggatcacctgaggtcaggagtttaagagcagcctggccaacatgctgaaaccccttctctactaaaaaatacaagtgattcttctgcctcaacctcccaagtagctgggattacaggtgtgcgccatcacgcccggctaattttttgtatttttagtagagacggggtttcatcatgttggccacgctggtttcgaactcctgacctcaggtgatccacccaccttggcctcccaaagtgctgggattacaggcgtgagccaccgcgcccagccaacagggtgaattcttagaacaaactaaattgatacccattgaggtggaattctgcctgtctgatcattagccacaccactgtcagaagaagaaaatctgacgtggtctttctggatctgattttggttttccatcagaagaatgatatttttaaaaatattggagcatgagacttttgcacaatatgatgtcctttaaaagcacagctctctttacagctcggcgcttgttcttttgtaggctcagacataaaaggaaataccgttgtgccagaatctgaaatctcaaattcttatgaagaccagtcgtcttatttttttgaaaaatactccaaggatcttttagttgaggtaaaggagcatttccggaaagttcagggtatccttggtgacgattctccagtggatttctttgggaggcttccacataggcagtgagcacgttccttggcccctggtttggggaactgcagggtatttgttgcatgctgggtgactggttttccttctgtcccagagtatttaacaattagaatagccagtaatgttgttacactttatgatatacgatattctaatatgtggctttttttaaataatagggtttggctgagatattgcatcagaagttcatagatgctgacgtggaggaacgccatcatgcatacctgaagccttttcgcgtcctcatcagtctgcttgacaagccagaaataggtaatgttagaaatgctgcttctatcctatgctgaatacagattacctgttttcagggaaatacaacatggtgagatacaaccaaagcgttattttgaatataatttaatatttggaatttcacaactttgaagtcatgttatatggttcaatgatcatatctgtggtcacttacaagttttgcatggctgggcgcagtggctcatgcctgtaatcctagcactttgggaggtagaggaaggaagatcacttgagctcatggatttgaaaccagcctgggtaatatggctgaaaagccatgttgaaaaaccccatctctataaaaaaatacaaaaaaattagccaggcgtggtggtgcttccctgtagtcccagctaccaagtggctgaggtgggaagaccacctgagcccagggggtcgaggctgcagtgagctgtgattgtaccacggcactccagcctgggcgacagagtgagacccagtctgaaaaaaaagttttgcacaataatttgaacattttttgttaggaaaatacctttgagctcctatagtgtctacagaacatgtggtatttcctttttaagcctattttttcaatgtcatacttaaaatgagctttggtttgattttcaattaagtaggggaccccgtccatctttttgccttgggatcctgggcaagccacttcttttcactgtggagagtaaaaacattttcactgtaaaatgaagagggttgaactagactctggtcaccaaaggctcccttcttagatactatggtcctatgagcataggttgagaaaagtgaccttctctcactatttatttatttatgaatgaatgaatgaacgaatgaatgaatggcagagtctcgctctgttgcccaggctggagtgcagtggcgcaatctcggctcactaaaacctctgtctcctgggttcgaacaattaattctcctgcctcagcttccccagtagctgggattacaggcatgtgccaccatgcctggctaatttttgtattttcagtagagacagggtttcatcatcttggctaagctggtctcaaactcctgacctcaagtgatccacctgcctcggcctcccaaagtgctgggattacaggtgtgagccactgcacctggccctctccctcactttaaaaagaaatttgcgaccaggcacggtggctcacacctgtgatcccagcactttgggaggccgaggcaggtggatcatgaggtcaggagttcaggaccagcctggccaagatggtgaaaccccatctctactaaaaatacaaaaattagctgggcatggtggcgcgtgcctgtagtcccagccactcgggaggctgaggcaagagaatcgcttgaaccagggaggtggaggttgcagtgagccgagattgcgccactgcactccagcctggcgacagagcaagactccatctcaaaaagaaaagaaatttgcggccaggtgtggtggctcacacctgtaatcccagcactttgggaagctgaggcaggtggatcatgaggtcaggagttcaggaccagcctggccaagatggtgaaaccccatctctactaaaaatacaaaaattagctgggcatggtggcgcgtgcctgtagtcccagccactcgggaggctgaggcaagagaatcgcttgaaccagggaggtggaggttgcagtgagccgagattgcgccactgcactccagcctggcgacagagcaagactccatctcaaaaagaaaagaaatttgcggccaggtgtggtggctcacacctgtaatcccagcactttgggaagctgaggcaggtggatcacctgaggtcaggagttcaagaccagcctggccaacatagtgaaaccccattcctactaaaaatacaaaaattagccaggcatgacagtgcacacctataatcgcagctacttgggagtctgagtcaggagaattgcttgaacccaggaggtggagattgcagtgagctgagatcgcaccattgcactccagcctgggcaacagagtgagactccgtctcaaaaaaaagaaatttgctaccatatcagctcactttaaggtctgcatctgcttatgtgagccctataccagggaaaagatccccatgtcttccataggattgcaagcctaagaatgtcatttcagtgctccaggtgtacctacctcctggtagctgtttgcagaggacaagagagctgagggctggccgggtgtggtggctcatgcctgtaatcccagcactttggaaggccaaggtgggcctcacttgaggtgaggagtttgagaccagtctagccaatatggtgaaaccccatctctactaaaaatacaaaaattatccaggcatggttgtgcacacttgtaatcccaactacttgggaggctgaggcacaagaatcacttgaatctgggaggcagaggttgcagtgagcagagttcacaccactacactccagcctgagtgacagagcgagactccatctcaaaaaaaaaaaaaaaaaaaagagagctgagggcattagtgaagtggcctctctctggccttgggatggaggcccttcgcttatccattcaaaagcacagagcatctgccatgtggcagggatggtgccagctctagggggacaaaaggggagcagcttctcatgaagttagagggaaggggagactccatgttcctggagtgtttttactgttcattaataataaccatggctgacattttttgagcaattattttgtgccaagtgatttacatacatccttttatatctgtctgcacacacacctctgtccctccaacaaccccaaggtaggttctcccactatgcctgttttacaaatggaaagactaaggttgggtgggagtaggtaatttgcccagggccagtcaggagcctaagctgggtttgtcagcaccccccgatgcttgcctgattgcactcagagaagtcctacccgagatgtttgcctctgtcaccaggtgaactttattccaagagttgtgcagctctcgtcattcttaacgaaagtccaagtatgaagcttttgttcttccaggctctgcccatgatgtgctgcctcagggtgtctgcactttgttcagattcctcttcccatctgcccgctcccaccttaaaccaaatagattttcctgctagtgtagagtaactgcagctctgaaaaatcatgatttagtccaaaaagtggaacacttatataaatgtattgggagcttgctgtgtaacttcagggaagtattaaaagaagaaaatataacttagcattctggagatgtgtgttttatgtcaaagccatgcaccttggtgagccaagtaaacgttgctgctaacttggctccaggtcgtattttctggaagcaaatgaatatcacgctcctgcccaatcataacagtcacttaatttactctttccaattttttagctgtctgcaagaaatcacactcaggaggcaaaggaggtgattatacagaactagaaggcacaggacggccattcagtccagtccatactttttgtggctgggctttagccatacctcatttcctcctccatcaatcaaggcaacaaaattgccttcatttttgtaacaagcatttagcattcttatgctgtagataaaatacacaggaagccaaggccaggtgcggtggctcacacctgtaatcccagcactttgggaggccgaggcaggcagatcacctgaggtcaggagttcaagaccaacatggcaaaaccccacctctactaaaaatataaaaattagctgggcgtggtggcacacacctgtaatcccagctgcttgggtggctaaggcgagagaattgcttgaacccgggaggcggaggttgcagtgagctgaaatcatgccactgcactccagcctgggcaacagagcaagactctgtctccaaaaaaaataataataaattctatcttaaaaaaaatacacaggaaacttagcatgaaaataattctctcagaggcacatcttttggttttgtgaaaagaagtgtaaaagattggattaatctgcttttttgccagtgttgacagagctttcattttctctgaattgattgtgtgtttctgcctttggatacatgggtaagaagtcaggccctcagctgcctgagggttgcggtttgcggagcagcaatgccctgcccatcccctgcctggttgcagggaagcttctctaacatgcagctggtccagttcttttgtgccatctttctcagcgtttcaggatagccatcatttcttttgtgttgctccagctcatgactaaaggaattgaagaagttgccctgctctctggatatttctgttgagtaacgtccctggccagcagtttatgcacacttaacacacgtagtctgcgctctgcctctatctagcagaatctgctttgggcaagttacttaacctctctgtgcttccatctccttatgtgtaatcagcagtacaggatctgtctgcatggctgttacgagggtttaatacgttaatagatgtaaaacgcgtagaagggtgtctggcacacaggaagttctacaaaaatgttggctattttcatgaatgttgtttccccagctaaagttgtcaccagtaaagttaagtttctgtatattttagactatataaaatgtctgtctgcacaggtttactgtatatatgtcttatgtatatacatatgtcacttactgatttaaaggggattgttaatctgtctctgaccatcttccttctaattacagggcctcaagtggttgggaatttgtttctcgaagtcatcagggccttttattcttactgcagagatgcccttggctctgatcttaaacttagctacacccagagtggaaattcgctgataaggtatgggtttggccttgaacctcacgcatctctctccctccccggtactgtgattttttttttcctctcttgcttactataaattgtgaagtggtagagaaagcagagatgcagcaggtgagaccattggtgaaaataatcaatgcgttgaagtcagtccatgggaattgactgttccctactgagtacggtgaagagtttaaagggagtttgatatagtctttcccccagcctgggatggacaggtatttattgattttttgatcaagtatgaaacaatgaaatgtatgtattgatcaagtatgaaactcgtttaacaaaggcagcttgatctagtatacccaagtggtgagttacagggcagagagaacagagaaaatggaggggagggcacctggcaagtggaaaggggatgtgagtcttcaggacaggagtccagggggtgttgggggagattgggggagacccaggcagggcaccggagagcacaggctccattcccccagaggcagagtgagtggtgtttggaagacagcgggcacattggcctcacgtgcgcagttacacacaaaccctgttttgtttgtttattttgttccttttaagggaatacaactttttcctttttgctttactcttaatgtaatttccttctgcctgaactagcattgggtacattgaaaatttaaatcaatgttaatatttttctggtttgttagttgtaagtgtactaagagttcttagtgtttgcttttttctcccagaatgaaagcggtttattgtttttctgagtatgaaagtaatacatgctcattgttgcatttactgatatttgaaagatcaagaaaaaaggtgtcacacgtaatcctagcactcttcagagaaaaccataaaacatttttacttctttctagatttctactacatacataaatacatagatgcctgtcttttattttaaaggtagaattacaccagttatttagttgcttggggttttctttttgttttcttgttggtttgtttgtttggttttgagacagggtcacccaggctggagtgcagtggcgtgaacatggctctctgcagcctcagtctcctgggctcaagcgatcctcacgcctcagccccttaagtagctgggactacagacatgcaccaccatgcccagctaattttttttttttttttttgtggagatgaggtttcaccatgttgctcaggctggtctcaaactcctgagctcaagcaatctgcccacctcagcttttcaaagtgctaggattataggtgtgagccgccatgcctggtactctctggagtgtcactctccagcatgacaaggtctcactctgtctcccaggctagagcacagtggcaccatcaatggtcactgcagccttgaactcctgggatcaagtgatcctcacacctcagcttcccaagtagctacgactataggcacacacaaccacacctggctaatttttaatttttctgtagagacaaggtcttgctatgttgcacaggctggtcttgaattcctggcctcaagcagtcctcctgcctcagcctcccaaactgctgggactacaggtgtgagccactgtgcccggccactgcttgttttttaaaatgcaagttgtgagtagctctacactattctcctatgggattagttgccttagatatttgttaaggatttatcatttatttaaggccaagtgcagtggctcacgcctgtaatttcagcactttgggaggccaaggcaggcggatcacttgaggtcagcagttcaagaccagcctggccaacatgacaaaacctggtctctacaaaaaaaatacaaaggttagccgggtgtggtgggccatgcctgtagtcccagctacttgggaggctgaggcatgagaattgcttgaacctgggaggtggaggctgcagtgagccaagatcgtgccactgcactccagcctgggcgacagagcgacacttcatctcaaaaaataaataaaaataataaatcctgactgaccaatttcttattgattgacttttagacagtttctgctttttcagttttgtttgtttgtttgcttttgagacagagtcttgctctgttgcccaggctggagtgcagtgatgtggtcttggctcactgcaactccacctcccaagttcaagtgattctcctgcctcagcctcctgagtagctaggattacaggcacctgccaccactcctggctaattttttgtatttttagtggagatggggttttcaccatgttggccaggctggcctcgaattcctgacctcgtgatccacctgcttcagcctcccaaagcactgggattacaggcatcagccactgcgcacagcctgtttgtttgtttttgagacggagtctcgctctgtacccagcctggggtgcggtggcgccatctcggctcattgcaacctccacctcctgggctaaagcaattttcgtgcctcagcctcccgagtagctgggattacagatgcccactatcatatctggctaatttttatgtttttagtagtgacagagttttgccatgtttgccaggctggtctcaaactcctgacctcaagtgatctgcctgcctcggcctcccaaagtgctgggattgcaggtgtgaactaccacacccggcctttttcagtattttttaatggccatttagtggtacacttctgcacacatctatgtagctgtgcagggatttcggtaggataaatttcttgaataaatttcctgagccatagaagataaaatttaaggctggatgctatggcttatgcctgtaattccagcactttgggaggctgaggcaggtggatcacttgaggtcaggagtttgagaccagcctggccaacatcacggtgaaaccccgtctctactaaaaatacaaaacttagctgggcgtggtggtgcacgtctgtaatccatcctagctactcgggaggctgaggcaggagaatcgcttgaacctgggaggcagagattgcagtgagccgagattgtaccactgcactccagcctaggaaacagtgagactgtgtctcaaaaaaaaaaaagaagataaacatttaaaatcttggctgaatttccctgctgaatatccatgtaccatgttattccaccagtagagtatggactaaaactgattttctgtacaaattctttttacagtagctctgaaattattattattttatttttatttttattttttgagacagagtctcactctgtcatccaggctggagtgcagtggctcaatctcagctcactgcaacctccgcctcccaggttcaggcgattctcccacttcagcctcctgagtacctgggattacaggtatccgccatcatgccctgctaatttttgtatttttgtagagacagggtttcaccatgttggtcaagctggtgcacccacctcagcctcccaaagtgctgtgattacaggtgtgagccaccgcacccagctctgaaatttatttttaagagactgtatcaatataaatattgtttacgatggcattatgcaaacacattataagaacagtaatattttcatttttatcagggtgtgtcagcttctctagaaataagttgcagatggtgaaatcaattacagttttttggacactttttgtaattcaggatttttttatagacatatttattcatgtcctccccttttacagtgcaatcaaggaaaacagaaatgcctctgagattgtcaaaacggtaaatttgctgataacttctctaagcacagactttctctgggattatatgacaaggtgttttgaggaatgctttaggtaagtatgcagttcaagaatgcagaatatttaggaaggatgagagggtttaataattttgtagctgcttagaatatcagattatatataagtagctgaagctgagtagtctttcctgagttttaaaattcaactaaaacaggattggaaagaattcacttaagattctagcagaataaaaacatctccaataagaaggttcacataatctttgccatgtaattctgaagctgctttaaaagtctaactttagaaaatcctcagcgcattttctggttacattcatcaaatcagctttcctctcctggctgcccgatctattgaaagcagcttagttttgtggctttgtgactggatagagtgtttttgaaactcttgctgaaatgaatgtaactggtcagataaaagcattaatgttttaagctactataatcagctttaccatctcttttaaccgggtgaattgcaccacccctaaattgtttgcagtggcgtaccccaggaataccgagctttcctggagagccctttcccatgccattttctttacgggaggaataaggtcatgtctcaaaccctgttttgtcctgaggcatgctgtaaaacttatttcttgttcatctccactgtaatgctcttggctgtttcagagtcttacttctcagctgctaccactacacttttctgcccaaataagctcacaaccctgggaaaaataagttaattgcaattggatccacaggcaacagcaaggccatattatattgaggttagagtatgctttggtcagcctggttgttatgttattttttattttatgacggagtctctgtctctcaccgagactggagttcactggcacgatcccagctcactgcaacctctgcctcccaggttcaagcgatcctcccatcctggcctcctaaatagctgagactacaggctcagcctcccaagtaactgcgactacaggtgcacgccaccacacccagctaatttttgtatttttagtagagacagggtttcaccatgttggccaggctggtcccaaactcctgacctcaagtgatccacccgccttggcctcccaaattgctgggattacaggcatgagccgccgcatctggccatcctggttattaaaaaaaaaaaaagaataaaatgtttctacccagatagagctgactctccatctttgcaacattttgtcctcttttcatcccagagttaatccctgtcctgagattaatgtctgtcttcagtgtaacatggctttgctgttgcctgtggatcctattacagttaatttattcatcccagggttatgagatgaaaagcaatagatactttttaacttacccatttatctagtagcctgtttattttaaaagaagtcttgaatttcagtataagataagcaactaacaatagttgattggtggggttacacttctctacagaagctgaaactttctaggcaactcaggtgctgataaactcctggaattacttggagaggagtagtcccaggccactcctacagcagggtgaacagccatgtggactgtggtgttctccagcccagcctcgttcccttggatcgtgcttttgggcttggactggggacttgggattacatctgtcgatggtactccaggtctcctgggagacacctgaattggtagagttcaagtcagagggaatctgtttggacaccaacagattcaggacacttattgacacttctacatgttagatacttttagtcaccaaaatttagttatgagaactacaaaagctgccttccattatgtttgaagtagaataacgttactggaaattgtaagaaatgcttggacttaccgcaggaagaagaattgattttttttttttttctgagacagagtcttgctctgtcacccaggctggagtgcagtggtgcgatcttgtctcactgcaacctctgcctcccgggttcaagtaattctcatgcctcagcctcccaagtagctaggactacaggcgtgggccaccacacctggctaatttttttgtactttagtagagatggggtttcaccatgttgcccaggctggtctcagactcctgagctcagacagtccacccatctcggcctcccaaagtgttaagattataggtgtgagcctccatgcctggccaaagaatggattttttctttgctgtgatttatagaccagtgaagcagcgttacagcgtgaggaacagcgtcagccctccccccacggtctcggagctctgcgccctcctggtcttcctgctggatgtcattcctttggtgagtgctggggaagggacatctcaacgcctgctattatttacattcttactggtggtgatggcctgctttatcaacctcacattactgaaaatgttttacataaatatgcaacactgttttgatgtttgttttggcataaaagatatagctggatgtaatctcttaaatttttaatgtcttatttaaaaggggctataacttttgggccagttgtaagtgggcaaagctgaagttaggtcaaccagctgaagaactgggtatcattcccgtactacagttactttagggaaagagtcaatacatttcctagttaaaattgtgctgttggctaattttctcaaaggaaactaatttccttaatgtagaaacgtgccaattttattttttattagaaagtgtaaagccacttgcaaggagaggagtaacatccttgatttgtctagatcaaattgaaataccgagcctagctctgtggtatgcgctcgtaattcccagctactcaggaggctgagattggagcattgcttgagcccaggaatttgagaccagcctggacagcataacatgatccagtctcaaacaaaaacaatagaaatgttcttttcttttctctgtctctctctctctttttttttttttctcctgtgacagagttttgctcttgttgtccaggctggagtgcaatggtgtgatctcggctcactgcaacctccgcctctggggttcaagtgattctcctgcctcggcctcccaggtagctgggattacaggcacctgccactacgcccagctaattttttgtatttttagtagagacagggtttcaccatattggccaagctggtcttgaactcctgacctcaggcgatccaccagcctcggcctcccaaagtgctgggattacagatgtgagccaccatgcccatcctcttttctcttttttgagatagagcctcactgtcacccaggctggagtgcagtggcatgatctcagctcactgtagcctcatcctcccaggctcaagcaatcctcccacctcagcctcccaagtgtctgagaccacaggcatgtgccaccacatctggatagttttagtattttttgtagagatggggtctcactgtgttgcccaggctggtctcgaactcctgagctcaagcaatctccctgcatcagcctcccaaggtgctggctgggattataggcatgagccactacgcctagtcttcttttgttttctgatttgaaaattaatatggtatggtggctcacgtctgtaatcccagcactttgggaggccgaggtgggcggatcacaaggtcaggagattgagaccaccctggctaacacggtgaaaccccgtctctactaaaaaaaatacaaaaagttagccgggtgtggtggcgggcgcctgtagtcccagctactcaggaggctgaggcaggagaatggtgtgaacctgggaggcagagcttgcagtgagccgagatcacaccactgcactccagcctgggtgacagagtgagacttcatctcaaaaaaataaataaataaataaataaaataaaataaaataaaaaagaaaattaatgtgggtcaggcacggtggctcacgcctgtaattccagcactttgggaggccaaggtggatggatcacaaagtcaggagatcgagaccatcctggctaacacggtgaaaccccatctctactaaacatacaaaaaattagccgggcgtggtggtgggcacctgtagtcccagctgctcgggaggctgaggcaggagaatggcgtgaacccgggaggctgagcttgcagtgagccgagatcgcgacactgcactccagcctgggctacagagcaagactctgtcaaaaaaaaagaaagaaagaaagaaagaaaattagtgtgaaatttatgccctaaaaaattgaattagatgccattttgagatgcattgtttttctgattgtgaaccaacattgtggggttaacctacacgtttatttcacaggaactttactctgaggtgcaaacccagtatctccctcaggtgctcggctgcctggtgcagcctcttgctgaggacatggaggccttaagtttacctgaactcacgcatgccttgaagacgtgtttcaaggtgctcagcaaagtccagatgcctccttcctacctcgacacggagtccaccagcggaacctcggtgtgtactctgaggggcagaaatggttctgggggctaaaagcagcttatgccttcctgggagtagaaagtctttagggttggttaggataggaataaagatgagaagatacccaggtgatatgtcaaatatgcttgtaaaaccctcactttaaaaggttttagcacctggcatggtacaatggctcacacctgtaataccaacactttcggagactggggcaggaggattgcttgagcccaggagttcgagaccagcctgggcaacatagcaagccttcatctctctacaaaataaaaattaggccaagtacagtggcccacacctgtaatcccagcactttggcaagctgaggcgggtggatctcctgaagtcaggaattcaagaccagcccaaccaacatggcaaaaccccatctctattaaaaatacaaaaattagccaggcatggtggcacatgcctgtagtcccagttacttgggaggctgaggctggagaatctcttgaacctgggaggcggaggttgcagtgagccatcacgccactgcacttaagcctgggcaacagagcaagactccgtttcaaaaaaaaaaataaataaaaataagggctgggcgcggtggctcacgcctgtaatcccagcactttgggaggccgaggcgggcagatcatgaggtcaggagatcaagaccatcctggctaacatggtgaaaccctgcctctactaaaaatacaaaaaattagccgggtgcagtggcgggcgcctgtagtcccagctactcaggaggctgaggcaggagaacagcgtgaacccaggaggcagaccttgcagtgagccgagatagtgccactgcagtccagcctaggcgaaaaagtgagactctgtctcaaaataaataaataaaataaaataaaataaaataaaataaaataaaataaaataaaataaaaaggcatggtggtgttcacctgtagttccatctactcaggaggctgaggtgggaggatcgcttgagcccaacaggttgaggctgcagtgagccatgattgcacggctgcactccagcctgagtgagagcaagaccctgtctctacaaaaaaaaatttttaagtttagcaccctttgtttcacccattctcatgctacttgcctgctctgtaactgcagttaatggttagatacagttaataactatgtaactacagttaatgggctagttataactagccctgcactgttttatgtgtgtgtttgtggcatgtgattttggttatttcgaatataagcgagatgaggtactggattagtttgctgggactgccataataaagtaccacagactgggtggcttccacaacagacacttgttttctcatggttttgaaggccagggcctgacacgaaggtgtcagcaaggttggcacctcctgagtgcactggggaaaaagagtctgtctcatgcctcccccgagcttctggtggtttgctggcaatattcagcattcctcggcttgtccaggcatcagcccagtctcggcctttatgttcacttggctgtcaacctgtgtgcatgtctgtctctgtgtccagatctctcctttttataaatccagtcctactggatttgggcccactctaatgatctcatcttaattggatcatctgcagagactctattttcaaattaaggtcacattcacaggtattgggagttaggacttcaacctatttttgggggacaccgttcaacccataacgtacactattctctgacttgctttaccttttttttttttttttttgagacagagtctctctctgtcgcccaggctggagtgcagtggcatgattttggctcactgcaacctccacctcatgggttcaagcgattctcatgcctcagcctcccaagtagctgggattacaggcacccaccaccatgcctggctaattttttgtatttttagtagagatggggtttcaccatgttggccatgctggtcttgagctcctgacctcaggagatccacccacctcatcctcccaaagtgctgggattacaggcatgagccaccacacctggccttattttatttcttcatacctttattttaccctcagctcagtttcctcattcatatttgttaatttgtcggaaacagttctcgctctgttgtccagagaattgtggcaggtgatccgcccgcctcagcctccctaagtgctgggattacaggcttgagccaccacgcctggcagaaacaattcttaaacaacttttttgaactctaaaggggttatatatttagacaaaaacacaagaaaaataggcccaaaagccagcctccccagagagcatgtgggtgtaccagcctcctctttgctacccaccgctctccttctcctgctttgggtgcctcctaaatttcattatacacttaacacagggattctctagtctggagagtgatgattttgaaaaacagaattgaaatacattcatgatttcaactgatacttaaatagcttggtgttaagagatgcacaattcacatctttttattttttacagagtccagtaaaaggtgaaaacggcaaaataattttggaaacaaaggcagtgattcccggtgacgaagatgcttcgtttccccctctgaagtctgaggacagtgggatcgggctcagtgcctcgtcaccggagctctctgagcacttgagggttcctcgagtttctctggaaagggacgacgtttggaagaagggcgggagcatgcagaggacgtttctttgcatccaagagctaatcgccaactttgccagcaagaacatttttggagtacagctgacagcgtcaggagaagaaagcaagtccgaggagcctgcagggaagagggacagggatgggacgcagagcctggcagccaatgattccagcaggaagaactcttgggagcccaagcccatcactgtgcctcagttcaagcagatgctgtcagacttgttcacagcacgagggtctccattcaagacaaaaagttcagagtcaccatcgtcttcgcccagcagccctgccaggaaaaacgggggagaatgggatgttgagaaggtggtcattgacctggggggttccagggaggaacgcagggaggcctttgccgccgcctgccacctgctgctggattgtgccactttccctgtctacctgtccgaggaagagaccgagcagctctgtgcaacgctcttccagctgccaggtgagaggcagccctgccgaagtccctctttgggaatcatacgatgaggcgattgacgtgggtggaatatcccctatccacaatgctagggaccaaatgtattttggatttcggacttttttcagatttttggaatatttgccttacacttaccgattcagcattcctaatccagaaatccaaaatccaagagctccagtgactgtttccttcgagcatcatgtcagtgctaataaggtttcaggttttggatttggaattttcagattagagattctcaacctatatttaaagactagctcaaattgtgtaagccaagaaggtgctattggcctcatttgttcccttcctcatttgtaattagtacatttttgacttgtgtctcaccacatggcaaagtggtaagggtggggcctatgtttttaaaccctgggtgtccagcacagcccatcagaagacctagaacatgagtggcattcagtgatagtaaatagactatttcatgatgcctgttgataaagttttttttgtgttgggtttttttgttttttttttttttttgagacagggtctggctctgttgcccaggctggagtgtggtgacaccaactcagctcactgcaacctccgcctcctgggttcaagtgattcttctgcctcagcttccccagtagctgggactacaggcacgtgccactacgcccagctaattttttttttttttttttttgagacagcgtcttgctctgtcgccaggctggagtgcagtggcgcgatcttggctcactacagcctccgcctcccgggttcaagtgattctcctacctcagcctcccaagtatctggggttacaggcacacgccaccacacccagctaatttttgtatttttagtagagacagggtttcaccatgttggccaggatggtctcaatcttttgacctcgcgatccacccgcctaggcctcccaaagtgctggggttacaggcgtgagccactgcacctggccccctaattttcatatttttagtagagatggggtttcaccatgttggccaggctggtctcaaactcctggcctcatatgatctgcccgccttggcctcccaaagtgctgggattacaggcatgagccaccgtgcctggccaatattttatatattggtttgctagggctcctctaacaaagtaccataaactgagaaatttgtctcatagttctggaagccagaagtccaagatcaaggtgtcagcagagccatactcctcctctgagaccctggatggaatactttttggcctcttcagcttctggtgctggccggcaacccttggagggctcctcaccttgcagctgcatcagtcccgtctctgcctttgtcttcacagggtgtcctctgtatgtcctgtcttcccttgacatgtccctcttacaaggacaccagtcatattggattagggcccaccctaacaacctcatcttaatttgattacctctgtaaggaccttatttccaaataagtctcaccagcgggaggttagcgcactgctgtccaggtggatttctcaggtaacttcccagatctagggtgctgtagaatctgcagactggggacccattctcacgtggttctgcttgtttctgcctctccggctggcttcctttcaggagccggtgattccagttttccatcttggctgaagtccctcatgactatttgctgctgtgtgactgactgctacctccagaacgtggccatttccactctgctggaagtgataaaccattcccagtccctggcgcttgtcattgaagacaagatgaaacgctataagagctctggacacaaccctttttttggcaagctgcagatggtgacggttcctcccattgctccagggatattgaaagtcattgcagagaaaacagatttctatcaggtatttcccactgggaacactcttcttatggcctccttctccccctgagcaaaactcagaaccgtattgctggggatgggggcagtggcccacttctctgagagtgatattctatagggcactgggcagaggcagtagcctttggtcttcctctcccagcatgtaactttcaccctccaggaaagctacagtgagagcaactggggccccagtattctgggcctgccaggactgagtggaacccctgcctgggagtggggtctgggtggaggcagggagcccatgactcctccactgcactcacctggatttagcctctgccacatccagcagaggggtgggaaggtgacgtgctggtggcctgcccctcccaggaggtgcaaaagcccttgactgggagctggggaaagagagcacccttttgcttggccacatgcaccagagtggatagtgacgtttccatggagctaagctggggaaggaaggagatgatgagcaggtcatggctcaagtgccatgactcttgctgctttgaccgaaatgtcgtaggttttccggaataaatgtttctttatttcctgaatgtcctttggataatttccagactctaaatggttggttgttgttggttttaaaataattttcaccagttatggttgtgttgcttgggagagggtctgtctgtggaactcctcacaccgctcagctttggttccatgtgggacaccatctacggtgtcaggtcctgggggagcttttacttaattgctcattgactttttttgttgttgttgttgagacggagtcccgctctgtcacccaggctggagtgcagtggcacgatctcggctcactgcaacctctgcctcccatgttcaagcaattctcctgcctcagcctcccgagtagctgggactacaggcacctgccaccacacctggctaatttttgtatttttagtagagatggggttttaccgcattggccaggctggtctcaaactcctgacctcaggagtttgggaggcccgcctcagcctcccaaagtgccagaattataggtgtgagccaccgtgcccagctgcttattgacttttgtaccacatttcttcttcctgctagagttgagtcacattagatcttgaatagacagaacttgaaaccaggactggaaccgctataagcagcagtgattaagcaagtgtcatcttggccctacatagatcagagatcagaaaatttggcatatttacactatatataggcacaggggagaaaaaagaagaaagaattgagatcatgaatctttggaaaggtactcatagaataaaagtggcagcattaaatacattccttttattttggggcagtgagggaagcttttccaagttcttactgaagccttgatttttactttcattttcatgtagtacatattcaagtacttaccatttgcctggcactagagcatacttttcttttttttttttccttgagacagagtcttgctctgttgcccaggctggagtgcaatggcatgatcttggcctctgcctcctgaattcaagcgattcccctgcctcagcttccctggtagctgggactacagatgtgcgccctcacacctggctaatttttgtatttttagtagagacggggttttaccatattggccacgctggtctcaaactcctgacttcaagtgatcctcccacctcagcctcccaaagtgccttacaggcgtgagccaccgcacccggccaagagcatactttttttattgacatgtaatattgtatatatatatgggtacaatttgatattctgacacatttatacattgtatgatgatcaaatcatggtaattagcatacccatcaccttaagcatttatcatttctttgttgtgaaaacattcagaaccctctcttctagcaatttgaaatacacaatgcattattgttagcagtagtcaccctactgtgcagtagagtaccaagatttattccttggagcacacttttatgtactgtacagttcttgagagttgaggacagcggcagctagtgcctgtccctgttgcagatgctggaactagagacacagcaaccttacccatagccaggacgtgcccccaattctcagactccagacagggctgttgtctgatctttcagcctttttttaatcctgcgggaacagctcacataccagagttcctgcttcccacagtgcaaacaagaaaaggtcagatagcccaagggtgccctgacctttcttatcaggtagtgttggcagatttcagataactaagacaacacccagaacagaggagtagagtaaggtttaaacatgtgaaggaaggcccggctcggtggctcacgcctgtaatcccagcatccagcactttaggaggctgagggctgcttgcttgagctcaggagttcgagaccagtctggccaacacggcaaaatcccatgtctaaaaaaaaaaaatacaaaaattaacctggcatggtggcacacacctgtagtcccagctacttgggaggctgaggtgggaggatcacttgagccaaggaggcagaggttgcagtgagttgacatcgtgccactgcactccagcctggggcacatagtgagaccctgcctcaaaaaaatatatatgagggagtaggtatggatttgtgatcggcatcaactctcaaaaaccttgcaaaaaaattttttaaaccttccggaagggagtctcttgcatatatatttgccatagtgacagcaaggaagtcggggggggggcggtctacgtagtcaaaaagttatatatcagaattcaattgtaatgtgattgttggaaatcactttcccttagagaaaaagtaacaaaataatggttaggagtttgagccagtcagtggttaacttgatctatgcagagaaagacggttttgttgagtagaaataaatgggccaaagaagttatttgatctaagttatgcctaaaatactccagtctatgagatataaacttcatatagtctatgaagtataagaatgtctttagaaatttagaaatttccctcccggaagtggggaccagccctccttctgggtctcacccttgttggggcaggcacactggctcctgctccctgccacttggcaaggggctgtagccctttgcagaccatgcatgtttaatgagctcagttcagggctgggaagatggaggacacgatttgggggtataatagtgttttgaaagtgaggcaggcacctgccacagcgttgtgcagggaaaagggaagagtcaagttagtggaattaaagctggtaggcgtggctctttatccatgctgcgtggtaaccaattcgagcagaccccagaggtgaccaagtgctgtggagctgaaccccagaatgagtgatcttgacaaccactgtaaattcaccaaactccccagagggtacatctgtgcattccccagtgcctgctcggcacctgcctgttgaaagaatgcttcaacccctttggtccagtttccagttaattctctttctgaaagtaatgttgaggttgaggcaagagctgcagtgttcttagtcggccagaaacctccaggtttgacctcctataacattgcctgctgcctggatgactttggtgggtttttcctttttttcttttttctttttctttttctttttttttttttttttgagacagagtctcactctattgcccaggctggagtgtagttgcatgatctcaggatctcagctcactgcaacctccgcctcctggattcaagtgattctcctgcctcaccctcccaagtagctgggattacaggtgcccgccgccacacctggctaatttttgtatttttagtagagttggggttttgccatgttgaccaggctggtcttgaactcctgacctcaggtgatctgccccacttcgacctcccaaagtgctgggattacaggcatgagccaccgctcccagcctttggtaggtttcttgctttatttgttggtgatttgtctctgagcatggaggattctcacatggcaagtataggtgagatccagtatgtcggggctgggactgactgagtgaggatgtgagcggatgttgcctgtgttgacctggtcccccaccgcctgccttttccttgtcccagagggtggctcgtgtgctttggaatcagctgaacaaagagacccgggagcatcacgtcacctgcgtagaattgttctaccggctgcactgcctggcccctacggccaacatctgcgaggacatcatctgccatgccctcctggaccctgacaaggtgagcctttctggccgccacctccatcctgcagcaccccggcccctgctgtacgtgcccttagccaactgacatccattcggtcgaagtctttctggggctgagtggacatcgtgattaataaaataagcagaggtgttctaggatttcagtactggaaggccactagaagcatgagccattctttttacagccctggaaatgtggtttgtgaccatattgaggctcaccagggaaacctgcccaaacttgctggaaggacttgcagggcttctgcaggtgttggcaaaataggcagttgtagggaatttattgtccctttaagaacttattgaagcagggcgtggtggctcacacccgtaatcccagcattttgggaggctgaggtgggagaaattgaggccaggagttcaagacctgcctgggcaacatagtgagatccatctctaccaaaaataaataaataaataaggccaggtgcagtgactcacgcctgtaattccagcactttgggaggccaaagcaggcggatcacctgaggtcaggagtttgagaccagcctgggcaacatggtgaaaccctgtctgtactaaaaatacaatattagccgggcatggtggcacatgcctgtaatcccagctactcgggaggctgaggcaggagaaccacttgaatctgggaggcggaggttgcggtgagccgagatcgcgccactgcactctggtttgggtgacagagcaagactccgtctcaaaaaataaataaataaaaataataataaaccaatttttttaaaagaatatattttattgagaatttatcgtcctgggtctcctttccagtctgttgtgtctcctcgttctttaagacacttgggcctgacacttgcaaggaagccatgctcctttgtgttttcctttggctgcagaccacaggggtgaccctggactctaatactgagttctgaatgtgccgctgtgttaaagtgaacaatcagagagagaggatgcaggttctccttttccttctggccgaatcagtcaaaggagaatgcagcgtctttgctgtggttgctgtcagttctgctgaagtctttgatctattgtttaaatggggtttatggtgactgaagacagtggtcagttacaaaaccaagttcctcactcccatgtatctcctcatcaagggaacaaggctggaagctctgtttagattttccgtgatctggcatctgacaagagagatccaaggcagtcgagtaacatctcacaatcgctcctttgataggtgaggcggccttcgttatgatctaccgttaactcacgaggaaactccacagaggtgcctgcccaacgtgtggggctggggagggagaggagcgtgcagttgaaaacatgaacccatatgaccgggtgtggtggctcacgcctgtaatcccagccctttgggaagccgaggcgggcagatcacttgaggcctggagttagagaccagcctggccaacatggtgaaaccccatctctaccaaaaatacaaaaattagctgggcgtggtggtgggcacctgtaatcccagctacttgggatggtgaggcagtagaatcacttgaacccgggaggcaaaggttgcagtgagccgagactgcgccactccactccagcctgggtgacaagagcgaaactccatctcaaacaaagaaaagctgacccctgcacatgacccctccgagcacagccagtggttcccataaacccctaagtgaatttaggccagacacatgtgaacacatgttaggaattttcttaatttggttgggatgtgaggaatcctggcatgccccgggatcacctgtgcagcttttacggcatgcccctatgaggggactttgcagggaggtcagatggcctagacctcccctggagcagtgaccatacttggtgtgtgtgcttgtcccatcactgtctcatgcttaagaggtgaacttgattgcagcccattgtattccacattgtttttcccgagtgcctctgaaactctaggtgtgaggccaggcactcggccttagagacaccagctgattctgatgcctgaggcccaggcccagactcagatatataacccatttggggtgaggcctgagcattgggattttaaatgctcccactggtgattccaacgcgaaaccaaagttgagtccccattgtgctcatctacttgggtctggaagtccagcttgggtggaggtcctagggtacctgtgttgggtgacgccctatgcccagtgtctgccacggtgcctggcgcacaggggtggctgcgagtgaactcactggtgtgtttcccactgcaggtccttgtttgtcgtgctggacagcctggcctgcacggatggtgccatcggtgcggcagcccagggctggctggtgcgtgcgctctccctcggggacgtggctcgcatcctcgaacccgtgctcctgctgctgctgcagccaaaaacccagagaacctccatccactgcctcaagcaggagaactcggccggtgagcagcctgcacaggacccgagggtgagggaggaatgggtggggggactggacctcagcagtgatagctgagagactgaggcccactagggggttttgttagatgcaaatggtactttgtaaattgtgaggacttcggcaatttaaggacctagtgatctagcatttagaactattagggagtgggtttgctgttttcactgaaaaaccagattgttttgttattaaaaaaggaaagttggccaggcacggtggctcacaactgtaatcctagcattttgggaggctgaggcaggtggatcacctgaggtcaggagttcaagaccagcctggccaatatggtgaaaccccgtctctactaaaaatacaaaaattagccgggcgtggtggtacatgcctgtaatcccagctactcaggaggctgaggcaggagaatctcttgaacccgggaggtagagattgcagtgagctgagatggtgccactgcactccagcctgggtgacagagagagactgtcattcataaatacataaataaataaataaaataacttatttgtgaaccttcaactacaaggtaagtggtttattttctatctgtgctctaagattcttttagactataaaatcttgttaatcagattatcagaaatgaagaagaaataaacctttcagttcagagaacttccagaggcatctttaacacaaacataaaagaatataggtagaaattaggaaagaaaagaaaaactaaataagcctgatgagtcaattaaacttcagtgattaatatctaatgcattttatgaactaacattacttcctacaatagctgtatttaatgacttcacaattttctaagggatggtttgcaaactttgagtgagtttgtttagcttgaggcagaaatttaaaaataataataagaagaagtactgcattcattcattccaagaaaagtaacagacaaggctataagaaggttgtagtgacctagtctaagaagtaaaaaccaaggcccagaatgtggcaagacaagggttaaaaagtaaagaagggctggacggtggctcacccctgtaatcccagcactttgggaggctgaggcaggcagatcgtgaggtcaagagatcgagaccatcctggctaacacggtgaaaccccatctctactaaaaatacaaaaaataagccaggcatggtggcaggggcctgtaatcccagctactcgggaggctgaggcaggagaatggcatgaacccaggaggcagaggttgcagtgagccaagatcacaccactgcactccagcctgggcaaaagagtgagactccatctcaaaaaaaaaagaaagaaaagaagaacaagttttcctctgcctagcaagctcacttcaaagacagttataagctaacgctgttcgagaagttgaaaccaaaggaataagctccagacacccccctctccagatcaagggtgaaggaaaaaaaggacaaatgtctgtatttagccagttcttgttttttcttatcctgtatttatcttaatctttttttttttttttttttttttgagacagagtctcgctctgtcacccaagctggagtgcagtggtgcaatctcggctcactgcaacctccgcctcccgggttcaagtgattctcctgcctcagcctcctgagtagctgggattacaggcatgcaccaccatgcctggctaatttttttttctttctttctttttttttttttttttttgtatttttagtagagacagggtttcaccatgttggtcaggctggtctcgaactcctgaccccaaatgatcctcccgcctcagcctcctaaattgctgggattacaggcatgagccaccacgcctggctatctcaatcttatcttacagagaaaagcaacccattagctaagtaagcagaggtgtgtgaaatggtttcctgtctttataaggctcctggcctaaacctctaacctctggttttcctttaggggaaaagctggctgccctatcaaataggaaacattttattgttccacattgtaagaaagtaaaactgaaagaagtgtaaacaaagaaccttcttaaaagtttggctactattcatggcagctacattttttagtatttctttttctttctgttttaagaggaaagctctatctccacagttccttgggcattattattattattattattattattattattattattgaagaagagtctcactctgttgcccaggctggagtacagtggtgtgatcccaagtcactgcagtctttgcctcccaggttcaagcaattctcctgcctcagcctcccaagtagctgggattacaggcgctggccaccacagccaactaattttttgtatttttagtggagacggggtttcaccatgttagccaggttaggtctctaactcctgacctcaagtgatccatgcgcctctacctcccaaagcgctgggattacaggtgtgagccaccatgcccagccttagttttggtatttttagtagagatgggtgtttcgccatgttggctagactggtcttgaactcctgagctcaagtgttccacccgcctcaaccttccaaaatgctgggattacaggcatgagctactacgcctggccttccttgggctttaaaagttccccagcactaccttgctgcttcctctaatctgtgtttcctgctgaccacagaaatggtctgctacctccgaataggagagaacatctttgctctgccattttctttctctgaaaaaaatgataagtgtcctgcttaccccaccctatttctgtaatcctgtagaaatctatttttaaaatactgctatgcacttcaagcagctcatcaatttctgatgtctgattcttcttcatttcttgatcttgcttaatgtccatggcatagagtttttttaaagctcttttgtgtgcctttatcttgtttgatcatcctaaaaaccttatgagaatgacagatttcttcttttcttttttttttttttttgagatggagtctcactctgtggcccaggctggagtgcagtggcgcaatcttggttcattgcaacctctgccttccaggttcaagccattcgcctgcctcagactcctgagtagctggcattacaggcacgcgccgccacgcccagctaatttttgtatttttagtagagatggggtttcgccatgttggccagactggtcttgaactcctggccccaagtgatccgcccacctcagcctcccaaagtgctagaattacaggtatgagctaccatgcccggctcatggcatagatttattgaacactgcttatttaaaatgtttggcaatatcaaagacttttgactcactaatttttttttccttttcttcttttttttttttttttaaataggcagtggtcagtggcctatttgacttctcctaaaaaagacttcaatattttaaagtgtcatacgttttctgattatagaagtactaacatggttagttttaaaatggaaataatgaggacataaaaacctaagtggaagtcctttgtaatgctagttgatagaactagggattgttaatggcttgcaggtagtctcccagactttcctagtggctgtgtattatacatactctctcctaactgggctcattctacataatactcttctgctgcttgattttttttttcctttctttttagagacaggggtctcactctgttgcccaagctggagtgcagtgacaccatcatagctcactgcagtctcgaactcctgggctcaagagaccctcctgcctcagcctcccgagtagctaggactacaagtgtgtgtcaccatacctagatagcttttaaattttttctagagatggagtttttccatgttgcccaggctggtttggaactcttgggatcaagcaatcctcctaccttggccttggcctcccaaacaatcctcctaccttggtctcccacagtattgggattacaggcataattcactgtacctggcctgatttttcctttcctttttttttttttttttttttttttgagacagagtctcactctgttgcctagtctggagtgtagtggcatgatttcagctcactgcaacttccatctttcaggttcaagtgattctcctgtctcagtctcccacgctgggactatgggcacgcaccaccacgtccagctaatttttgtatttttagtagatggagtttctccatgttggccaggctggtctcaaactcctgacctcaggtgatctgtcctcctaggcctcccaaagtgctgggattacaggcatgagccaccatgccaccacacccagcctccagtttgtctttatacacatgtgacatttcggtgaatatccacatccttatggctttgaaagtcttctgctgacatttctgcaggatacatttctgtttttttgttttttaagacggagtttcgctcttgttgcccaggctggagttcagtggcacaatttcagctcactgcaacctctgcctcctgggttcaaatgattctcctgcctcagcctcccgagtagctggaattacaagcacctgccaccacgcccagctaactttttgtatttttagtagagacagggtttcaccattttggcgaggctgatctcgaactcctgacctccggtgatctacctgccttggcctcccaattgctgggattacaggtgtgagccactgcacccggccaggagacatttcttgaaagagaattcctaggaaaaaataatacgtatttttaaaaattgctcccctccaaaaaattaaaatacttaagtttactataacaatgtaactaaatgatcccatccttgaacattctgtaaaacctatccaccttcctttgtctacttttgtctgtaatgtaaaccggactctggtggtggtgtttcatgtgagaattttaggaatattgatctttctgtctggctttaagacaaagaccgccctacagctaatgtatcatagctgacccttctgtctaaagtcatttgtcatcttgtaattttcagatgacttgcaccgttggtttaacaggaagaaaacctctttcagagaggcatgcgcagtgcccgagcctcaggagagcggctctgaagagcacctgcctctgagccagttcaccacagtggaccgtgaagccatttgggccgaagtggagaaggagcccgagaagtacccgctgcgaggcgagctgagcgaggaagagctgccctactacgtggagcttccagacaggacggcccacggcgccccggacagcagcgagcacaccgagtctgcagatacaagctcctgccacacggacagcgagaacacgtcctccttctcctccccttcccacgacctgcaggagctgagcaacgaagagaactgctgtgcacccatccccatggggggcagggcgtaccccaagcgctcggccctgctggcggccttccagtcagaaagcttcaaggctggggccaagttaagcctggtgcgggtggactcggacaagacgcaggcttctgagtcgttctccagcgacgaggaggcggacttggagctccaggccctcaccacatccaggctgctaaagcagcagcgggaaaggcaggaggccgtcgaggccttgttcaagcacatcctgctctacctgcagccctacgactctcggcgggtcctctatgccttctcggtgctggaggctgtgctcaaaaccaaccctaaggaattcatcgaggctgtgtccaggactagcatggataccagctccaccgcgcacctcaacctcatctccaacctcctcgctcgccaccaggaggccctcattggccagagtttctacggaaagctccagacccaggtccccaacgtgtgcccccactctctgctcctggagctgctcacctacctctgcctgagcttcctgcgctcctactacccttgctatttgaaggtctcgcaccgagacattctcggcaaccgggacgtgcaggtcaaaagtgtcgaggttttgatcaggataatgatgcagctggtctcagtggccaagtcttcggaagggaagaacgtggagttcatccacagcttgctgcagaggtgcaaagttcaggagtttgtcctgctctccctgtcggcgtccatgtacacgagccagaagcgctacgggctggccaccgcccaccacggcagggccctgccagaggacagcctctttgaggagagtctcattaacttgggtcaggaccagatctggagtgagcacccgctgcagattgagctgctgaagctgctgcaggtgctgattgtcttggaacaccacctgggtcgggcccatgaggaggcggaaaaccagcccgacctgtcccgggagtggcagagagccctgaacttccagcaggccatcagcgccctgcagtacgtgcagccccaccccctcacctcccagggtcttctggtctctgcggtggtgaggggtctgcagcccgcctacggttacggcatgcatccggcctgggtgagcttggtcacgcattccttgccctacttcggaaagtccctgggctggacggtgacaccctttgttgtccagatttgcaaaaacttggatgacttggtcaagcagtatgaaagcgaatctgtgaagctctctgtcaggtgcgttacgctccttgtgacatctttattgctttagtgatggtttttataacgaatgactgttttgccacggatgtggatgtcggttggaggataatttcatcccaatgagaagcctgtttagcattatcaagaggggtaacaagcaactaaatgttctgatccattatgttatgttatgttatgttatgttatgttatgttatgttatgttatgttatttttgagacagagtctctgtcacccaggctggagtgcagtggcatgacctcagctcactgcaacctctgcctcccaggttcaaacaattctcctgtctcagcctcccgagtagctgggattacaggtgcctaccgccacatctggctaattttttgtattttagtagacacggggtttcaccgtgttgcccatgctggtcttgaactcctgagctcaggcaatccccctgcctcggcctcccaaagtgctggggtgctagagggagccactgcgcccagccctgatcctttatttcaaatccgcacaggtacccagtctagctcagtgttgcagggcatgtcagctactctctactatttttgcaaaacagaaataaaaatgtgaatcatcttcacagaaattctaaaacattgaaaccatttttccaaagtgactatatgaatgtaaaatcacacaaaggatggttaacattattataatgatattctatgacgagagctccagtttatttgggatggtgatctctccctagttcctgtgtttatatataggattagaaacccttatggcctcattctttaaaaattctcaaaccagtttctcttttcttcaccacagcacaacctccaagagggaaaacatttctccagattatccactcacccttctagaaggtctaacgaccattagtcatttttgtcttttggaacaagccaaccaaaacaaaaaggtaaatttttttttttcctgagttcaaggcaattttcatgtattgttttgtctttgggctatgactgtttcaaataagtaacgtatgtatgtaatgtctgtaactaatatgcgtatggaggtgatgcaaatgtgaatgcaaatattacataagtcacgtacacacgtatgcaaatgcatgtgtgttagcaatgcaagtgcctacgcaaatgcatatgcaaatgcatgtatataattaacgcaaatgcataagtatgtatgtcagccatgcaaacatagttttcttcctgctggcactccctgtgccagccctttgcccattgttccatcagtagcctgtgagataacttataaagccacttgtttgattttaggcttatagtcatctttttccatgtattttttacttgctatcatggtgttcatgaaatctgagtaggcagacattttagctgttggttattctaccctgtagaataccctgggattaagtcttagaatacatctaacactttggttgaatggttgaaaagtttgtaatttagaacatcagactcacagctgtctctgtgaaagagaaccatgggttgaaatgcacagagaagcttattgctcccagaccaccacatgtatgagttgcttagaagagagtccaacagcccagacctaatcccgctagcactgctgccctcgtgggaagaaaaaccattccacagacacagcctgcctcatgtattcattttaatttttagaccatggctgcaggtgatcctgccaacttgaggaatgccagaaatgccattttggaagagctgcctcgaactgttaacaccatggcccttctctggaatgttctcagaaaggaggagactcaaaagagacctgtcgatctcctaggggccacgaagggatcctcttccgtttactttaaaaccaccaaagtaagaggatgtctctgtagttctgtcatttacttggtcttgtattgttccacccaaaataaatgtgtataggaaagtgtgcatgataaacagatgtgctcaatgaaacccaagtcagagatcagaagtagaaatctctagttcatttgttatcagtaagtttcctatacctgaaatggaggagtctgagtggtttcagcctgttttcttcttattttccattcaccttattttgtagttaaaaataaagtcttggccgggcatggtagctcacacctgtaatcccagcactttgggaggccaaggcggatggatctcctgaggtcaggagttcaagaacagcctggccaacatggtgaaaccccatctctactaaaaatacaaaaattagccaggtgtggtagcacgtgtctgtaatcccagctactcaggaggccgaggcaggaaaatcgctggaacctgggaggcggaggttgcagtgagccaagattgcaccactgcaccccagcctgggcaacagagcaaaaccccatctcaaaaaaaaataaaaataattaaaataaataaagtctctagagctaggcgcggtggctcatgcttgtaatcccagcactttgggaggccaagatggggtggattgcttgagctcaggagttcaagaccagcctggccaacatggcgaaaccccatctctacaaaaaatacaaaaattagctgggtatggtggcaggcacctgtagtccgagctactcaggaggccgaggcaagaggattgcttgagcctgggaggtggaggttgaagtgagctgagatcacgccagtgcactcaagcctgggtgacagagtgagaccctgtctcaaaaacaatagtctctagtggttcaaagcggggatacctagatcctcacctctaaatgatctagagaccccagccttgagtctctaaagcatttctgcgagacagctcatctctgttctgcttttagcggtgcctgtcaaacatggccccatcagagtggaatgtcagggtgcctttgagttcttaaaccaaaaacgcacaactgtgaatatttatattatagtttagtctttggttttcagtgtctgcctcagaaggctgtaggcgcaggactcggtcgctcaccatctgtgttactgtgtgtggcatctcagaattatctgccacatctgacatcagttgagagcccccaggtgccagatgtggccgcagggatgagccttgccatcctgcatttaggtaccacggtgcgttgttggcctccagacattctgtcggttcctagggtgccaagggaattctgtatttcaagctcctataagaacctgctcttaaaaagattcagaaaaccttttttctcactcagaaaaaaagattttctaaaccttttttaggggagcttcctgtagcactcagcctctctgagcctccatttcctcgtctgttaaaccaggctgtggctagcatcctgtcctcatgggttgagggaaagagtaattacgataaaggccgatgctcattaggcacttaactcctagccctccctgaggaacccagggccggggagcgggaccccacattagtccctctagagcagaagccatggtggaaaagaggggacagctccattgctggctcagttgtatctaatgtgaaataaacatgggcggttgtcacaggaagcgctgggtaaatccgtctcttcgacagacattttgtgcctgctgccacgcaccaggctctcttgctttaccggtggacaagagagatgaagtccctgcccctgtggcagaggcagacattaactggcagtgtaataacgatgtgagcagggcttcaaagaaacacagggtttcctgagagtgtgtgaacaggaggcctggcctgacctggggttcctgaggcggcatggcttagctgaggccccaggcggagaggatttaactacggtgggcactgcaggctgagagagcggtaggatttacagagcgagaaacgtggcgggaacacagagaaattcataagtagcaaaacagagggtgctgagtgacatcaggaccatgttacaggtttaaattgattacctgataaaattagttaaatggtgcttatttctggaaattgagcaacaactttcctaatgaatataagcccttccgcagcagatggagtcaggctgaggctgtggggtttccagatggaagcagtgctgcaaagccttgcccggcttcctgcaagacccccactgtgctcacagcagcaagggtgatattcatcgtctcccgagatgctcctggccaatcgagctggccatccgtctctccaccttggctgctcactgccccttccccccgccggcatgacacgccaacatcacacatctagctccttgcggaaagggtttgattcctcccattgctgggatccacccatcagggaagcacctcagcacaacattgggcacaaacatgacagggtccttgctctcggtatggacagcagtggtggttcaatgtatatgatgccatagccccaatattactctgcagtaacttttttttccctattttctagaccataagacaaaaaattttagacttcttaaaccccttgacggcccatcttggggttcagttgacagcggctgttgcggcagtgtggagcagaaagaaagcccagcgtcacagtaagatgaaggtaaagtttaaaaagttacaggagtggttaaacttactgtgacaaagaaataccacagaatcatgtggaatcaaaggtgacattggaagccagcatgggaaactattgagttgatttaatcattttatcttattttatttctttatctatttgagatggagtctctctcttttcacccaggctggagtgcagtggtgcgatcttggctcactgcaccctccacctcctgggttcaagtcattctcctgcctcagcctcccatgtaactggaattataggtgcccgccaccacacccggctaatttttgtattttttagtagagacagggtttcgccatgttggccaggctggtcttgaactcctgacctcaggtgacccacccacctcggcctcctaaagtgctgggattacaggcgtgagccaccacaccttgccgatttcatcatttgaaatgcatgagataatatagctgtgtctcagtacaagtagaatgtgtattgggcaggtagggaagagcgcacctgacttctgttttctaatttttctgtaatgagtatatagtacttgtgtttaatctttttaaatctaaaatacatataagagtatatataacatgaacatttttaaagaataaaaatggcacagtggctcacacctataatctcaacactttgggaggccaagacgggcagatcgcttgagtctaggagtttgagaccagcctgggcaatatggcaaaaaattagccgggcgtggtgttgtgcacctatagtcccagctactcaagaggctaaggtgggaggatcacttgagcctgggaggtggagggtgcagtgagccatgattgtgccactgcattccagcctgggcgacaaagcaagtccctatctaaaaaaaaaaaactttacctaagaacatgccacccatttggcttaagaaatggtcacttatcctagcactgtgggcctttttttatttgtagtaccatcttattgcttttttaatgtgtagaaatcacacttgttagctgggcatggtggtatgcgcctatagtcctagttacttgggaggctgagatggaaggatcacttgaagccaggaatatgaagctgcagtgagctacgattgtgccactgcactctagcctagacaacagagtgacacttcatgtaaaaaaaaaaaaaaaaaaggaaattacatttgtccatgataataaagaaaattgaaatcaccaatcatatttctatgcccaaagataatttctttttttttttttctattgagacagagcgatctcagctcactgcaacctctgcctcctgagtttaagcaattctcctgcctcagcctcctgagcagctgggattacaggtgcatgccaccacactcagctaatttttgtaattttagtaaagacggtttcaccatgttggccaggctggtctcaaactcctgacctcgtgatccgcctgcctcggcctcccaaggtgctgggattacaggcgtgagcccaaagataatatcagtttgtattttgcccgttctttatccacttgactggtccatgatgaagtcctgcaggggtcggcttacctttttcaacctcaatcctcttcctttgttccctcccacccctgctccatcccctgctcgggatctgctgctgcacctccttgacactcccccagtgctcagcctttgtggcagacatgggcgcctgttctctgaggaagagtcagtggtcagtgtccaaggccaccctcctgagcgcctgtcggctccttccctggtgaggaacctggtgctagttgtttttcttccaaatgcccatgaccagggtatgcagacttctgtcatcaaaaatatgcctcccataccagggctttccttccaaggctagcaaatgggagcctggtttatctgtttttacttcctgtcttcgtatttttgattccatctcttgtttccttcaaatttagtatatttgtttctaaaatgctttctactaaattcaaacataccactattacagccccatcatggcctgcaccttttattcctaatttgtatcaaattatgttgttcccctgggtggagcctttacctagttcaataggaaatgtttgtttaagagattaaaacaggccgggcgcggtggcggctcatgcctgtaatcccagcactttggaagaccgaggcgggcagatcacctgaggtcgggagtttgagaccagcctagccaacatggcgaaacctcatctctactaaaaatacaaaacttagctgggcgtggtggtggccaagatcgcaccactgcactccagcctgggtgacagagtgagaccgtgtttcaaaaaaaaaaaaaaagagatgaaaacagattgatttctccagggacgactactgtagaatacaataaggatgtgtcatccttatttttactttctctctataagctttcaaggaacttttttttttcttggcagattatcccaacggcaagtgcatcccagctaacccttgtcgacttggtgtgtgcactcagcaccctgcagactgacacgctgctgcacctggtgaaggaggtggtgaagaggccaccccaagtcaaagggggtgatgaggtgaggagcctggggaagcctctgggcttctgcagattagtgggtggcatttgtcataactctacttccttataaatcgtgtttgggagggaaggataggtaacaagagctagtgggaatgcttggggtagtgaagtggaggtgctgtttgctgtgctttgggggagacctatgaagatctggtgcttcttttttaagttgggaactgcctgaggtcaggggctctcattccttgtaccctgctgctgaggacactgcctggtacatgggttagcgccttctgggcaccaagtggaataaaatctttagaaagaggaaatggcacctgcctcaaggagctcgcagccataaagatgccaaagataaacaaaaccagactctagtgaaagatggtaaagacagatgtgattcaataaccactgcggtaagggaaagtgttgggttcagtttagatttgtgtggagatgactgggaaaggatgagggaggagggagggggaaggagcaggaagtttaaggagagttggagaagtagaaaattacaaaagagcaggtggggaggctgctcagtccatagatgtgattaggccatctgggtttgctaactggggcttatccaaatgaggctcctaccctcccacagaggctgggagatcgagactctgtctttcttgatgattctgtttcaaagggatggctcccaggtccttgagaaacacattcctaggttgtgggagacacatacacatctcaaagggacagagaaagtatttatcattgtaaacttaaaagaaaatgctctaagaaagggaggtcaggggtctcgcaggaacaaacagtaaattatttggcaaccttgagctttctcggacaagtgtttgaagaggactggtgtccccatcctagggatccatgctagtgttgtttggggctgtgggggtggacagaatcatttgtcaagcagagggctcagaggagcctagctagaatcagctcaaggagagagtctttgtcaagggcaaattaaaatttgtgtaacttttttttttttttttttttgagacacagtttcactctgtcacccaggctggagtgcagtggtgcgatctcagctcattgcaacctccacctcctgggctcaagtgattcttgtgcctcagcctcctgggtagctgggagtacaggtgcatgctatcactcctggctaacttttggttttgttttgttttgtttagttttttcgagatgaagtctcactttgtcgcccaggctggagtacagtggtgcaatctcagcccactgcaaccccgcccctggggttcaagtgattcttgtgtctcagcttcctgagtagctgggattacaggtgcgcaccaccaagcccggctaatttttgtatttttttttttcttttagtagagacgggattttgctatgttggccagactggtcttgaactccacttgccttggcctcccgaagtcctgggattacaggcgtgagccaccgtgcccggccaaaatttgcataattttttttaaaacttttttttttttaagacaggatctcactgtcacccaggctgcagtgcagtggcacaatcacagctcaccatagcctcgacctccccaggctcaaatgatcttcccaaatagctgagaccacacatgcacaccaccacacctggctaatttttatattttttgtagtgacggggtttgccacattgcccaggctggtctggaactcctaggctcaagcaatcctcctgcctcggcctcccaaagtgctgggattacgggcgagagccaccatgcctggctgcataattttttataaaggtagaaaataaatgtcagagaacataactaatgatagacactctgagaaagaggagatttcatctggctgctgtgaaacagaaaccttcagggtgatgtcattgaaccgagaagttccttgtaatttttctgctcaatttcattacagcagcctggagggcccatgttgtctagagagcttcttcaattatacacggtggatttaaaacagggcaagctgtgtggtttaatatttgcattcccttagagtcttctatttctgtttttaccaaagcagtcttcatcattgaaagcagcagagctgttttgctcttaattaactaatttaataaaaaccagggatttatttcaatcttgaaataattgccttctgtcgaacagtttaaaatcatacagttagcaaaaatttaagaataatctaaatgaaaattaggggggccgggcatggtggctcatgcctgtagtcctagcactttagtccaggagttcgagaccagcctgggcaatgtagggagacatcatctctacagtaaatttaaaaattagctgggtgtggtagtgcacacctgtagtcccagccacttgggaggctgagacaggaggatcagttgagcacaggagttcgaggttgcagtgagctatgattgagccactgcactccagcctgggtgacagagtgagaccctgtccaaaaaaaagaaaattcgtgcaatggaaaaagtgattattaaaaaatatagctatacttgaacaggtgtttgtgtaccgatgttcatagcagcattattcacagcagccaaaaggtggacgcaatccctgtgtgtctcagtgggtgtgcggataacaaagtgagatctgtgcgtgcagcgcgttagtactcagcctcgagaggaatgaaattctgacacgtgctacacaacatggatgtcagatcctcaacatggatgaaccttgaagacattaagttgaatgaaataagccagtcacaagaggactaacacagttctatatctggaaaaaaaaaaacaactgtgtcctcactcaacaacataacaatcaacacagaagacttctcttaccccaaatatgcggggagttctccccaccagcaagcaagcaattgattccgcagtggacaccagttgggtgtcctccaattcaattcctactctatctgcttggagatagtgtcagatcccacagggtgagggctcagtccccaagagcacccttcacttcagacaccagtcacaagtctgggcctctggaacttctgactgactagcttcaagttgggattcccacgaaccccctctttgggttcagttaatttgtcagagcagctcccagaactccagaaacacgtttactggtttattataaaggctactactgaggatacaaatgaagggatgcgtagggcaaggtatgggggaagaggtgcagagctcctgtgccctccgtgggcacagaaccttcatgtgctctgctctctggaagctcaccaaacccagtcctcttgggccttttatggaaacttcattggatgggtatgactaaagcatggacaaccgtgtcgaagtgtgattggacaaaaagagtgtgatctaatacttaatacagtgactggggaaacctagcagggcctgcctgttcagattcttcttggcctgtctgcacagcactgcttcctccagggtgtgggacaggaccctctccagaatgagggtcttatgaaccgtagtcagattagagtcctgccttggggcaggtcaaaggagggcaggagttatgaaccaagaactgcagacaaacacgtaaaaacataggttgatacgtagatagatgatagatagatagatagatagatagatagatagatagatagatagaagtagttaggtaaatagatagatgtaggtaggtaggtagatgtaggtaggtaggtagagagatggatgtaggtaggtaggtaggtagatagatgtaggtaggtaggtagatgtaggtaggtaggtagagagatgtaggtaggtaggtaggtagatgtagggtaggtatgtagatagatgtaggtaggtaggtagatgtagataggtaggtaggtagagagatagatgtaggtagatgtagttaggtaggtaggtagatgtaggtaggtagatagatgtaggtacgtaggtagatagggagatagatgtaggtagatgtaggtaggtaggtagatgtaggtaggtaggtagatgtaggtaggtaggtagataggtagagagatagatgtagttagatgtaggtaggtagatagatgtaggtaggtaggtagatgtaggtagatagatagatagatgtaggtaggtagatagatattatgattttagagtgttaaagggtggctcactcctgtaatcccagcactttgggaagccgaagcagggggattgcttgagcccagaagtttaagaccagcctgggcaacaaagtaaaaccttgactctaaaaagaaaaaaaaaattagccaggcatggtatgcacctgtagcctcagctacttgggaggctgaggtgggagaatcacttgagccagggaagttgaagctgcattgagtcaagatcacgccactgcactccagtacagagcaagaccctgtctgaaaacaaaagaaagactttttttttttttcacatcagacaatgtgccgaccattgtaacaaagtttgagggtggcacatatcacgcatgtgcgtgaacacccaatcatcacactaatgaactgcagatgaatcggaagacttttttttcagccatttttttcagcctcacatatgacacggggcagccccctatagaaatgtccaggccccgagggcctggccgttgggcgtcacccagtcagttatcctccagctcctggtctcttccttcgttccagtgttaatcgacaatgctctatgtgcactgagtggtgtcgtggaggctaaatagtggaaaaagcaattcctgccctcagtcctcctatattctaggttggcaaagaagagagaagagaagagaagccatcctaaaaaataacagcactgcgaggccaggttatggagcgagctcagtcagtgcttaaggcttcgaatgtaaaaggacccggatgacttccacagtatttcttggggatctggcccaggtctcccaatcttccaagaacgtatggtcatcctgttgcctttcactgtttttttttttttttttttttgagacgaagtcttgctctgtcgcccaggctggcgcaatctcggctcactgcaagctccacctcccaggttcatgccattctcctgcctcagcctccctagtagctgggactacagtcgcccgccaccacgcccggctaattttttgtatttttagtagagacagggtttcaccgtgttagctaggatggtctcgatctcctgaccacgtgatccacccgcctcggcttcccaaagtgctgggattacaggcgtgagccactgcgcccgggcttttttttttttttctttttttttgagatggagtctcgctctgttgcctagcctagagtgcagtggcgtgatcttggttcactgcaacctctgcctcctgggttcaagcaattgtcctgcctctgcctcctgagtagctgggattacaggcttgcgccaccatgcccagttaatttttttgtatttttagtagagatggggttttgccatgttggccacgctggtcttgaatgcctgacctcaagtgatccacccgccttggcttcccaaacttccgggattataggtgtgagccaccgtgcctggcctcctttcattcttgtccataaatgttaggagtgggaatggtgctccacagggcggtctgtgctgctgcaggcttggtcgccgtagaaccaaggggttcttcgaggtcctgaagacagctctgcagaggctatgacagccagagcgagtgtgtttaggttgtattccttcacattacttgaatttctacaaatacctgcaatttctagtctttcctgggctataaaggaaccggattttatctagctgactgatttttggcggttcaaataacaaaactacattttgtggttagtttagttaattaatagctgcaaatagctttttacaagcaaggagggggtaaaatatgtgttttagaacttgtttccaagtagttccagccacagggtttttggggaagctgtctgagctgggcttggagtcatcttctaaactaagaactagaattttttggccgggtgcggtggttctacttgggaggctgaggcacgaggatcgcttgaacctgggaagcggaggttgcagtgagctgagattgcaccagtgtactccagcctgggcaacagagcaagactcttgtaaaaagaaaaaaaaaaaaggaaagaaggaatgcaaagaaagaaaaaggaaagggaagggaagggggaagggaaggggaagggaagggaggaagggagggaggaaggaaggaaggaaagaaagaaagaaagaaagaaagaaagaagaattagaattttttcttgcctcttggtaatcatatgcattcactggagtcaacactggccctagctttctgtttgggaagttcggttacagtgccaattttcccgaaatgcctgttgacgcctggaatgtaaagtaggtgcacagggtgggagatcactgtagaagtctaaggggatgtgaatgatttggggactcataggacacacttgttttaattgtacatgatgggcactatcatgtctgttgttatatctgaaagattctttagtcaaaaacctttgctttgttaggctatagatctgtttcattttgtatctgaattcttttagccttatttcccaccaactcggagtaattggttttactttcattttcagaaatcgcccctagtggacattcctgtgttgcagttttgctatgcttttctccaaaggtaatacagtcccccgtcctccaaaaacttccttaaatacagatgctattgcagtgagcatgcataataaatatctggttttatttctagactactagagagccattgttcagaaaatatcttaaagttgtcataatttcttcccaaggtattgatctatgcttttccttctccagagagttaacatcttaaaatctgtgcagcgtactttgaacactttatatgagcgaagctttatgtgaggcctgttaaactttaaaaggcttggatttgcattaaattgatacagaaaaagaaaaaaaccacatatagggaagtgttaaagacctcttttagaaaaaggagaaatgggccaggcgcggtggctcacacctgcaatcccagcactttgggaggtggaggcaggcggatcacttgaggccaggagtttgagaccagcctagtcaacatggtgaaaccctatctctactaaaaatacaaaaattagtccggcatggtggcgtgcgcctgtaatcccagctactcgggaggctgaggcaggagaattgcatgaacccaggaggcggaggttgcagcgagccaagacctcaccactgctctccagcctgggtgacagagcaaggctctgtctcaaaaaaaaaaaaaaaaaaaaggcaaaatgattgtttctggtggcgttctcagtgtgccttcccatgttttatgtggagaggtatctgctttgatttgctaagttaatatatgtattaggtgtctcagctaagagagcattaaaggggattccgcaggtttttccccatggatgaaaaagaagctttactggacctcattcagatcttacaatggctgcatcccaggtgcagctctgtgttgcagaaaatgagggtgaggtggctgggtgcggtggctcaacgcctgtaatcccagcactttgggaggctagagtgggtgagtcacttgaggccaggagtttgagaccagcctggccaacgtggtaaaaccctatgtctactaaaactacaaaaaattagccagggcttggtggcagcatgcctgtagtcccagctactcgggaagctgaggcaggtgaatcacttgaacccaggaggcagaggttgcagtgagctgagatcacaccactgcactccaggctgggggacagaatgagactctatctcaaaaaggaaaaaaaatgggggtgggaagggtatagaccacttctcagggaagcctcactatgcctacatagccatcaggagtctcactgtaaataactccaacaaccaggcacaggctccttgattcacacagttaacattacatagttattcccactcaccacattctgaagttgcaggacggtaaattgaggcctcctggtagatgaccagggtggggttaaattcagaccacttcccttgtgagcatcattgttgttctttcctccaggagttaaagatgagccggtcacttccctcctgtgacagcgaatatatattgcgttgctggcgaatgttgagtgtagtggcctgagggacagctgagctttcccaggagctgcaggttagatttggtcatcctccttttgcagaggagaaaccgcctaggtcacacaataggtagtaagttggagaaccaggacttggacctgggacactctgactgtagtctgagctttcactgcctggactgtgcttcctcgctttggagcggtgatctcagaatcctcatcctgagagctacagagcggggtaggccagtttcctggtgagtgtcctgggacctaatgctttgcagccttctgacaggtgatgctgtgttaccagccacttcagggaagcagaatattagcactagaaaggcctgagagatcagccgggcacggtggctcacgcttgtaatcccagcactttgggtgaccgaggcaagtggatttacttgaggccaggagttcaagaccagcctggccaacatggtgaaaccctactaatctctactaaaaatacaaaaaattagcccagtgtgttggcccgcgcctatactcccagcttgggaggctgaagaacgagaatcgcttaaacccggggggcagaggttgcagtgagctcagatcgtgccactgcactccagcctgggtgacagagcaagactctatcttaaaaaacaataataaaataaataaataaataaataaaataaaataaaataaaatagaagaaaggccgggcgcagtggctcacgcctgtaatcccagcactttgggaggccgaggcgggtggatcacctgaggtcgggagttcgagatcagcctgggcaacacggtgaaaccccgtcgctactaaaaatacaaaattagccgagcgtggtggcacatgcctgtaatcccagctattcgggaggctgaggcaggagaatcgcttgaacctgggaggcgaaggatgcagtgagccgagatcacgccattgcactccagcctgggcaacaaaagtaaatctccgtctcaccaaaaaaaaaaaaaaaaaggcctgagaggtcaaggtcgatcatctaatttaaggcttttattttagagacaaagaaaccaggagtatctcacctgccagcagtaggatttcaggttctcaaactccaagtgtttgccagaataccaaagtttagctcatgtacattgtaagtttttaaaaagaaaaaggtcagtgaggtatgctgtttaccctttgctttccaactgccaggatcttaaatatgcttataaataaatgtattttgacttgttcgtggttgagtatttttcctatcttttaaaaaaacaggctcccagtaccagccttgcaagagaacttttcttcactgttgggagtattgaaagagtctgtacagttgaatctagccccacctgggtattttctgcttctcaggtatcatgtcaccacattgtcattgtgtaatattttctcttggcacatattttatttctgcagcatttttaatctgaagctgattgtctcccaacagcatgctgaatgactttgtaacaagaactcccaacctggaaaacaagaaggaccaaaaagacctgcaggtttgtatatgaaagaggttcagccaaatgatattaccccagcagtgctgtcctcctttgggggatatcagatagcaggtagacaagagacattggacagaatctgaggttagctttgcacttgttctcaagtcttacttctgccatcactgtctctagagagttcggacagtcccggggcccgggttttctgatgaaggttcttgtgtaatgcttgagcaatcgattgtggaattgacagctgcacccctcaccctccacactgtatgcagatgtatgtggatctcactgtaaaacataaatggaataagaaatcttatttccccccagacgcggtggcgcatacttgtaatcccagtactttgggaggctgaggcgggcagattgcttaagctcaggagtttgagaccaatctgggtaacatagtgagacctcatctctacaaaagtacaaaaattagcctagtgtgatagctacacctatagtcccagctacttgggaggctaaggatcccttgagcctgggaggttgaggctgtagtgagctgtgatcacaccactgcacttcagcctggcaacagagagagatcctgtctcaaaaaaattttttaaaaaaggaagctatctccatacatggatatttctttttttcttttttttttttttgggccagggggttggacagaatctcactccatcacccaggctagagtgcagtggcacggtctcagctcactgaaacctccacctctggggttcaagcgattcttctgcctcagtctcccaagtagctgagattacagacatgccaccacgcccggctaattttttgtatttttagtagaggcgggctttctccatgttggctggtctggtctcagactcctgacctcaggtgatcctcctaccttggcctcccaaagtgctgggattacagacgtgagctaccacacccagcctccatacatggatttctttccttaaacgccttatcccccattataacagtaatatatgctcataacaatttgtttaatactgaaaaataaaactcatcataggagaaggaaaactcagagtggaatgccaactaataaatacggaagttatgatgaagttggaaaaatcactgttttgcaaaccattatagacattgattcagttggcttttctatcacatttatagccttggcgatactactgctaatctttatgatccctggcatttgtgaaaggtatatccagaaacagcctcaggtccacagttctgaaccacaagagtactgtataaagtgcagtaggccgtgtgcggtggctcacgcctgcaatcccagcactttgggaggccaaggtgggcggatcacctgaggtcaggggttcaagaccagcctggccaacatggtgaaaccccacctctactgaaaatacaaaaattagccatgcctggtggcggatgcctataatcccagctactcaggaggctgaggcaggagaatcgcttgaacctgggaggcagaggttacagtgagccgagatctcaccaccgtactccagcctgggcaacaagcgtgaaacttcgtctcaaaaacaaaaaacaaaaaaacaaaaacaccataaagcataattagaaaattccagtgcctcctcctttggccttgacttgtagccagagaagaaaacgttacaatgccgatgctgcacgtccaggtgctgggatagcacttgctcacctaagccctccctgctttcgtggcctgttgcctgtagcaggcccctctgtcttcagccagcctggacagggctctggccacaggcattccctccgttgttgcagctggcatgcctcttctctgctccttttggttgcggggaccaggtggcatctgcttctttctgtctcatgacacctggcctccccgccactaattccttcctactgttttgagcgacaccctatgcttcttccccactgaggatatagaaaaaaacaaagtgtgattttcctaccacactctcgtaacatagaatccttctgtgacctcgtaaccaaaatgtgtgggaattgcttcccaccagcaaccaagctagtagttctgcagtggacactagataggcaccgtccaattccattcaattctggcattccccacctagagatagcttgagatcctgcaggttgagggctcagtcccacaagactgccccaccccctcagatgccaatcacaagccccaagtggtttcatctgtgcttttgacagaccagctctaaactggggttctcactacccaccccttgggttctgttaattagctggagtggctgatggaactcagggaacacattgaacagtttattttatttatttatttatttttttgagacagagtcttgctcttgttgcccaagctggagtgcaatggcacgatctcagctcactgcaacctccgcctcccaggttcaagcgattctcttgcctcagcctcccgagtagctgggattacaggtgcccgccacaatgccagctaatttttgtatttttagtagaggtggggtttcaccatgttggccaggctggtctcgaactcgtgacctcgtgatccagccgcctcagcctcccaaagtgctggaattacaggcatgagccaccacacccggctgaccagtttattataaaggagattagaaaggatacagatgaagcgatgatcaggcaaggtacgtgggaaggggcacagagcttccatgccctcctagggcaccaccctctaggaacctccacatgtttagccatccagaagctcatccgaacccagttactttggggtttgtggaagcttcattacataggcatgatggattaaatcactggtcattggtgatcaatttaacctttagcccctctccccttcctggaggttggggagctgaagttctctgggggcccccagccacaaccatctaagacacgtattactttggagaatccaaggaatttaggagttatagctgggaaatggggagaaaggccaaaaacatttccacaatatcacacccgtccactcagtgctttcatcagtccttacgggaactcctctaagcccctaatcccttttcctgactttccttgtgcccttcacaccctgccctgcctaagttagccaattcgccacttccctcgagcgcacccttctctcacccagcaggcaggtgtgccctgcttcacacctcaacacaactgctgagcctaggaaccgtgtggcacagttgaggtcaggattataaaattctcggatgtcaaggattatagccactcgtagctggtgacacttgatgacactggctgagaagcctgcttcgagtttctgtctctccagctactaaccagattctttactgatcatactcctgagagtggatgactcctcacttcaccccactgagtcagtttaacttactgacctttatttcttgtatattattgaaagatgcatttctaggaagaacccgtggtcctagagaaaccagaaagccaatccactgaatacaatttatggttttttcatcagcgtgctgcaatgacttgtgttctctgtatattttacctacattggccagtatagtagccgttagccacaggtggctgttgagcacttgaagtgtggctagtctgcagcctgggcaacatagggagaccccatctctacaagaaatttaaaaattatccagatgtggtggcatgcacctgtagtcccagctacctgggagcctaaggatggcttgagcccaggaggtcgaggctgcagtgagacttttttttttttttttttgagatggagtcttgctctgttattgggggaactcacccccagtatttcaatgtaggttctttctattttccgtaagtgtcggccggctgagaaataaagggacacagtataaagagaggaatgttacagctgggccaccaggggtgacatcacgtatcagtaggaccgtgatgccctcctgagcctcaaaccagcaagtttttattaagggtttcaaaaggggagggggtgtaagaacagggagtaggtacagagatcacatgcttcaaagggcaaaaagcagaactaataataagggtctaacaaagatcacatacttttgagggaacaggacaaagggcaaaagcagaactactgataagggtctatgttcagcggtgcacgtattgtcttgataaacatcttatcttaacagaaaacagcgttggagagcagagaaccggtctgaccacagatttaccaggatggagtttttccccactctagtaagcctgagggtactgcaggagaccagggcgtatctcagtccttatctcaaccgcataagacagacattcccacagtggctgtttatagacctcaccccaggaatgcattcctttcccagggtattaatattaatattccttgctaggaaaagaatttagcgatatcttccctacttgcacgtctgtttataggctctctgcaagaagaaaaatatggctcttttttcccaaccccacaggcagtcagaccttatggttgtcttcccttgttccctaaaaatcactgttactctgttctttttcaaggtgcactggtttcatattgttcaaacacacgttttacaatcaatttgtacagttaacacaattatcacagtggtcctgccatgatgtacatcctcagcttatgaagataacaggattaagagattaaagacaggtgtaagaaattacaaaagtattatttgggaactgataaatgtccatattaaaatgaaatcttcacaatttatgttcctttgctgcggctccagtcggtccctttgttcggggtcgctgacttcccgcaacactctgtcaccaggctggagtgcagtggcactatcttggctcaccacaagctctgtcatctgggttcaaatgattctcctgcctcagcctcccaggtagctgggattacaggcgtgcaccaccacgcctagctaatttttgtatttttagcagagacggggtttcaccatgttggccatcatggtctcaatctcttgaccttgtgatccgcctgcctcggcctcccaaagtgctgggattacaggcgtgagccaccgcgcccggctgcagtgagtcttgattgcaccactacactccagcctggttgacagagcaagaccctgtcctgcccaccacctcctaaaaagaaaaatgtggtagtctgaattgaatgcactgtaagtgcaaaacacacattggatttcagacttagggcacacacaaaagagaatgcaaaatctgattaataggttgtttttgttttttctttttgagacgaagtttcgctcctgttgcccaggctggagtgcaatggcatgatctaggctcactgcaacctccacctcccgggttcaagtgtttctcttgcctcagcctccaaagtagctgggattacaggcatgcaccaccacacccacctaattttgtattcttactagagacagggtttcaccatgttggtcaggctggtctcaaacgcctgacctcaggtgatccgcccgcctcagcctcccaaaatgctgagattataggcatgagccaccacacctagcgtattaataatttttatattgagtgcatgttgataatattttgtatatattgggttaaataaaatacattattaattttttttttgaaacgaagtctcactctgtcatccagactggagtgcagtggcatgatctcagctcactgcagcttccacttcctgggatcaagcgattctcttgcctaagcctcccgagtactgggactacaggcatgtgccatcatgcccagctaatttttgtattttttttagtagagacagggtttcaccatgttggccaggatggtctcaaactcctgacctcaagtgatccccctgcctcagcctcagcctcccaaagtgctgggattacaggcatgagccactgcacccagcctatattattaatttaactttaactgtttatttttaccttcaatgtggctcctagaaagcttaatggtacgtatatgctcacagctgtggcctgcattttatttctactggacagtgctgttttaggcacttaacattcttttccttaattaacttcctttccccctcctcctgataattctcaggaaatcactcagaaaatcctagaagctgtggggaacattgccggctcttccttggagcaaaccagctggctaagcagaaacctggaagtgaaggcccaacctcaggcctctctagaagaatctgatgctgaggaggacctgtatggtaggtggagatgggttggctgatagtgcctctggtcagcgcgtggttctggcttttccttaagagagatcttgagtgttctcaccacaaaaagaaagaaagtacttaaggtaggctgggtgcggtggctcacgcctgtaatcccagcactttgggagaccgagatgggcagataaagcaaggtcaggagtttgagactagcctggccaacatggcgaaaccccgtctctactaaaagtaaaaaaatcagctgggcacagtggtaagcacctgtggtcccagctacttgggaggctgaggcaggagaatcgcttcaacctgggaggcggaggttgcagtgagccgagatcacgccactgcgctccagcccaggcgacaaagcaagactccgtctcaaaaaaaaaaaaaaaaaaaaaaaaaagtatttagagcagtgacaagatgttagtcaaactttagaaaacatcactttgaggccaggcatggtggctcacgcctgtaatcccagcagtttgggaggccgaggtgggtggatcacctgaggtcaggagttcaagaccagcctggccaagatggtgaaaccccatcttaactaaaaatacaaaaattagccgcgcgtggtagtgggcgcctgtaatcccagctacatgggaggctgaggcagagaattgcttgaacctgggaggaggaggttgcagtgagccaagattgtaccactgcactccagcctgggcgacagagtgagactacacctcaaaaaaaaaaaaaagaaagaaagaaagtacctgaggtgatgcatgtcttaacttgtgttttttcacaatgtatgcatatatcagcagggatggtgaaatattgaaaaaagaaaacatatatcaaaacatcatgttataacctgaaatgtataccagttttatttgtcagttatatctaattaaaactggtaagggaaaagatgttggaaagttaaaaaaaaaaaaaaagtttaggcataggaaaaagcaaactaccttctcaagtctgtgttcattcacccagactctttctttgttttttgtttttgtttttttgagacagagtctcgctctgtcacccaggttggagttcacccaggttggagttcacccaggttggagttcacccaggttggagttcacccaggttggagtgcagtggcgtcatcttggctcactgcaacctccgcctccctggttcaagccattctcctgcctcagcctcccgaatagctgggattacagacatctaccaccatgcctagctaatttttgtggttagtaaagacagcgtttcaccatgttggccaggctggtctcaaactcttgacctcaggtgatccacccacctcggcctcccaaagtgctggtattacaggcgtgagcctctgcgcccggcccagactcttcctttgtatccatagccagatgactgaactgtctgttttgactttttacaacatactatgtgtgtgtgctaaacaccgggaccccttagctggtgtcccaccatgtgtatgccatcctgctgaccttcactgagcctcagtggggctccagaaagtaacaccccaagaccatttacctggacatggtgatagaaatctgtgtgggataaagatgatgagaatgtgtgtgtttctttttgcagaactatggaaagagaatttagcaaatcaagctgggagggttggctcatgcctgtaatcccagcactttgggaggctgaggtgggcgggtcgcctgaggtgattacaaatgatcctttttttttttttttcaggattaagcatatcttggggcaagtgattttctttgctactgtcagtgtcatttaacacagggaaggacagtatgcccagtgccagtagagcttaatacaacgtgagaaaggatgtttggtcccagttttatttaatacaggaacaagaaactacatttcagttttcagtgtaaactatcacagtacctgccacagagtaatgttcaaatattgttatctttcattattacttctacgaaaattgttagcagggctgggtgtagtggctcccacctgtaatcccagcactttgggaggccaaggtgagaggatggcttgaggctacaagtttaagactatcctggttagcgggcatggtggctcagacctgtaatcccaacactttgggatatactccatttaaaaataaatcaggccgggcacagtggctcaggcctgtaatcccaggactttgggaggccaaggtgagtggatcacccgaggtcaggagttcgagactggcctggccaacttggcgaaactccatctctactaaaaatacaaaaattagccaggtatggtggcgggcatctgtagtcccagctactcaggaggctgaggcagaatgacttgaacccggaaggtggaggttgcagtgagccaagatcgtgccactacactccagcctgggtgacagagcgaccaaactccatctcaaaaaaaaaaaaaaaaaaggactatcctagtaacacagcaagaccccatctcaggccgggcgcggtggctcacgcctgtaatcccagcactttgggaggccgaggtgggcggatcacctgaggtccagagttcgagaccagcctgaccgacatggagaaaccccatctctactaaaaatacaaaattagctgggtgtggtggcgcatgcctggaatcccatctactccggaggctgaggcaggagaatggcttgaacctgggaggcggaggttactgtgagccaagatcgcaccattgcactccagcctgggcaacaagagcaaaactccatctcaaaaaaaaaaaaaaaaaaaaaaagaccccatctctacaaaaggggaggcagaggttgcagtgagtcgagatggcgtcactgcactccagcctgggcgacagagcaagactcatctcaaaaaaataaataaataaaaataaggccaggtgcagaggctcacacctgtaatcctagcactttgggaggctgaggtgggcagatcacctgaggtcaggagttcaagaccagcctggccagcatgatgaaaccctgtctctactaaaaatacaaaaattagccaggtatggtagtgtgtgcctgtaatcccagctacccgggaggctgaggcaggagaatcactggaacctgggaggcagaggctgcagtgcgccgagatcgtgccactgcactccagtctgggcaacagagggtgcaaactccatctcaaaaaaaaaaaagtttttttaatgactaaaagaaagtaaattaccaagagaatttcaggtgggacttagtactgcgaggaaagtaagagtaatgtgataaggagtggctggtagtggggcagggccactgtgagtgttacagaacatgtccccaaggaggtgacagttgtgctgagagatgaaagacaaggggacagccctgcagaggtctgggaaggcactgccccgaggggattgcaggccttggccacgggagtgggcttagacccagcgacctgaagaccaggactctggagcttcatgaaagtggtgggaagaggtcagagaaagggtggagactgatgagactgatggttgtcgggcttggtagaaagcacactaaggggccgggcacagtggctcacacctgtaatcccagcactttgggaggccgaggcgggcggatcacgaggtcaggagatcgagaccatcctggctaacatggtgaaaccccgtctctactaaaaatacaaaaagaaattagccgggtgtggtggcaggtacctgtagtcccagctactggggaggctgaggcaggagaatggcgtgaaccagggaggtggaggttgcagtgagccgagatcgcgccgctccactccagcctaggcaacagagactctgtctcaaaaaaagaaagaaagcacactaaggagcttggatttcatcccacttgccacaggtagccttaaagtacttagagcagccacatgttagtcaaactttaaaaaccatcactttggctgctgtgatcagtacagtgtgtattggatgagcacagaaactggaagtccaggtaaaaggattttgcgctggttaaggcagaagatgattctggcttggaggcagggtcaacagaaagggacagtttaaatgcagagtcagcaggatttgctgatggatcggatgtagttattttagaaaatgcagccaaggatgacaggtttttggcttaagcaatttaccaaggtggaaaaaacagaagaaaaaacatttcgtagagaaaaattgagcttgattttgcacatgttaagtcggaaatgatggaaaagagaaggacccagcaaagatgattaagcagtcactgaggtgggtgaaccaagagagcatagagccttggagtctgggaggagacaatgtgtccgaaggccccaggggcagacacacggtggagggccgctgagaagcaaagtgcaacaggaaggggcaacaggagctgacaatgtagaattcatcggggtgggtggtcaggatggtgaggggacacttgagaaacaggtggagaagaggatgggaatggagcaaggggagacagtggaggtcggtaactctttgaggctagttgtccatagggcagtagccaagcagaattaaggaccagagaatgttttgttgttgttgttttgtgtgtttgtttgagatggagtctcgctctgttgcccaggcaggagtgcagtggcgtgatcttggctcactgcaacctctgcctcctgggttcaagcaattcttctgcctcagcctcccaagtagctgggattacaggtgcacgccaccacacctgggtaatttttgtatttttgacagagacagggtttcaccatgttggccaggctggtctcgaactcctgacctcaagcgatctgcccgccttggcctcccaaagtgctgggattacaggcctgaaccactgcacccggcctgatttgtttttaaatggaggatatcaaagcctatttgcatggtgacagaacagtacagcagagaggaagaaattaattcaagagagaggaaggataattagcagagtccttgatggccacagggccaggattgggatcataaatggaattattgttatttgataggagtcaggaacatatctattaaaacaggagatgaggctgggcacagtggctcacgcctgtaatcccagcactttgggaggctgaggctagcagtttgcttgagcccaggagttcgagaccagcctggacaacacagtgaaaaatccccatctctacaaaaattacagcctgtagtaatgggacctgtagttccagcttctgaggaggctgaggtgggaagatcacttgagtccaggaggcggaggctgcagtgagccaagattgcaccactgtactccagcctgggcaacaaagcgagaacttgtctcaaaaaaaaaaaaaaaagaattatgttggagagtgggaaagccagcaccccacctgggaacatgtggtagcatcaagtcccttgagagattcatggtcatgacataaagtaagatcagttgcttggtggtctggtttgctctggaacatttagctacacataactacgtagacagatcattgggtgtacccagcagtgcattcttctaggtgagtccttccgagggaaagaagcaaaggagtgaagggtagatgactgaccctgggtgtgggtgggaggtgaggacctgtagcagctgctgggtagttaggcagtaggactcagggactggaaagctgtcctaggatgcaggaaaatgccagaggggtggtcagaggaggatgctggaaacggagatttgagaagctggtgaggtcaagggtatgacagtggtggagctggagcggagtcggggatggttagaagagaagaaggccaggggcttagaggctgggatgtaggagggagcatccaaaggggtcgtgcagtttcaagaacgatgatgagaatggaaatggagaggatgttagtgagttagtgctaatttatttgatcaaaatatccagattc

SEQ ID NO: 391 - DNA, 8309 bp, Homo sapiens
ccgtaaacactcccttcgttttattcatcttgattttcatagcgatccccttctaatttctttatcgtgcctcaccttgtttggtcctcaatcccaaataattataaatttccaagctagttgtttaaccaaaaattaaccctgaaattagtttccacctatacaggacattgaacagaaataaactacactgttttaacttctttttctaacttggcacctggatcaaaagtctgagatcattgttttcatttgtgtctttagctgtggcatactattgaatatattgttgattatatttgcctggcaaagttgaaacccataatttaaattgaaagtatgatatttaaatggatatatttcatgcacaataatccacaaaatattaagctagttagtgtcataatatcacagacccaggcttctgattcaaactgagagttgttttcaatatgctacactatctgcttacataccccatctgttgaatttttagcatctggcaactcaaagtatggcctccaactagcagcaccttcatcaccttggagctttttagaagtgctgaatctcaggtaccacttgaaaaactggaatagaatacacattttagcaagattgccttgtaagtgcaatgaagttttaaaagcactgtcttagtatatttcacatataagcaagagtaaaactcatctttcttacttaaattccagatcagggtacagtaatcctttttcttagaaaaataaatttcattttacttcagtaaaaaggctggcttctgttatataactctcttatctaaactcttttgaaatttgtttattcattcatattcatttattctcatgaaattattaagaaccgaatatgagccagatattattccaggttctgggaatttcatagtgatataaagagaaaaccttgccctttttgaaactacattatagatgaggtagacaaacaatatacaagattaataactaaaatatacaataggttacatggtaaaaagtacaaaatatgataacaaagcagtaaggaaaagtgaagaatgtcagagcaagtttagcgttgcaaatgtagagaaggttgtcagaaatttagaactaagtattttctttcaaagcatattttcctttttatggcctcaactccaatctccaagtagaaaatatccaagcctaaactttagccttaatttcccagtggtgttctggctccaaacacataacaatattttgatagatcccctaacaatttaacataatagatttattatcataaaattattatagtctgatgtcttttgaggacttctttgaccataatattctttcctcaaccccttccaaagcctatgactggggaaaccctaagcttcatcaatttgtgcaaattcacaaacactcattctcgaaggatctctttctcttcagggctccttcagggctttgtctgtgtggcctaaacacaaatatgaagttcaacgctttttcaaattttgaaaaaaaaaaatcatcttaaaagcattcatgagcaatgtcaatttaataaaagattctataacaaaggtagaaaagaatgtttgcattgcagtcataggttgggtttcccaaaatgagattgccttacagggggttgattggagagtgctgtcaggaactacaccagaaaggccatgacagtgcagaactgaaaaaaggaagaagttgaattgtgatgattaggttgcaaaaacgacctcaaaaaactggagcagcgggagttctgaagttcagatggccttctggagatgctcataagtgcagcaagtgttcaatactgctgctttaaacagtcaccctcctctatctttgctatggaatcttctataaagtttgctgtcatagtatcacttatgttgtgtcaggtcctccaagaaaaagacaccaagagaggattagccatttgccatatatttaaaatcgccataattgtgagggaaattgggaaagagtaagaaggaagttggcaatgcaatgacactttgatgaagatctaatcctagttaaaggagagagaagattgggtagaagcatctcagattcaacacaattataatagagattggcaaggctgttagggagtccttgaatcaaatttgcttgtcagaggagtcctctacctcctatgactagatttaccttagtattctttacttggtaaattattggctgggaatagtccatgggaagcatggacttaatttcagagctcagacaattaaatgcacctgcagagatctgcaaggtgtattcttataactgccacaatgaggtgctagagttgctgttcctgaatcagggcatggaggacatgagtctggaatgtgagaaattcactgggatatcccctagtgcttctttctctgtgatgagagtaagtgagcatttttagcaatcatggactgagaacaccaaagtattgagaggcgtagaaacctcaggaacaaagatctgtgcccacgaggaaatggacctagacagtaacaatcccactaagatgaatggtctccgaaatgggaagtagagaaagaagacattgaatataggttgaatatagattatggcatctaatctgtagcagcagatacatttcactaacaatcttaatttaagctcttattttagatactgagtacagccactattttgaaatgccagcgacagagtggaatctttcatgcacgtccgtgtgaagagaccaccaaacaggctttgtgtgagcaacatggctgtttatttcacctgggtgcaggcaggctgagtccgaaaagagagtcagcaaagggaaataagggtggggccgttttacaggatttgggtaggtaaaggaaaattacagtcaaagggggtttgttctctggcgggcaggagtgggggttgcaaggtgctcagtgggggtgctttttgagccaggatgaggcaggaagaggactttcacaaggtaatgtcatcacttaaggcaaggaccggccatttacacttcttttgtggtggaatgtcatcagttaaggtggggcagggcatattcacttttgtgattcttcagttacttcaggccatctgggtgtatacatgcaagtcacaggggatgtgatggcttggcttgggctcagaggcctgacattcctgccttcttatattaataagaaaaataaaacaaaatagtgttgaagtgttggggcggcgaaaatttttggggggtggtatggagacagaatgggcgatgtttctcagggctgcttcaagcgggattaggggtggcgtgggaacctagagtgggagagattaagctgaagggaggccttgtggtaaggggtgatattgtggggatgttagaagaaacatttgtcgtatagaatgattggtgatggcctggatacggttttgtacgaattgaaaaactaaatggaataacagaaggagaaaaacaggcataaaaggtttaagaattgggatgactcaggatatctgattagagagtgcctaaggagattcagcatagtcctgccagcaaagattatttatttacttcaagagttaagagtggcagtttggggatagcaccaggagatatcagctgtgatggcttggaaaaacagtgtaaaccagcagtgaaaacaagagcagggcatgtatgagtagttgagaatggtgaataggagtatgactagacaaaagatagtagggatgacaagtttttttggggcacagtctaagttggtctggtgtcgaatgagactggggcctaataaaaaggagcatctatacaggagcttaaatgggctgtaccctgtagcattctgaggacaggcctgaattctgagaaacgaaagtggtaaaagtattgtccagtcctttttaagttggtggctgagcttattgaggtgtgtctttaaaagatctttagtccgttctacttttcttgaagatggaggaccgtaagggatatgaaggtttcactgaaccctaagagcctgaaaaactaattggctgatttgagtaataaaggctcgtctgttatcagactgtatagaggtgggaaggctaaactgaggaattatgtctgacagaagggaagaaatgactgtggtggccttctcagaccctgtaggaaaggcctttacttattcagtgaaagtgtttatttagactaagaggtattttagtttcctgacttgggcatgttgagtaaagctaatttgccagtcctgggtgggggcaaatcctcgagcttgacgtgtatggaagggagggggtctgaataatccctgaggagtagaatagcagatggaacactgagaagttatttccttgagggtagatttccacgatggaaaggaaatgagaggttctaagaggcaggctagtggcttgtactatagcatagcctgcctttgctggtatgtggcgattaggcctggtggaactgccatcaataaatcaagcgtgatcagggtgaggaacaggaaaagaaggaaatatggggaaatggggtgaatatcaggtggatcagagagatacagtcatgggggtcaggtgtggtatcaggaataatgtgggaggccagattgaagtcccggccaggaacaatggtaattgtgggacttaacaaagagtgagtacagctgaaggagccgggaagcagaaagtatatgcgtcagatatgaggaagaaaatatattttggaagttatgagaaatgtagagagtgagttgagcatagtttgtgatttttagggcctctaaaagtattaaagcagcggcagccgctgcacgcagacatgagggctaggctaaaacagcaaggtcaagttgtttggacagaaaggctacagggtgcggtcctggctcttctgtaagaattctgaccacactaaccatgcctaggaaggaaaggagttgttgttttgtaagggattgaggtttgggagattaatcagacacaatcagcagggaaagcacgtgtgtttttatgagaattatgccgagataggtaacagatgaggaagaaatttgggcttgattgaagtaatgggggctgtctgtgaagccttgtggcagtacagcccaggtaatttgctgagcctaatgggtgtcagggtcagtataagtgaaagcaaagagaggctgggatgaagggtgcaaaggaatagtaaagaaagcatgtttgagatatagaacagaataatgggtagtagagggaggtattgaggataggagagtatatgggtttggcaccacggggtggataggcaaaacaatttggttgataaggcgcagattctgaactaacttgtaaaccttgtctggtttcaggacacttaaaatgggggaatggtaaggagagtttataggctttaaaaggccatgctgtagcaggcgagtgttaacaggctttaatcctttcaaagcgtgctgtgggatgggatattggcattgagtggggtaagggtgattaggctttaatgggatggtaatgggcctgtgatcagttgccagggaaggagtagagatatcctatacttgcgggttaaggtggggggatatgagaggaagactcgaaggaggctttgggttggggagaagggcggcaatgagatgtggctgtagtccaggaatagtcagggaagcagataatttggttaaaatatctcggcctaataagggaactgggcaggtggagataactaaaaaagagtgcataaaagggtgttgtctaagttggcaccagagtgggggagttttaaaaggtttagaagcctggctgtcaatacccacaacagttatgggggcaagggaaacaggcccttgaaaagaaggtaatgtggagtgggtagcctccgtattgattaagaaggggacggacttacactccactgtgagttacctaaagctcggcgtccgtgatggtctacggggcttctgaggtgatcaggcagcgtcggtcttcagccggcaagccaagaaggagtcagtcagagagccttgggccagagttccaggggctctgggagtggctgccaggtgagttgaacagtccaatttccagtggggtcccacacagatgggacacggcttaggaggaatcctgggctgcaggcattccttggcctggtgatcagatttctggcacttgtagcaagctcctgggggaggaggttctggaggaacgcctggctgctatggttcaggcgtttggaaattcttgtgtgctggagatgtgtctgggctttgtctcacagtggaggcaaggaattgcaactttttttctgttattgcacaccttgaaggtgaggttaattaagtcctgttgtggggtttgagggccaaattccagtttttggagttttatttaatgttgggagcagattgggtaataaaatgtatattgagaataagacggccttttgaccttttagggtctagggctgtaaagcgtctcagggttgctgccaaacgagccatgaactgggctgggtttttatatttgatgaaaaagagcctaaatgctatctgatttgggataaagaaaaaggagcattaaccttgactatgcctttagctctagccacctttttaagagtaaattgctgggcaggagggggagggctagtcacagaacgaaactgtaagccagaccaggtgtgaggaggggaggtgataaaaggattatagggtggaggagcggaggctgaggaagaattgggacctagctcggcctggcgaggagcagcctggggaggaagggagaggtcagatgggtctgtagaaaaggaagattagaaagactcagcgacgcttggtgttggtactggggggacaggcaggagggaaagaaggaagatttgggacaagttgcactgggcacagagactaggaagggactgatgtgtaaaagaatgcctggacgtcaggcacctcagaccgtttgcctattttacgacaagaattatttagatcttgcaggatggaaaaattcaaagtgccattttctggctatttggaactactgttgagtttgtattggggtcaggcggcattgcagaagaaaataaggcatttaggttttaggtcaggtgtgagttgaagaggttttaagtttttgagaacacaggccaagggagtagaaggaggaatggagggcggaaggttgcccatagtgaaggaaggaagcctagagaaaagagagagtagagaaacggagggaagggatttgggggttcttatcttccagaaaagtgggaaaagtggttggggtgcagaaataagggattggggcacagagatataaaaggttggggcacagaaataaggggttggggtgcagagatatgaggttggggctcagaaataagggattgggacacagagataagaggtcggggtgcagaaataagggattagggcagagagataagaggtcggggtgtggaaataagggattggggcacagagaaaagaggttggggtgcagaaataagggattggggcacagagataagaggttggggtgcagaaataagggattggggcacagagaaaagaggttggggtgcagaaataagggattggggcacagagataagaggttggggtgcagaaataagggattggggcacagagaaaagaggttggggtgcagaaataagggattggggcacagagataagaggttggggtgcagaaataagggattggggcacagagaaaagaggttggggtgcagaaataagggattggggcacagagataagaggttggggcgtggaaataagggattgggggttcttgccccgtagaaaagcgggacttgccgctaagggtgcaggagaaggggttgaggaatagttgcccctctcccaaaaaagcagagaaggggtagagacaaggagagaaggggttggggtacttgccccttccccagaaaagtgggacttgccgctaagggtgaaggaccaaggcaggcattcctgcgtggtctgacacccttgaaaggtgggtgtataatcagagacgcgtccctgcaatgattaaacaccaagggaaggctgccttcccagtctgtgaccggcgctggagttttgtgtccacggataaaatgtgtctcctttgtctctcccagaaaatgaaaggaattgaaattaagagaagggagggattgaagagtgaaagggagaaagtggttgagggacagtgagagaggttggagaagagagtaagaagaggccgcttacctgatttaaaattggtgagatgttcc

SEQ ID NO: 392 - DNA, 17078 bp, Homo sapiens
acagtccaatagttattttatgtgattttttagcagataaaacaggatttttttttttttagctaaaaatgagctctttctctagatagaattttagcaaaaatgggagacaggatgcgatcatgcctagaaaataatgaagctggtaaggcccactgggtccctgctaagaaggggcatcgtggtgcttgcagcatcattgacaatgacaggcacttgtcactcatgggttggtgttctcctctctccatggcctcgtctatccatctgggagttgcaggtgatgtcctcactaaggcacccttgccaggcttcaggaggctgaggactgtcctcttctctctcagaaggcaaggtgtaggactgctcagcgtgcttgagactagaaaaggcccctgccagactggcgctagtatcttttctgtaaagaaacaggtgttttagtgtaaattcctcacgtcccaaagaggtaattcaagcaaacaaccagaaatgcaaacagtacagaaaagcctatggcaaaaatcccaggagatgcaatggagaacaaaacacttccaccttccaggagctgacttgcaccaaacaagaaaagaactaaataagataattcgggtcacaagagtaatattgaagtccaggtagcttgagaaagatgagtccggccatgtctccatttttagatggcaacctgaggctgggtttgtcataaaccaagtcaagacaattgagacctgttggcatcttcaagctagccagtcatggggactgtatcttctttatccatgtggcacacaaggactggggagatgctggggagtgactcctgttcagcttcagacattgcttcaggaaggggacaaatttggcccaggaatgactgctagccttgttgacattagggagacttggcagtgtgctgaaaaccaacctgaagtaaaagtgcctggttgctatttgaaattcaaggtgattactagagtcaatacccatgaaaaggggaaaggatatactccaagtagatatcacagaggatctaatcactttgggacagaaggcatgatggagtcctgagtgtaacatggcagagaaacagtaaatgtctttcccaatcatgccacatatataaatcatattaaagctaaactgccgctgtttttgataatgctatccagtaagtacttttgatgtaaacctatttctccactcagatgaaggaatgggagtaggggaaggctttttttgttagatatgcctctaggcttaggaaaatattttaagcattttgatgattaccaaaaggaaaagttgccagtttataagaagatggtaaggggccagttgtggtggctcatacctgtaatcccagcaaatttgggaggccaaggttgggggatcgcttgagcccaagagagggagattgcagtgagctgtgattgtgccactgcactccatcctgggtgacagagcgagacactgtctcaaaacaaaaacaaaacaaaaacaaacaaacaaaaatcagtgagggttggggagggaagaagaaaagaaagaacaagaaaaaagaccaatggtgtaattgggggaaaggggggcgattcctgaatgtgtgccataatatatgtgaagtgttaattcattctttcaacaaattctcattcacctaaaaatatgtatgaatcagttaacttcactatttcatgtaatttgaatctgtctttttctcacaactttccaatgcttgttagacatttacaaatgagagatatccttcatccttctttcccatctcacatgctgttgtattaagaaattacatatctatcttaaacccttaaaggcattcgagtttactgttattttcttaccctttttaaaataaatatcatgatgacgataattataggattgtcttctgactgatgaaaaaatactaaaaactcctgaaatgtttttgcataaatgccttctatttttcaataaacctctgataatacaaaattaaataccaaaggacactcatttaacagtataattagaagtgagcatgacctgagttgctgctgaaaatggggtttctgatatgaacctctttcctagatgaactttgaatcatgcagaatctcaaagaaatgtgggttgtgtcagacagtgagttcagaatcactgaggcagtgggacagtatgaatcaagatgggcagtgggaggaaattctgacaagtggtgacaggtaagctattgatatcaggttaattcagcagaagaaaggcagcttgacttggcagagacaaagaatagaggcagggagttggggagaagggacaacatacatatatgcaagaagagagtagataagagctcagatctgggatttagttttcaaatcagtactgctgggttattctatagacagactcatcacaagtttgggtgtagaaaatgactgagaaacaaaaattttaatatttgctgctataagaacaacagtggctgaatggtcatcatgcagataatcagaattcactggacttccttaaacttcctttgctgtttattactatttttgttttgaattacacatgtggagggcacgataatcttttcactactcaagttttctaaaggtcttaagctgttcctagttagaactgtggcacatgttttcagagcagggcagttggaaggtcaatgatgcagagttactgggaaagagctaattaaattatccagcaaacgtcaggatttagcctggtgtttatttgagctgaagatggagttagacagtacagttttggggatttgaatgatgggggcaaataaatctttgcaagagtttatgaagactatacatatcaatgtcaagaaatgtgaagggtctgggaatttacaattcttgcaatctaactagttagcctgctgcagtttcatggatgctggcaaaagacaagaagtctcctgggtcagagacaaaggatttcaatactcacagtaatatcaatagctggagcatcaatattatcttgtgacagttcactgagccccagttcccacagagtaacatgaaaagggccagatgatatctgttcacacagtaggttgcactatcaaaatgaaatcctgagcttagggaacccaaaagctattaatgggcaagaagcatgcctgaccgttgctctggagggagacgctatttctattttccaaggctgttcactatacaaacataattgaatagatagtctggaacaaaggctgtcagtatcagctcacaagatgtgaaaaaacatgagagacctatgaagaattgatccccagtcatcaatatttcatttttctgtttaaaaaatgtgaggttctaaaagatcaagtgacactttaaaaaaacacaatcagttaacatatgatttttaggctagacctagatgctcaggcctgaatagcaaagcccgctatgtaacatccaaggttccataagctttcccgacagagttcctaatgttaggatgcataatgttcggatgcataatatacacattttaaattaatttgaaaagtagtgctgattgatactcagtaatcccttctgttccagacttacagtattattaatgccattgtctagagtattttgtgagaggctattccaactgaaccatatcttccctaacagttacagagaaatagacagatttcctctctatcgaagcacaagtttatttacacagcaactgtagtttgtgtagtaatgttggagacattacttggtgctgctgtaccacccgagagggtaccttagaggaagcactctaggtgtcaatgacagtgaagaagtagctgacaggtggtagaaagtgagcagcacctggagtcatacaaaaaatttaccgattattggcaattaacttagcatcacaatgtcaaacaatcaccctgtaaaaggagaatatccatacctcactcaaagtgttatagtggaaaattaaatagaatgaatatgccagtgctctatttttgaaacattcattagagattgcgctctggtgaaaattgtaaatggctgtatacttcataagagttgtcagtgacaatcatgagaacagtaagctgattaacaagacaaagttgacattttgctttctagaagataaaacttctgattgcgtgaactccaaaaaaaattaactcaaacaaaaatacagaaaactcccaaattttttaaaaaaaaacccttgaggtcatagggagacaattttttaaaaattgtacttttcatgacaggcctcatttttagggaaaaacaagtagttttcaaaataaataagcttttgtttttgtagaatgtgggcttattttatgaacttatcactaatttgtaattttcttaaaatgttgaatatataacggtgatgaaagatgttttcattctttcattaaagttgccatttttgttgggcgccgtggctcacacctgtaatcccagaactttagcaggccaaggtgggcagatcacctgagatcagaagtttgagaccagcctagccaacatggtaaaagcccatctctatgaaaaattaaaaaaaaaaaaaaaattagccaggcgtggtggcaggcgcctgtaatcccagttactcaggaggctgaggcaggagcagcatcgctttaacccagaggcggaggttgctgtgagccgagatgatgccgccgcactccagcctgggtgacaagagggagggtcagaatcaaaacaaaaataaacaaaaatattgccattttctttacctgtgatttacatgaaattttctaattctgttttctgattagtcacatgtttaaatggagtgtgtttaaaaattcattatatatgtacaaaccatgttaaatgttttccaaagtcaggacttgtatttaattgataaatcagcataaactttgaaaattttaacacttagaatttagaataggattgcctatgacattgcaagaacatattatcatctttctaatgctcagataataattctcttattattcttactaacaaccttttcattcttccaatcacacaggttttgaagcctgtattagttcgttcttgcactgctgtaaagacatacctgagactgggaaatttataaagaaaagaagcttaattggcttatggtttcacaggtcgtacaggtagcatggctggggaggcctcaggaaactttcaataatggcggaaggcaaagggaaagcagcacacctttacatggctggagcaggagagagagagaagggggaggtgctacacacttttaacaaccaggtcttgtgagaactcacccactatcatgagaacagcaaggggaaaatctgcccccatgatccatttacctcccaccaggcccctcctccaacactggggattacaagtgaatatggatttgggtggggacacaaatccaaaccatatcaaagcctcatctatgattctatcccactgcctcttcccttgccatattaccagggatcacatcctttctattctgcattcaaccaacatttactattgtagaaactgaggccccaggatgttattatgatatagtatttaggaagagatagtatcatgtttgaggattcttctccattctgaccagtgaggtctggtctccatatctctaatccagactgctcatcttcttcatctgtctactctggtctattccacatgtcattaccaaagtatcaccctaaagcgcatttatggtcatagtcaaacaccatgaaaggactcctcccatttactaaataaatccatgtgtgtaagcatagaattcaaagacttccatgacctggtctcagtatacctctgcaattcttattctatctttttcataatatatctttatcctttgtgcaacctgacaacttgacattgcctatactttcccatctctaagatactattcccttcacatgaaatgctcttctacttcatattgagctgtcaaaatgctaccaagactttagggtaagctcagagccttatttgaattcccaattatattctcacatttccttggaactttttgttacacttttgtgtatctctcactgcaatgaataacttctgtttttaattgtacttacatgcgcccctgttatattctattatctggcacctcaaagagaattaaagtcctgagtattttaatgttccattcactcacactacgtatatagctataagtttcttcatcaacttttcaacaggatttcttttccttcaaattagtcctaccaagtcttgggttagattgccccctttcctcgcctttctttgtgtatttgtaatatattgcacattgaaacagaaaatgagcacagctgagaaatcattctataagaaatgctgcttatccactctcagtgtctgaagaatacatctttaaaaagaaaacagaaataatatgtaatagcatactgaaatgcatgggatacatttcagatgggaactgggcaacaaacaaatgcttgcatagagtttaaactgaaaaatcgtaactgcaaatgagaaataggtcatgatcagtatcaataacagaatttcatatgtacatttttattttttttttgagacggagtcttgctctgtcaccaggctggagtgcagtggcacgatctcggctcactgcaacatctgcctcctgggttcaagcgattttcgtgcctcagcctcccgaatagctgggattacaggcatgcgccaccatacccagctaatttttgtatttttagtagagatggggtttcaccatgttggccaggatagtctcgatttcctgacctcatgatctgcccacctgcagtgctgggattgggattacaggcgtgagccaccgtgctcggcccatatatacattttaagactgcactaagaaagttcagaaaacttcagcctacataagatagtatatctagacagacaggtaagtgttggaagacactgatcatggcctgagtcttaaaggagattggcagagatcccaggacacctcagctttaccctgcctgcttactacctccctcatgtgcacaaaccgaagcgtgtcaaaactttcactatttcaaatattaatttaagtataattatgtacatcaattacaaaaaattgatagccatcactgagagtaggttttagggtaattttcactctccacttttcagggcatcagagaaagtgataactaggaataacttagggaaatctctgacctggtactcatcaagattttcttctcctgtctttgaatatgtgtgatgtgcgggtcccattctgtgcctctcatcagtctacaattcacattaatttgtagcaaatcttgtgtgagcgcagagaattcacacatcttctctgtgtttaacataagtcagaatcaaaagaagcttctcattaatctacggctcataagagttggttctatgcctgtttacttatgcaaaaatccatgaaaatacaggaaatgattcctttgacccaaaaagtagtgtgtgtgtgtgaggggatggggagattacatgattagaagagcttcatatattaagattttgttgaaaaacaacttttattccagatgccacctgggaaaatatccctcatgtgactaaaagtcctttatcctatggctagagcctgtgactcgtgagtaaatgagtaaatccaggggatgcagctgtggattaaattatctgtttgctacctcttggtcttttgctgtttgttccagcaggataacctaggaggatgtgtaactaactgttctatgtgttgatacagccccttcaagtatccatgcctacgtgagaaaatcctttcctttgcaactgctaaatgcaactgcaacttttggatgggagtgatacatgtggacagcaaagatgaaaagaacttcaccaaatagtgtttctcattactttgaaaaatgtcggccatgtacagcatgcaagaagaaacagtgaagaatgttaacatgctcagcatgggaaaccgagtcatagctttacatcttcacttgattatttccaacattattttacacccttctgatcaaagacttcaattatctcaatttttcagagcatttttggcactggaacatcattagacaagttcttggaacagtactttgccctattattagtttgacctactaactttcttatattaagctcctcacaaatggactatagaataagaaaataaaggttttctaccaatcctagttaattgctgttattagttaactgtgtgcttccttaagtatgttttaaggagtcataaacagaacctctgtattaaatatatttttacatttcaactgattcttggcatttatgtcattcatgttgtttttctcgacatttataccatttaatcagtcagaaaaaaagtagtgggtggttaataagttatttacaggaaaagtgaggcatataagaattaatgaaagacacttaactgacatcaccaaagagaacctgacaaaacttaaacactcaaatagttttaatagtcatcaacttcatacaatgttatactttatcattcaataaatgtaatgaattttgtactttttaatgtttaaaactttctagtggaaactaaccaagaaatttgaggccatatttcatcttgtgctacttatttttaaaaatatattttgtgcaataaatctgaccacttcagtagcagttggctaaaaagaccacagaatttgtcatccaaaccggacactattgagagtctaagaggataccattaatattatgttgggataaccagtgtaaaatcaaattttcccaggaaagctacaacttatggacatcctaaagttacgccaactaagcagacgtagagaaagatcagatttgttctcctctttgaagatatttttcgtctttttctctccccctttgagttcttatagaggaaaaagccataagaaaagaaagaaatagaataaggtttagagactaagtacagtcataatgagattttagtcaatgacagaccacatcacatatacaactgtggtcgcctatgatgataatggacctaaaaaattccctggcctagtgatgtcatggttgtcagaatatcatggtgtgtcatattactcacgtgtttgtggtgatgctggtataaacaaacctactgtgctgccagtcacataaaattgtagcacatataattttgtacagtatgtaatacttgataatgataataaaccattatgttactggtttatacatttactatactacacttattattttagagtgtaatccttctacttattaaaaaaaaactaacagtgaaagagcctcaggcaggtccttcaggaggtatccagaagaaggcattgttatcataggagatgacagctccattatgtattattgtctctgaagaccatccagtgggacaagatgcagctctggaagacaatgatattgatgatcctgactctatgtaggcttaggcaaatgtatgtgtttgtgtctttgtttttaacaaaaacgtttaaaaagtaaaaaaatgaaaattaaaaaaatttcaaatgggtaaaagctcatagtataaggctatgaagaaagaacacatatttgaacagctgaacaatatatgctaaacgttattacaaaaaagtcaaaaagaaatttaaaagtttataaagtaaaatagttagagcaagcttagcttattattaaagaaaaattatttgtttataaatttagtggtggcctaagtgtatagcgtttataaagcctgccatagtgtatggtaatgttctaggccttcacattcactcaccactcactcactcactgactcgcccagaacaacacccagttctgcaagctccattcatggtaagtgccccatacatgtgcaccattttttatcttgtacaccatgtttttactgtaccttttctatgtttggatatgtttagatagtacaaacgtcattgtgttacaaatgtccacagtattcagtacatttacatgatatagatttgtaacctaggaacagtatgctataccatatagcctaggtgtgtagtaggtgatatcatttaagtttgtgtaagtatggcctatgatgtttgcacaactacgaaatcacctaaagatgcatttctcagaacacattgccattgataagtgaagcatgactgtaatttagattcaaatttgggctcttccagatagtacctgagtgatatttctcatgttatctctgttttcatttccattttgaatgacagtgtcttgtccatattgccatgtattgaaatcatttaatataccaaactctaatactgttgagcagagctgtacaatacattagccattagctacatgtggcttttttttgaacctgtggctttttctatgtaaatttggaataactagtattaaaaaaacataaaattcaattgctcagtcactctagctacatttaagtgttgaatagccacatgtagctactggtgactacagtagaatacagattagatttccatcattgcaaaatgttcttttggacaacacttggagggtcaaaatcattatttcttgcttagacactttcaaatcttcctaaaatgtcaatgtatattcactttggcattcctgaacctgttctccattcagcagccagagcaattctctccaaaggcaaactttgccaatttacttacctatttaaaaccatttaatggtgccctgtggctccagccctccctgtatggtctccctgcttctttcatcccaacgttattaaactatgcttgctcctgctttctgtttccagccaccttgatcttgttattccccttgcatttgcttccttcctccatgggtccttcgactgtatcgttttcactgccttgattgctctttctgttattcatcacatatgtcctcctacagatcagctcaagtgtcacttcccaggggaatctccccaagcttctctgaaagattaaatcttccatgataactctaaaacaccatataatttcccttcaaatggcaaacacgtttttatttgtttatcttcctcaaaatctgtctttgtggcaggcaaatagtgataataaatgagtgaatgtttgtttttcattacatttgaatttctaccacagtggcttctgcagaattggcattcatggaacaaaagaatgagtccaatccttgagtaggctctatcagcatcactatgaaaaactatagcacctgataacagaagctaactctgtcagaacactgggatcaatctccagaggtcatcgatctcaccccttgccccaatgactcatgttgcttctctttatttaagctagaatccattaatagaataattatatatgtaaatataaaatggaaatctgagttccagcttcaataattttaataattaatatatcaattattacctcacagtacttgctgtaggaaggttgtgagatgtccatcctttgagatttaaatatagttcagtccagaagaaaaagtccttttttttgtttttttattctgctaccaaaagaaatttttttgtttgtttggttttttcatgcgcgttcctgtgaagagaccagcaaacagggtttgtgtgagcaacaaggctgtttatttcacctgggtgcaggcgggctgagtccgaaaagagagtcagccaagggagataggggtggggccattttataagatttgggtaggtaaaggaaaattacagtcaaaggaggggcaggtgtgggggtcacaaggcgctcagtaggggagcttttgagccaggatgaaccaggagaaggaatttcacaagataatgtcatcagttaaggcaggaacaggccattttcacttcttttgtggtggaatgtcatcagttaaggcaggaactggccatctggatgtgtacgtgcaggtcacaggggatatgatggcttagcttgggctcagaggcctgacattcctgtcttcttatattaataagaaaaataaaacgaaatagtggtaaaatgttgtgacggcaaaaatttttgggggtggtatggagagataatgggccatgtttctcagggctgcttcaagcgggattatgggcagtgtggaaacttagagtgggagagattaagctgaaggaagattttgtggtaaggggtgatattgtggggttgttagaagaaacatttgtcatttagaattattggtgatggcctggatatggttttgtatgaattgaaaaactaaacggaataaaagaaggacaaaaacaggtattaaaggtctaagaattgggaagacctaggacatctatttagagagtgcctaaggagattcagcacagtcctgccagcaaagattatttatttactttaagagttaagagtggcagtttggggatagcaccaggagatatcagctgtgatggcttggagaaacagtgtaaactggcagtgtaaacaagagcagggcatgtgtaagtagttgagaacaatgaataggagtatgactagacagaagatagtagggatgacaagttttttggggcacagtccaagttggtctggagtctggaatgagactggggcctaataaaaagtagtgtctatacaggagctcaaatgggctgtaccctgtagctttccgaggacaggcctgaattctgagaagggaaagtggtaaaagtattgtccagtcttttttaagttggtggctgagcttggtgaggtgtgtttgtaaaagaccattagtctgttctacctttcctgaagactgaggaccgtaagggatataaaggtttcactgaatactaagagcctgaaaaaatacttggctgatttgactaataaaggctggtctgctatcggactgtatagaggtgggaagtctaaaccgaggaattatgtctgacagaagggaagaaatgacagcagtggccttctcagaccctataggaaaggcctctacctatccagtgaaagtgtctacctagactaagaggtattttagttttctgactcggggcatgtgaataaagtcaatttgccagtcctgggcaggggcaaatccccgagcaggtgggagtgaccaatgtgaaggagaaaaattggccatgagggacagaagttggaaagctagctgcttgttgagggacagaagttggaaagctagctgcttgtctagccaccttatcagcataagcgttgcctagagcaatgggatctgatgccttttgatggcctttgcagtgaatgactccagcttcctttggaagtaaagcagccttgagcagagtttttattaagaggcattaatgatgaaggacccttgcatagtgaggaaacttctttctgcctatgtaacagcatggtggtgcagaatatggaaggcatatttagagtcagtataaatattgacacgtagtcgttttgcaagagtgagggcccgggttaagtcaactagttcggcttgctgagaggtagtggagaggggcagagcggtagcctcaatgatagatgtggaagatactatagcatagcctgcctttgctggtgagtggcgattaggcctggtgtaactgccatcaataaaccaaatgtgatcagagtgaggaacaggaaataaggaaatatggggaaatggggtgaatgtcaggtggatcagagagatacagtcatgagggtcagatgtggtatccagaataatgtgggaggccggattgaagcccgtgccaggaacaatggtaattgtgggagactcgacagagagtgagtatagctgaaggagccgggaagcagaaagtatatgcatcaggtatgaggaagaaaatagattttggaagttataagaactgtagagagtgacttgagcatagtttgtgatttttagggactctaaaagtattaaagcagcagcagccactgcacacagacatgagggctaggctaaaacagtaaggtcaagttgtttggacagaaaggctacagggtgttgtcctggctcttatgtaacaattctgaccgcactaaccatgcctaggaaggaaaggagttgttgttttgtagaagggattgaggtttgggagatcagtcgaacacgatcagcagggagagcacgtgtgtttttatgagaattatcccgagataggtaacagatgaggatgaaatttgggcttgactgaagtagtgggggctatctgtgaagccttgtggtagtacagcccaggtgatttgctgagcctgatgggtgtcagggtcagtccaagtgaaagtgaagagaggctgggatgaagggtgcaaaggaatagtaacgaaagaatgtttgagatccagaacagaataatgggttgtggagggaggtattgaggataggagtgtatatgggtttggcaccatggggtggataggcaaaacaatttggttgacaaggcgcagatcctgaactaacttgtaaggcttgtctggttttaggacaggtaaaatgggggaattgtaaggagagcttataggctctaaaaggccatgctgtagcaggcgagtgataacaggctttaatctttttaaagcgagctgtgggatgggatattggccttgagcggggtaagggtgattaggttttaatgagatggtaaggggtgcatgatcgtttgccaaggagggagtagaggtatcctatacttgtgggttaaggtggggggatacaagaggatgacgcaaaggaggctttggattgggaagaagggcggcaatgagatatagctgtagcccaggaatagtcagggcagcagataatttagttaaagtgtctcggcctaataagggaactgggcaggtggggatgactaaaaaggagggcttaaaaaagtattgtctaagttggcaccagagttggggagttttaagaggtttagaagcctggccatcaatacccacaacagttatggaggcaagggaaacaggcccttgaaaagaaagtaatgtgtagtgggtagcctccgtattgattaagaaggggacaggacttaccctccactgtgagagttactcgaagctcggcatccgtgatggtctagggggcttccaaggcgattgggcagtgtcagtcttcagctgctaagccgagaagatctgggaaggagtcagtcagagaggcttgggccagagttccaggggctctgggagtggctgccagatgagttgaacagtccgattttcagtggggtcctgcacagatgggacgcagcttaggacgaatcccgggctgcgggcattccttggcctcatggccagatttctggcacttgtagcaagcccctgggggaggcaggcctggaggaatgcctggccactgcgatttaggcgtttggaagttcttgtgtgctggagatgtgggtggggtttgtctcacagtggaggcaaggaagtgcaactcagaaatatgttgctattggctgtctctactctattattgtacaccttgaaggcaaggttaattaagtcctgttgtggggtttgagggatggaacttaatttttggagttttatttaatgtcgggaatggattgggtaataaaatgaatattgagaataagacagccttttgaccttttagggtctagggctgtaaagcatctcagggtgctgccaaacaagccatgaactgggctgggtttttatatttaatgaaaaagagcctaaacgctatgtgatttgggataaagaaaaaggagcattaaccttgactatgcctttagctccagccacctttttaagaggaaattgctgggcaggtgggggagggctagtcacagaaggaaagtgtaagcctgaccaggtgtgaggaggagaggtgataaaaggattatagggtggaggaacggaggctgaggaagaattgggacctagcttggcctggtgaggaggggagaggtcagatgggtctgtagagaaggaagattagaaagactcagtgacgcttggggttggtactgaggggacaggggggagggaaagaaggaagatttgagatgagttgcactgggaacagagactagagagggactgatgtgtaaaagaatgcctggacgtcaggcacctcagaccgtttgcccattttacaacaagaattatttagattttgtagaatggaaaaattcaaagtgccattttctggctgtttggaactactgtcaagtttgtattggggtcaaatggcattgcagaaaataagacacttagattttaggtcaggcgagagttgaagaggttttaagttcttaagaacagaggctaagggagaagaaggaggaatggagggtggaaggttgcccatagtgaaggaggcaagtttaaagagaagggtagggacacggagaaggggggtggggagcagccctgggctgcaacgtaggtgagcagccaaagcaggagtccctgcaattgacttgccaccaagggaacgtgggtgaatgatcaaaggcaggcgtccccgcagagatcagacaccaatggaacgtgggtgaataatcagagaggcacccccgcaattattaaacaccaagggaaggctgcctccccgagtccgtgactggcgccggagttttgggtccacggataaaatgtgtctcctttgtctctaccagaaaatgaaaggaattgaaattaagagaagggagagattgaagtgtggcgccaagatagaaaggagaaagaggttgagggatagtgagggaggttggagaagagagtaaaaagaggccacttaccagatttgaaattggtgagatgttccttgggctggtcagtctgaggacctgaggtcctaggtagatctttctcacggagcaaagagcaggaggactggggattgatctcccaagggaggtaccccgatccgagtcatggcaccaaatttcatgcgcgtttgtgtgaagagaccaccaaacaggctttgtgtgagcaacaaggctgtttatttcacctgggtgcaggcgggctgagtccgaaaagagagtcagcc

SEQ ID NO: 393 - DNA, 4844 bp, Homo sapiens
gcagaccacgttagaacctcggctcctggagtagcagaacctcggcttcaatgggaccctcatttcataaatgaagaaactgagattcaaagaggggaactaccgaaggttacagagcgagttcgtgggtaagcatggtaagaaccctggtctcccggggatcccacagcgattgacggtttatagttcaaaagagccaggaaagcttcccttctgcatttattccagtaaattcgccaacccttctcgaagggagttcttgctagcccctaactaaaatttcccccacctccaccctgcagcatcttaaagctcatgttttagttgattcctggccaggctcctagcccaagactagcccctccctactgctagacgactgtcccattgacctttatgacccacagatgaccccactgggcctggctcacactctgcttgttgtggctgtggggccagagggtcagtgtgggaggcctgagctgccctgggggaaaggagggaacaaagggggccctcagttccgagcacctgggtagagaggctgggcggtgaagtgggtggggaagggaaggagggcagctgcctgcaggaatgggtataaaggacaaggaggaccatggagactttaacgctgggcctggatggaggaggagaccagtgctgcaaagtcacaattcccttcccagtccatctccctccctctgagcccagacgcctcttccctgccccctgcctcccaacattggggccattcacagggcccctcaccagctgccctcacttcacccagctccctcccctggaaagggcccaagaggaggacccagctgcagccccagatgtggatggggatctctgggggaggggaggaaggggagtctgactccaggcctcttacattaccctcagatgatgaaaccatgtcagagattttggcaagggtgtggactggggtctgaggatgcatctgttggtaccatcttcctccccttccctcctccactcacacccccctccccgccaataactgcttcatgcagtagctcagatccctgtttggcttgacctattaaggtcaaatcaaaaccaaagataatttcaagggcaaatttcaagggccaatcaacacatccttttcatccccatggcaaacaggaggagcaccgccagcagtgcccccatgatgggggctggagaagaggtcttggtggtatcctggaccttttattagcatttgaatctagaggaagctctccctggggccaggggatcacctctcctggaccaggaggttagcagaatgttgcagtcatatcctgcaacattcctccccatcttccaaccaaaataattcgtggggaggagactaacacatatggaccacctacacaaggtattttatgcacatattctcattttttccctataaccttgtaagctaggcttttttattctttttaaattttgcagatggggaaactgagcctcacatgtatgaattccagcatataagcaacagactccagatttggacatgtatatcttattccaggcttcccagatgaccaccaaggtggaagggatgatgatgtccaggcagaagggagctaggccggcccaggcttttcctctaggcacagcggactccaggttcagccttcccggatggtaatgttgcattctgaagagctactttcccgccaactcatctctggacttctctggggcccaactctggtttcctgcctgcaggaggtcccctctgacttccgacagtagatgacccttctgactcacagttctactgctgggaaatgcctccagagctgctgcccaccctctctgcatccctccaggtcactgggtgttgagtcaggggaagcagggatacacacgggcgggaaactcaggtctcctaaatgtcagagcctcaggacttcggctactcagaagtagctccctcctgggccaccagggagcagcagggcagccagcatccagacatcccccctgggttctgctgctcagaggctagatggagaaccaaggtgggaaaaaggcttaaaccacagcgtggggagatttaggttagatgggtcagaggaagtttaggacaagccttgcccttttcagtttctgtccagcttcagcacagccactgcttcctctctttggtttttacccatccccctctctcccatcacctctatccccttccagctttcctttccttccctccttcccaaaccccagagtttctcaggattagctgcccgtgtgcctatctcccccacccccatgctttcctcactgtctcacagaaacaggcaaacacacacacatgcatacaaccatgagctggccctgagagttctctgactggactggggttggagccccagctcttgtcctgagctgaggcccttcccccaggtatcttggggcttccatcatttctcttgacaggagctgtgggcgtctgggcagatgggaacctgggggaggtgtggggagccctctctgaggcaggaagctcccacgctactgtagttaaaataatccggcagcaacttggggcagccatctgggatgcccagatcttccaggacacccagctctcaacaacaaccctataggaacaaatcaaaaacctaagagatacttataggccctggaaatgtctcccaaaagtggcctgaacttgagccctgtttccttttatcttcttcaggttagcactgggcattggcatttgcaaaaaaactctaagcattaagcaaaacttgtaggagtggaagatacagcgttctggacctccagtcctaatacccagccacaccccagcagctatgcatggttccatgggagagcaggcatagcccatcctgctggcatatagtccagccatatcttccaatgcccacctggagactaagccgagttctgcccagcaacaggagctcagagctccagagagcctctcctggggtgcagactcaggagatcttagctcaggagcagacttagcctgacttcctcttttataggaggagacagacttagttacagaggaaaccagagttgttataaatagcaaggaagggagaaacctgctatggattacaaacacgccatcaatcttaaaacaaactatttttagtttcaaataataacgagagtctaattaatgctctgtataacttcaaatgtgggatctttatctgcctttctactttgtgatgctttctaatacagtattagggccaaaggcaggaagagatgtgggcaattctcaatgttaccaaatcctagatatggaaagaacctgagaaatttagtccagccctttcattttcagtgaagaaactcaggcccagagaggtaaaaggacttgtccaaagttgcatagtaaggtagggactgagcagtgactaaaagcctagtccctgtactccagaagcaggacagtttccacagcagcacaatagaacccaaaggctaaacatctgtggttgggcagttggtgagtttatagcctggataaaagtcaggtctaagccaggtgtggaggctcacgcctgtaatcccagcactttgggaggctaaggcaggtgaatcacttgaggccaggagtttgagaccaacctggccaacatggcaaaacctcatctctactaaaaagtacaaaaattagccagatgtgacggcacatgcctgtaatcccagctactcaggaggctgaggcacgagaatcggttgaacccgggaggtggagatttcagtgagccgagatcgcactactgcacttcaacctgggggacaaagcaagactctgtctcaaaaaaaaaaaaaaaaaaaaaaaaattctgaatgaaatagcaaaagacagcccagaagctgaagtgtggtcttctgagtcaccgagttttgggttcacatcccagctctgcaactgactagctttgtaaccctgggcctgtgtgtaactactccaagcatcagctcccacatctcaaaatgagaataatcacactcacttcattacaggactattatgaggtttaaatgaggtaacgtgggtcaagcatccagcacagtgctcagcaaaaaatagatgttaatttccttcccatttccctcggattctctaccccttcttcaatggattcttatcctctaactggacagaagggcagatttgtcataaagcagtcacgtgagggataagaagtctcacatgagtgtgaatgaggctgggggtgggggcgtagtttatggcaatgaagtttgcatggcacaagtggtcagtgtcagatccagagggcgggagaagacagatttgcagaaaattatccatcctctgctaaccactcagtgacgggcctcggggttcagggtcagtgtttacaggggaggagggaggctgggcatgctgggtcctcattgtacacaaataccccgggcctcaacctcacccatgtgccacactgtgccaagggtgttacataacatttctcttttaatcctcacaacaatctatgaggcaaatactgttctcgtccccattttgcagaagaggaaatgagctcaaaggtcacttggctagtgtatagtcattagtgctgtctccaaatatttccggctctctgccttctggcacaaggtaggactgcatgttctcactctttgatgctagctgtggacatgtgaccaactttaaccaataaaacgtggcggaactgatgtgcgtcagctctagtggaagcattaagactctggcaccctcacacctatgttgttcatagagtgtaaatgagaaataaacttttattgttaaacca

SEQ ID NO: 394 - DNA, 348 bp, Homo sapiens
tcaaggtcactgattttagtagctatgcactatggctgccatcatgcgaggatcagtaatttttggcagatggttcttaaggctgaggaaagaggccaaggctagtgtatgaaaggtaaaaagataaaaacactcacatttgagttttgattaagtaactgaaaatccgtacatgctgtttttccacctctgctctgacctatcgagaactgagagcgacagcagaccagtgtgagaacaataccagcccttcttttgtacctcctgcctttgtcaagccaaatctgaaggaatgaaagtttcacacagattcgagttggaaatcccagcatgacaaatatctgtaat

SEQ ID NO: 395 - DNA, 560 bp, Homo sapiens
agtagcttttaaagctgggccttagtgggactctaaatgcaatgaaagcagtctgtgttgagagactgaaatgcatttcaaagccaggcctgattcggggtacaaggaagaacagacctatgtgcattttgtaggaagaaaactgtgaawggaaaaaggagaaggggagagaaacgggggaaatctggataatacattaaagtaaccrtaattttggagatgcattcatcttattgaaaatatgtacgtaascagtgataccgaagtcggatatttgctcaatcaggatgctcaacaatttgagcctttaaagtttggagctgcatgggtttgtggagaaagtcggctcgtgatatttcctcatggttgtgattcctcttcactcttttgaatttggaaggatggcatacacatctgaaaaataccactacttccttcattggactgcaaggtatttctgtttggaaaagtaatggagtccagtcaacttcattgatcgccaaggactgtcaaaattataaaacttgctgtggagctctgacatgccagaagccgctaga

SEQ ID NO: 396 - DNA, 5303 bp, Homo sapiens
ttgggaaaaaaagtctttattaggtaccatcattctcattcttgttattattgacatcctcgtcactgtgaatcagccagcccagcctccaacacacataccaccagcacaactcctcatgttgactcgtgggccctgaaaccacccacagagtagatgaggaaagggaggctccatctgtcctagggagaacgctttgcagctgcccccagaagactccattctaaggttggaatgggaggaggatattatgtaagttcaagaggaggaaagagaaaatgttttctctgtggaagcagcatagatggatggacttttggtggctaaatgccttcctctaaatgctagcattggatacggttatgcgggaaaatatatgtgtgcatatgggcacacccctcctccgaatatctctctggcaaaagctcctcatacattcacaaaagccgcccccctccctttggtaacagaagtaacttacaggagtttacctttgcctctgctagaaggtcaatctcttttccgcttaagaggagatctgggctgtttctggcaggggaaagaagagtatcaccaatttttcctttgacacatttctaaatctggaagtatctggtagagttacctcaagaatcatataagcttgcatcacgatggggactgtgatggcagtggtgcatatgagcccatcaggtccttcttcgcgtattcagtcagcaaactgcctcaaccgtgtcctactttttcttaagcatataattcccctttcatttaagccagactgtagctagaggggctcaaataggtaagagagaagatactaaagagttaaatgcactcaaaggggagaactattcagatttcttataaaattactggtggcataaataggccccaaatacagaagggaagggctgaccttcactcggacacctcatttgagcacagaaggggcctggcaattacacatggggccaagtggtctattcatctctttgccattttcagccattaaagccctacataaacatacatttcataatgagacccacccggtggacacaggcaaatgcccacacccatgcgcacagacctaatagacccagaacactcccacacacattaaagctttctggaacaagagtttacataagtaatgaagtaaaaaatatgcccctcccatcatagattatctgcagcagaaacctggcaggcgtcagccatggtacctgtggtttaagctctcagcttaaagcatctgaaaggggcattacgtgggaaggcatctggaggttttacaggagggcagcacatcagcgaagggtacagcaacctctgaaggaattacggggaagcagttactaaaaagaggctcgtcaatgtggacgtttgtggggcaaggggtttagtaatcggaggcttaaaccatgcctaagagaagcatccagcggccttcacagtgagcagaaggggcagagcaaggcgcttcacaccccaataaggcccagcactgactgctttcttcttcccaaacctgtccagaaagggcggaggggacaccaggactcagaaagctactggtttcgggggaggtatattttgaaggcaacggcaaatagacaagggcttgtgaaggctcaggggtgagagaagctgttctccctttctgtcctgcagccaagcttgccttctgggactccagaggcagcccagcacctgcagtctgcaggatgtgcactgcagctttctctctgcgggggcaagcaggttgtgccacattctgcagacccagagaaggttctggaagtatctaggtgaggtgcaacacacttaacctctgcctgactctaaacactgctttaggagggcaaatgaagagcctaagagttaataattacacaaggattgcacacagtaggtacttaataaatatttggggaaactgaggccggggaggggccctgatccaaggcatcactgaatactaatttatttagcaggctagactgaggctttggagaggaaagaagtcctcagtaagcttcagtggagactcttagggcttgattattgtgtcaggaatcaaattaatctcctaagcatcccttatggccttggccttgcaaagccaggcctctgccatgctcgggggaagggatgcagcaggcttcctgggcagaaggatccagctcttggcctcctttctctgctcctccctctactgcagggacctgcccctcctccatttcctccacctggaaattaatgagcttaggtcttgccccatccgctgcagcttggtggttaatacagagctggaaatgggatgagactgtggcagcgcagtacgaggggggtctctaggaccagctgctgctcagggtctagtgatgggaggaaggcctgatttgggaagcaggttcttcaggatgaaaagcttaaccctttccattccctgacagcctctttcaaaacagtctttcctcagacccccagttgcacacattctgtttttccttctgttcacatttttaaaggaacacatgtctcccttgggtccatgtaggttattgtgcctctcccttcctctgcagctcctggatctctgcctgaaactgcaataacagctacagggagggcgtgaggtgctccttagagccatgaccacgctttcaactccgatagagcttgtgaacccgctgggagctggctccttcttgtccacatagcccaacgacttccttaagcttgtcaggtgctctcagctctacagcaaagtgtgacaaacagctccccctctcccttcctaccgcctgccctcctccccaaacctcaagcagaacacaatatatccgcagtccaggccctgaggcagtctgccagtctctggatgccaaattattatttttttaagggcaaaccaaaaaactcagctcagaacaaaaacacagtcacggaggaaggtgttgacccacatacaatgagtcctgagcccagagaaaaatctgcacacacaagcactccgcaatgcgctcccaggcgaccccctccccacgcacaccgcatctgtgctgcacagatctgcttctgtcacagaatcagcttctgtttctctccctgagtctgtttgcatctctaagcccctgtctgtcacaggctgcacacctccccaccccacgggctccggtgcgggacaggcagccggagggagctccagacccctcccctcgcgcccgcggccgctgcgcggaggtctgcggagggcgcctggctcggtcggtcgctccttccttggcgggccctcgccgacccacggtgctcagccagccccattcttggcattcaccgcgtgccttaattgtatggacatttaaatcaaggtccgctgtgaacacggagagagaggcctttctcctgaggaaggaaaggaggaaggaaggaaggaaaggtgaaagaaaggaagaggggtgggtagaagatggaataagaaaaccaggaaaaagaaataaaaagcggcgcgtgtgcgtgcgcactgacagcggggagagggatgggggtggggaacgccggaggaagggaccacagcatcctccccgccgcagctcccccaatcacacagacaatgagataacagcgacgtcttccaaaggctctttgttctcccccatcctttcgcatccaggctttttcctgcaaagcggagggggtggagggatgggggtgtgggtggaagtgggagacggaggggtgcctcccccgtgttaattaccccggctcccctcgcccctttccccgcgcctcgcctcccctgcagctccagacaatgaaaaaacaacatcgaccccacctcgccccagcgcagcaacccacccacccatgtcgccctctgcttcgcccaggaaactgaaggggactaggaggaggaagaagagagcgaaggacaaggagagcagcggggactcggcagcggcagccggggcagggcgcgcggccgccgcctctttacctccatcgctgagtgggggcgcagccgggccgggcgtgccgcaggggcgagttgccgcggtccggggctgggacctggggattcagccttccggaactcgcctgctgcagtcctctcgctcaggtcccaagtggtggaggggggaaaggaagagagacgagagagagagagacagagagagagagagagagaggaagaagaagaagaagaagaaaaaaaaaccataagagcgaggcccatctggcccctcatcagctttgtcaagtcttgcatacgctaaaatgctaatgacctagatagctcatgcaaaatgcagcagggagggcgggagcgagggaggtgggagggaggaagagagaggagtgcaggggggagggagggaggagaggcggagggagggagagagggagagagcacccctacactctccccaccccacccccaactgtcagcgggctttaccaggtaaagggtggacgtagatttaaaaggtcactcgtgtataatgcggctggatccccgggtcaaaaaaagggggcgagacagaggatgagagtccctaaagccaaaaggacaataagacatcattttaagcccccacccccatgccctcctccacctctccacactgtttacacacaaatcctgtcgccgcctcatgcatgtgcacggacatgtcaatttctcatcaatttctcagcgctcctatcgacagacacccgaattctcattcccagcaaaactcatccactggacccgagggaggagaagaccccttctcctcctcagtgctcttcgggctggcccatccctactcacctccatctccactctctactcccttagccctccaggcagcagagggctccttctcttttctaagccttgagtcccctgtcccctttccaacccccgcatcttgagaaggagacgcagagtagcaggaaagccaagtcaagtccacctaggtctcccacaattcagctacccctcccagaaaaaaaaagagaccccaacaaccccgacccctctcctacgtagacactgtgaaagcaagccacagggacaaataaaagacaatccgaataccctcagcgttccgcacgccgggcggacgcccttccgcagcggccacgcgtgttctgggttcagcgctcctgcgcgtcccttctcgccgaacccaaggtgctttgtcccggcggccacacaaggtcttcggctttttgttctccttttttaagagactggccgcagtccccagcgattcagccggcccaaccaaaggcagtggatctac

SEQ ID NO: 397 - DNA, 10092 bp, Homo sapiens
agccagccaatgtgttaacctgtctctgtcaacctaagaatgttggccttactgacacacctttgctccatgttcaagaccagaagtagctgggatttgtttgcaaattgggtaattagtttaaaaatctgtgattacatttttaaatgaaattttcaaagtggcctagattgaggtgattcagataggtttgcgaatataccattttatattgttgagaaagaacaaaaagggaatttccagatgtcctagaaatcctagcaacagatttctctggttgtcagtttccctggagaaggcgccagataggaatctccaatcagttgtttttctcttcgcttcaggcccttacacaaaagccatgaagagatgttcacctacccggtattttaaatgttctgtaaattattagccaaatagaactgtaatggggttgtatttatgggcgcctagaaagaaaacacaaggacttggtaggccaggaagaaaagattttaaaatttagaatgaatagcccttctgggttttctttttgacaattcttggacttgaggtaaaacaaggaggattgtggccggatttcagatcccaaagccagcctccatcttaggcctttgcctcattgtgccttttaggttttcttacccaccgtctcctgttttgtcttttttttcttttctcctacccctatcttgggacattcagaaactgcctgggtggtttgagaagagacaacccagtttgatctgcaatacaaggatccattcgtaatctctctctcactgatgttattcccccatctgccgtcttggttcatctcaccacagaagggcatttagtcctacccagccatcggctgcgtatgacagcaggatggcacttcccatttctctgtggttagtgctcgagtgaaaacctctttcagctgagtcctctgaggttctgctgttgagtcctgggtggctgatggaatgattgaggaggtctggtcaccctcaagcgccgtcatcgccttgtttccatgggcttctgtcacacaaaatgaagaacagaaatgttaggacttaagagaatgtttggaattcacacctctttgcagtcctttcaaggctgctgctctgtgctgtgtcccatgcatgtgaaagtagagctgtgatggctgctgggacgcttgcaaagatcatgtgtgagaattgagcacaagaccacaaattattactgcttgatgcgcttgttaaaactctatctgccaggaaaccaaattttcttttcttttctttttttttttgagacagggcctcactctgttgcccaggctggagtgcagtggcgcgatctcagctcactgcagcctccacctactgggctcaagtgatcctcccacctcagcctcccgagtagccgggaccacaggcgtgtatgactggctacgcctggctaatttttgtatttttaatagagacgagtttcaccatgttgcccaggatggtctggaactcctgggctcaagtgatctgcccacttccgcctcccaaagtgttgggattatggccattagccactgtacctggcacaatttttttttgtaccctcctttatgccaagaatcagtcctaatttctttactatgtgaagtaacttttaaaggtaatagaaaaggccaggcacagtggctcatgcctgtaatcccaggcgccgtggctcacgcctgtaatcccagcactttgagaggctgaggcgggtggatcacttaaggtcaggagttagagaccagcctgaccaacatggtgaaacactgtctctactaaaaatacaaaattagctgggtttggtggcgcacgcctgtaatcccagctacctgagaggttgaggcaggagaatcgcttgaacctgggaggcagaggttgcagtgagccgagatggtgccattgcactccgacctgggcaacagagcgaaacactgtctcaaaaaaaaaaaaaaaagtaacagaaaaaagagtgaaatatattagctatcttttattctgagccaaaacttgacagatgtgggaaatcttcatatagtgtatgaaaatttcattgtacagggaaattattttcctctgtgtcttttcttttactataaagtgattcagaattttactgttactataaaattatgcaaagtattgtgacaaaactgcatcaatttgttgactattaaagtgctccttgaacattatatttcctgggtcttttctgtgtgtggagtcagcaaactgttttttgctacctggactttgtcttcttttacagctctggattcttaaaagtaccacataggtagcaaacctgtgaagggtatgagattttaccctacttgcaggctaataaagtgagcacaccacatgggttcatggatcctggcagaagttatgagactcataggtcagagacaaaggacagtttattatagcaatagcagtggccagattatcagcatttacactggttccctgagccccaggccccaagaagagggccaggtgagacctgcacacgcagtgggctgcattacaagaggaacccccatgcttaggggaccctggtatttgataatgggcagtaagcctgcctgacttttgctccagagacagacactatctctgtcatccaagactgttcactagataaacatccttgaaaatataagtctggaacctggcaattggtgtctattcttaccagatgtataaaaatgtgagaggccttggagaatcatatcccaagaatcagcagtttcttttactggacctttaagattgagacttgtaaggtcctgatgcagtgacttgtaaggtcactttgtctctcttgtgaatgttactgttttttctcttctgaggttatgaccaaagaatcctcaaggcgagtgatccttcaggtttgagacagccacatgcaggaagacaggacttgtagagtgttggggccaagtgtgtggttagaatccttggggtggggaaagagtttgttctagactccagtgtagtccttgtggctaccaggtctgacgtgccaaggacacgggaaagctgggagtgaggatactcatagtcatagcaccttacaccagaataaaagttttttttttctttttaagtgatgagagaatggctagtctgattttgccaacatgggctgctatttgcttaagaccttgatggtataaggagtgaagatgcaatcagggtaaaaggcggtctggagttgtggtgtgctggcaaaccagccctctggggcaaaaaattaaaaagccttgatatggagtgtttgctgatacctatgatgtaaatattcccgccatggccactttccagctaccagcaaggcatcctggcaccagggattgggaggagatggcatagtcctaagagtcagccttgggcattgggccatgtgggactgggcagtggggtatctggtctggttctaagtgctgtgatgaagcagtagcagctgtaatagctggcatttcccgtgtgctcatcacatagcagatgttattccaaggactgtatgttctttatcatccctcatttgatagacaagacaactgagacacaaaagggtgaaataaacagtaagtactccatcccaggccatctcatccagagggtgctgtcttgaccactctactactctggttgatgggaggcagtaaattgtccatcagtatacttcttcatcaaagctacatagtcaaaaagccacaggaggctgtgaggagaagctcactgctgctctgttgaagtctgtattggtttcctatggccactcttaacaaattaccacaacctcagtggcttaaaacaacacaaatatatcattctgtcatcctggacacgagccaaaggttgtcggcagaagcgaattgcttccagaggtgctatagggtgctgcccattccttgccccttttccgcttctagaggctgcccattttccttggcttgtggctgcatcattctggctgcttctattgtcacacctcctctctgaccctccctgcctccttgtaaggacacttgggattacgcccatccagataatctagaataatctcccattttgtgattcttaataacatctgcaaagcctcttttaccttgcagaataagatattcacaggttctggtgaggaggacagggacatctctgaaggggagggaagcaggagatagggtctggaggcatggaattggcttcctaaggccaattcaggctgacttcctagaactaagtcaaaaggaaaaccccaactttccacgctcaagtaacaaaaggaccagaggctactccctttgcaacctccccacccccagccccttttctgcatggcaggtgaaaaattgaaagtatcgctaattgatcccctcccacaaccaatcagactggtcttaggccaagtcttcatttgcctaggagtataactttgtaacttcagcctctgattgggcgttttacacaaccagtcagatgtttgtatagggtggtgtaactttgtaactttgcttcagcctctgattggtcccctcccacaaccaatcaaactgatcatggacctctgcttcatttacatagggtgtacaccaagtaaccaatgggaaacctctagagggtatttaaatcccagaaaattctgtaaccgggttcttgagctgcttgggctgctcccaccctgtggagcgtactttcgtttttcaataaatctcttttgttgcttcattctttacttgctttgtgcgttttgtccatttctttatcaagacgccaagaacctggacaccctccaccggtaacaggaggagcattagtcagcctaccacagactccaacgaacgttttttgagaggaaatgaaagaatattcctaagttattgggtgccttttcttcaggaatccctgaaagtgggggtttgcaattttccctggattgaaaacagaaatgcttcctacacaaacatgattgagaccttgtactctaggtgtaaaaaaacagagtaggtcatactctgtgggttatggtcagagagatctggttagaagttcccaggtaggcgacagccctagatgtgtgacacttctaggagaatctctggctatgtggatacgtccaggtgtgtaaggcagcctcagggactgccaccacttggtcacatacatgtccctccaactaatcctagctctcaaggacaggtggttctgggccctgtgttgcccatgagacttggtccacggcaagcctgtgacggagtgaaagtgaggggacacccaatttgaaaactcggcaggaagccagactccatgacatacaaatagatcaaagtgaatcggctccgttgtttggggaaatacctgaggtttgttgtttcgtgccaagaagattaacaacacggacacacgtgggtgggttaaggagcagaaagtttaacaggcagaaaaaagagaacagctcccccatgcagagggaggaggactccgaatggatctccccattcctggcgggaagcagactgatatatagaggagggggtttgaagaggtggtatttgatttacatagagcccaagggattggtttgaccaggtgtgccatttacatagccctcgaagaaactggccattccaccttgatcttttattatgcagatagggttttttacttggccagagccttgacacctgcacacatggcaacaaacagaagggaggcgaaatcttccatattggatgcacctgtcttccaggtgcagctgccggcatttatctgtgcaagcttctagcttgcttatttatgcttgcagcttgacttttcaggctgctttctgttggaaaagaaatggttttgggggctgctttttattaaaagaaaagccttaccaaggactcctgtaccctatctgcctaaattttttttaactactatattaaaaggtctgtaagtgggagctggccctaaaagtaggttgtagagattatttggatgtgccaacaagcttcatctgcagcttggactgtctccattggaaggcctctggcagattttgtaaaaagttatataacaattttactataggaaaaacttggctacagatatgaatttatattacccatcattggctggttccttatcctgaacattggtttccttggaatctgattttggcttgtttggcctttaaaaaccccagaagaatggggtttctgccagattattttctggttttcagtctcactgaatgtcacaaaggccttggtttatggttcccaactggtaaagaaacgtcaaactttgcctctcttagttccttctacatgacaatgggtggcagttgctcatatggaagcatttcttttccccctaaagcctatgagacaggctgcaacttaaacccctattttattaaaggagaggaaatgtccaagagcccagagatagtgggtaaaagcatcataaggactagaaatggggtcttcttgttgctaattagtaggggtgaggggtaagtggcagatgtgactgccgtccatgcccagacagggaattgtccttgaacctactcatgcggtgtcttctggggtacagtgagtccacagggcaggacggccttggagtcaagagcccagactcacattctatctcaggcttcataactcaattgctccatgaccttaagccaatttagttccctcatctgtaaaaatggggataacaactgaatttacctcatgggattgtgtaatgcccaaccttgtttttactaaccctgtttttagactctccctcttcctttaatcacctagccttgtttccacctgaattgactctcccttagctaagacagccagacagactccatcttggctctttcactggcaccccttcctcaaggacttaacttgtgcaagctgactcccagcacatccaagaatgcaattaactgataagatactgtggcaagctatatccgcaattcccaggaattcgtctgattgataacgcccaaagccccgggtctatcaccttgtaatagtcttaaagcccctgcacctggaactgtttactttcctgtaaccatttatccttttaactttttgcctactttatttctgtaaaattgttttaactagacccccccctcccctttctaaaccaaagtataaaagaaaatctagccctttcctcagggctgagaaaattttgagtgttagccgtctctcggtcgctggctaataaaggactcttaattcgtcttaaagtgtggcgtttttctaactcgctcaggtacaacaattgttgtaaggaatgattgaattcatccaagtaagggaattagagcagtttctggcatgaagtaattgctcaataaagtgtgtcaggttttaagattaattgatctttacatcatgataaatggcaacaaaataaatgacaaatggattaaagtaaatggtaaaaacaacataagaacaaaacattaaaaaatcatataatagaagaaaccaaatattagtaagtgtgaatatataaagtgaaaattactacaagttcaaatatatatatatatatatatatatatattttttttttttttttttttttgagacagagtttcactgtgtcacccaggctggagtgcagtgacgtgatctcagccaactgcagcctccacctcccaggttcaagcaattctcctgcctcagcctcctgagtggctgggactacaggcacacaccaccatgccttgctaatttttgtatttttaaatagagagagggtttcaccatgttggccaggcgggtctcgaactcctgacctcaagagatccacctgccttggcctcccaaagcactgggattacaggcatgagccaccgtgcccagccgttaaaaaaattttgaaaaggtaaatcataagctggaaaaaagattgcaacgtatttaagagttaatacccttaatatattaaaaaatcaaatttgtaagaaaaaattcaatacatcaagagaaaatatataaagtacatgtaaaaggaagttccatattccaattatgaaaattgcaaatcacggttaaatttataatagccagtgttggttagcatgcacgaaaacagagaaacaggtgctgttgatggaagtgtgttttggtttaattttttggagggcagtcagaaagtaacaaaagtcttaaaaatgtccataaaatggaccttacagatgtccacctggtcgttccacctctagaaatttgtaagacaaataattcggccgggcacagtggctcacatctaaccccagcactttgggaggctgaggtgggcggatcacgagatcagtagatcaagaccatccttgctaacacggtgaaaccccgtctctactaaaaaatacaaaaaattagtcgggcgtggtggcacacacctgtagtcccagttacttgggaggctgaagcaggagaattgcttgaacccgggaggcagagactgcagtaagccgagatcacgccactgcactccagcctgggtgacagagcgagactccgtctcaaaataataataattcaacacagggtctcattctgttgctcaggctggagtgcagtggcatggtaacagctcactgcagcctcaacctcctgggctgaggtgatcctcccacctcagcctcctgagtagctaggactataggtgcacaccaccacacctggctaattaaaatttatttatttatttagtaaatagagatgaggtcttgctatgttgcccaggctggtctcgaactcctaagcagcatcattttttctaggtgttaaactgacaaccacccaaattcccagcataaggattctgcttaaaatatctagctctctgatgaaatatcttcaaagaatatttaatgaccttaaatctcagacaaaaaggtaaggagacaaaatgaggaacccatttccgtacaaccccaatttggaaaaacacatgtgcaagtatgcccatgttaaaaaatatagaagaaaaaaaggctttaaggaaaaaaaaaataatagtaatgatttagggtgggaatcgcgttaatattcccaataattttatatattttaaaaatctataattttatcaggggaaaacgttatgttgcggaaattaattgatcgattgagtgattggttaacggacagtgtccgatgactcatataatcccccggttcgagtccctttaggccgcagacgtttcgcgccttctcgggtgtccaagtcgcgcatccatacaatgaggggtaatatactagattacctgaggtcttcttacggtaaaaacaccggtgtcttaaggtttcccagtggaatttgggggccgggttgacttcggagctggagctcgcaaaggccggggctgctgcagattctgacgctttgtggacccctactaccgagcgcagccgcaccgcaggttttcttcgctgctggttagatccaaagcccatcccatcctagtaaactgggacagcgccgcttctcacatcactatgggggcttctgctccgtggcggggaaaggccagaactgctgccttaaatacgcttttgcatcatccggttgctaacctccggccacagcattccccactccaaaatgccacttttccaggtgtgtttgcctaaatttaccccatttacagacttctcaggtgcatcattgggaacagggcgctttgcagtttgcaaaccacctcagacaactccaggtttaaaggataaaggatgacattgtgagcaaagcggcatcaaaatttcagatatttaactttcacattctaaccatacacctttccaaggtcttgtaatactttcacattgtgaatatacatctttacaagacccagtagtacatgggtcaagtgtggcaaaacagacatcgcgagccagccaggagtcgaacctagaatcttctgatccgtagtcagacgcgttatccattgcgccactggccccgacttgctaaagccttctccgtgatagctgatcacccttatacagtttgaacgggcttccgg

SEQ ID NO: 398 - DNA, 3924 bp, Homo sapiens
agaaaagcggtcaacccagccacgatgcgagccaaaggattcttggctccaagcctggtcctggctgttagtttggaactcatgcacccagatgctaactcgccctcagaatgcagaggggatgaaacactgaccggacaattcaatctgtatatgggtgagtccagggctcagtctgcattgcgcggaaaatgaaggtgaaggtggaggtgggacctgatggtctcgtcccggatagggttgaagaagtgggagaaaaggaatcaaaatcgtggatgggataagattgtgcgcgaatgctctctgggagcggatcgtggccgacgagggcccgaagatgctgccttgtgatcgcaggtgtgagtggaagctgtgtgagtgtcaatgtgagttgcctgtttgggagaccagcattgtatttttgtatcaggtagtaaccttggagccaggtatttgtaaaattatgataagagggcatcattctggagcatcgattttatttggaggttgacaggagagggaaaaaaacccctaatatctgataaacaacataaatagatttttatgttaaagtagttatatttattacggtctagaatgcaaatccaacatggcttttaaagcaagaaagattttttttatacaaagtcaaaggtattatttttatacacttactacaaaacatacaaatagtataccaagcctaagaatataaagagtctagctttaattaattgaatgtaaatttaaaaacaagcatctaataagtagtccttttcacacatcgaaaagccaatttcggaatttttttaaaaactcaaattacaaagtaacaaatatctggtgtcttagtaacttgaagatcagtactaatgattaagccagcttatatgctaatatgatacatgaaaaagcctgtatttcacaaatagcaaaccactaaaactttaattttccacagaagccattgtttcacaccaataattatgttaaagatcaagacaggctaaaagtttttaatgagcactgaatccattaaaacttggcaaatttttccacgaaggtagaattttaatttctgtttaaaccatgggtagatggtacacccttgtgagggtgtactgtaagtacttctaaggagctttatcagacttcatcccaaattatgtacctagtaaaagatgtaccaatgtctactttggaataagaaattattccttgtttgagcaaggattaagcagaaactgaaagaagtgtagtttatagcttcttacataaagtagatgggcacccctcaaaaacaaaccaatatcctggctccttaaatatcaacattaatctaaataatgtatagcatgctcctgtccaatctttcccgctcatttgtagtcttctcagatcgatgcttcattttagtcacacatttctatcctgcaagactgggtacctgggctttttgtctggttttgtaacactaggcagttttggccttactcaaaatataagactgcaaaaggcctgttttacctcaaccatacggcttcaggaaatggtctgtatttccaacagaaaagtggtatctaactctcaggatggtttctaacaactggatagatacctgggtctttgcggcctgtgatgcagcctaacaatacaggaccttgtgtgatcagctaggtctgctaaagcaaggggacatccatgttctagatttttatttatttatttttttttgagacggagtcttgctctgtcgcccaggctggagtgcagtggcgtgatctcggctcactgcaaactccgcctcccgggttcaagccattctcctgcctcagcctcctgagtagctgggactacaggcgcccgccaccacgcccggctaattttttgtatttttcgtagagacggggtttcaccgtattagccaagatggtctcgatctcctgacttcgtgatccgcccgccttggcctcccaaagtgctgggattacaggcgtgagccacctcgcccggcccatgttctagattttttattctggtttagcaggatccaaactgcctgtcctgaagagactctctttctcttccatacaacggctggcctctaccaagttaactgcttcgtggggggaaaatattgcctttcctttggtctgcatgttttaagggaaataccaaatacacctacaggagtttatcaataatagacaaggctgatttcaaactctttcaggagataaactggaggggaagacgaatggcaggagggtgaagaggaaactgaattactgtgcaaacacccgccactcaaatccgggtggttactgcagagtgaataacgataggtactatttcgtgtaaggcaaagtcctttgaaagggctcctagagcgtcaaggcctccacctgatgaatgaatgagtcaggcaggcccagctccacttcacggatgggaaaactgaggtacgaggcctcgctgaaagatgcgaggcagagcggagaaccagaagcaccacttctctcaggctgatgctctaatctcggctccccccgcccctacaatggcgtagacggcctccgccgcccgactcacacacaccctcccccgggaacggcaagtctcctcgggttccaaggacagggtcaaaagacaagaggcccgaggcgctcccgccgtgatttgcagccagataccgttgggagcgcagccagagagcgttgggagcgtgcgtacctccagcccaacatggcggcggcagcggccgcccccgaccccaagccctccctcagggcccgaggcttctcctcagggccttccggtgggcgggaagacagcgcaaccccgccaggcctttctcgtcgctgcgcctgctcgctgaaggagtcacctacccgacgagactaacggctgcggcgcggaagccccacagcccgccgagaaccaggaatacgagagccaggcggcgcggcggcgggacctgtactgagcaagaaagaagatttcaaagtaatttattgttatgagatccgtgcttttatcttgtctcagactcccaatgataggcacatactctcctctgtacatttaatgaaactactaaaatatttcgatttaaatcttccacctatttgttttctgtgtatcctacctgttcccgaccttgacattttcaaagaatacaggttacttattttgttttttggtggtggtgagtttttttggggttttgttttttggtttttggttttatttttggagacagggctttgctgtatcgcccaggctggaatacagtggcgcgatgatagctcactgcagcctcgaactcctgggctcaagggaccctcctgcttcagcctcccgagtagctgggactacaggcctgcgccaccacgcccgggtaattttttattttttgtagagatggggtgttctatgttgcccagtgtggtctcaaactcttgggctcaagagatcctcccacttctgctgcccaaagtgctaggattacaggcatgagccaccgcgccgggacagttattttgtagagtgttctttaatttggatgtacctcatcttttatgtatctttgggaggaataccacataactcatgtggtttatcccatcgagagacacacagtgtcaatgtgttccattcttggtgatgttaacttttattacttagtgaaaataattctaagagatttcaccactgtagagtgaataaatgaatatgtgggattcatcaatgaataagtaaaaggatgccaactggcaaaagaactgagttgggaggatggcttgagcctgggaggtcgaggctgcagtgagccgtgatggcaccactgccctccagcctgggtgacaaagcaagaccccgtctcagaaaaaattaaataaataaataaatacccagcacctg

SEQ ID NO: 399 - DNA, 21962 bp, Homo sapiens
gcttttggagtacacttccactaaagttatagcatgcttgaatggtttatttcaccaatatttgcttatggaaataaaggggagtggccgaggagaaaggagaagaggagtggaggaggggtttgaggctgagggaggctctgaccacagcacagagcaccggcaactttgtctaatgtgatcattaaccttcctgcaaaacacagctggcagttctctgaggtttgtcactagaatgtgaagacagccacacagatattgcacagactatttacagatcgtttggtttacattgagagtcattgctctacttttgtgcggtaggaaaatgagatttcagcaattcctttttgcattttttatttttattatgagtcttctccttatcagcggacagagaccaggtaggcctttgatacatttgtacaagtaacttgttttgcctgtttgcatccctgggtctctgagcatgattgtgtttatctgaaaaccacttaggtgtgcttgcagttagtagtattggggataaatgtgtaggattttgaaagtatgctatctatcctgttgggtctattatttcaatattttaaaaacatctggactttgaaatgataagtattttaccactatttttcctaaatgccaagaaaatagatctctaagctattgcagattatgttgtctttacaagtaaaatgaaacagaagtgttcgtctattcattataaaggtaaataaatgtatagatttttaggtaaaatgcaaactccaaagcagtttatttaaaaagtatgttgctgcccagagtaggggctgaattaacatacaaaaagcataatgcaacaaaatgcagattaaatcttaaaacaggtcaatagctgtcatttctaattatgtaactaggcatgtcacttaaaacaaataagtgcagtttttattattatgcttatacagctaaaaagcatcaaaaatatgtatgataaagatacataatattaatttacttgacatgttttcaaagatgatatcaagtatattgtacttaaccaacagaaatttagtacacaaaagtattctaatgtacttttacttcaaaaccaaacagctaagatttcaaagaaccagtaagtttgaaaaaaaaaagaaagaaaagagagaaaagaagagagaaagaaagaaagaaagaaacagaaaaaagaaagaaagaaagaaagaaagaaattagaaagttaaagttttctgaaccacaaacccaactttaaataaaaaggtggtaatatttacatccaaatatgttaaattattcacttgataatatacttcttcagttagaacagaaaacgatgcatcacttgttaaaaattcagactttgctttttagtgaattagaagtttgatcactgtgagtttatttcgaatgatgtcccctggtctgtgcttttacataagtaagaaaaaagttccaattcagcaactctgagaaagcagcttgatcccttctcattgtttacagcagtcactattcaaaccatttatacttttcagaaatacacagtagctttgacaatgttcttacaaaatatttgtgattaatttactacataaaataaaaggtctaggagcatttaggaaaaaatcattcaaaaggaggaggatattactattaagatgttgctatgttgctcaacgatggagttaaaaaaataggagtaaaagaagatcttgctattaacattaactgttaggaacaccccttgtgtatatgcatcacattggtttttaattttataatcacatttgaacaaatggcaaataaccacaatctagtttggctccaaaatatgtttgcattgtctagattaaacaacaattaagcctctgaaaaatgctcctaatacttctctctttttccttcagttaatttgaccatgagaagaaaactgcgcaaacacaattgccttcagaggagatgtatgcctctccattcacgagtaccctttccctgaggtatttctgacagaaaatagattcgctacatttaggcagtgttccaaattagatataccaggaaatgtttcttcacagtttgtaatatgtgataatggcttatggcaatgtcaagacttaagagatgcataccaataaatgaaagagttaaatgaatgacatgacttttgagaattgctttaatagttaaggaagaaaattagacagatgaggacaatgtaggaaaatcttgataactgttgaatctgagtaacagctatttgggggctaatattattgcggatgttatgcagaacgagccgattcccctattaagaccagtgtgtatgaaagcatttggatgtattcacccaacagccccataccagcaatgaactaccatcaatacttcggggtttcttttcttctcctcctctcctcctctcctcctctctcctcttacctctcccctctcccccagggtcttgctctgtcacccaggctggagtgtaatgatgtgatcccagctcattgcagcctcaacctcccgggctcaagtgatcctcccacctcagccccccaagtagctgggactacaggcatgcgccaccactcctgggtaatttttgtattttttgtagagatgagggttccccattttgcgcaggctggtctcgaactcctagcctcaagtgatccacccgccttggccttccaaagtgctggaatttcagatgtaagccaccacacttcatattcctattcaactattatttgccctcagggtttatttattttttctgaaaatatttcttttaatagataaagtaaagttaacactaataaaatggcagctttccagcctcaccaatagtagtgatcttgatagtcacatcttaaggataaattctggtagagttttgctcctcccttttcttgtttttacacttgttaaataatgttagaccaccacaattactggtaatactgcttgaatcagttaacttcaaacactgtccaagtttaagtcacttcatactaaaaaatacacagtttggcattccattgtaagtatttcaagctcattaattcatttaagatatagcttccttaaaaaatgccacagaaatatccctcatctggttaacatacacaggcaatggcaaaattagcttattcagttggcctgtagagtagcttttacggttccattcattcagtggaaagaacagttgctgtatctattgtttaatgcatgctttccaaacccggggaaagccctgtagtagaaaattaaatgaaggaggagcaatttcataataaacatttatcaaaaggattgagacaaaaatgtcaagttctctatgtctatatctgtaacaaattaatctttgttatcaaaatatgaaaaatagctttggtggaggaatccagaaagatacagtaggaggtttctgagaagccaattaatggtgattgaaacatgctttaaaaagattttctgtgttaaaatatcctttggtgtgtgttgataatgcttccagcagagcatttcagtgtcatgtatgaaataatggtaaaaatctgtgcttaagaggaatagagacaccccagatttttccagcactccttcataaataacaaagaggagaggacacatttcacaatagcaagagaattcctgcatatacaaagaaagataccttgcaaaatataaacacaagtctttagatagccacatattatcctcaaatcacataccataaaaaccagtgttacaagtaagcatgaatagtgaaatttgaatttttaaagttgaggggaattttgacttacaaatcaagtttgtaaaccaaagggaaatttaattaaagctatgcaaactacttaataatagcaactctttacaaaagttggctgagagcttataaaactgcttgggtgacagcatccattttctcagttttagactcgttctacatttcagctactgttctttgaagaatgtttaaaagtcacctgttggaatctactgtaagagttaatgtaagataaacattagaaaatttttcaagaccttgctcaaccagcactataataacaagtgctaccttcagatctgataacataattctcactgtcctaaatactttcccattttttatatgttttgcaacaaaggcactttgataactgggtaaatgtactgtaaacctaggtagtggactctaaggcaaaacacccctttcacttcttcccctctaattttttggatgctttagataaaatcacatgtggttatttgatcagttaggatcaagtaagactttgtaaaaggataggtaaggtaaacaattgactttgaaagttttccagattaaccctttattagagtgttcagacctttagctcttttaatagaaatgtcatattatctttactctgtcaatttttccagctcctagggtcatcctcaatgatcccagcctatgcaactgaattaattacacagaaaattacatgctgtatgccgttcatttccttgatttttttttctcagaaatattttggcaccaccttcagtcctaagtgatttagagtgaaggagagcaagggaaggggtgtcaggaaatgcaagtctacaggttaatgtgagggccctagagtggaaaatgaggtcgcgacttaaggctggaatgacttctcccttccaacagtaaaatctcagcacatcaatgcttttatttataagtatgtactctaaggccaggtccagtggctcatgcctataatcccagcactttgggaggcagaggtaggtggattgcttgagtgcaggagttcaagaccagcctggacaacatgatttaaccttgtctctaccaaaaaaaaaaaaaaaagttagccaggcatggtggcgtgtgcctctagtcctagctatttggggggctgaggcctccagggaggatcatttgagcccaggagtttgaggctgcagtgagctatgattatgcactccagcctagactctgtctctaaaacattacttacttaatatgtactctagataactacatactccgtcaatacatactctactagcttttttttttaatttatttttattttttgagacagagttttcactcatgttgcccaggctggagtgcaatggtgccatctcggctcaccggagcctccaccttccaggttctagcgattctcctgcctcagcctcccgagtagctgggattacaggcatgcaccaccatactcggctaattttgtatttttagtagagacagggtttctccatgttggtcaggttggtctcgaactcccgacctcaggtgatctgccccccctcagactcccaaagtgctgggattacaggcatgagccactgcgcctggtctagctagctttttaataacaattgtaatacatcttcatggtgtagaatatatttctaacagtatggaagaatgtaaagtcaaaagtacaagttccccatcctaccctattgcccatattcatgttccagaggtaatgactatgaatatatttttggaaaaagtgtcttttaatacattattattattattattaatttcattattattatacttaaagttttagggtacatgtgcacaacgtgcaggtttgttacatatgtatacatgtgctatgttagtgtgctgcacccattaactcatcatttagcattaggtatatctcctaacgctatccctccccactccccccaccccacaacagtccctggtgtgtgatgttccccttcctgtgtccatgggttctcattgttcaattcccacctgtgagaacatgcggtgtttggttttttgcccttgcgatagtttgctgagaatgatggtttccagcttcatccatgtccctacaaaggacatgaactcatcattttttatggctgcatggtattccatggtgttaatacattatttttaattgagtccaactgatactctcttgtcaccctcacttggtattcaagctttgcttctagtttcctattttctgtcttattcttacccccttgcagtcatgggcatctgacccccttaaccaaacctgccctgcttcccaactcttcctgcaattgtcctagcatcttcatccttctcactccattctctccacctcttgggtttaagtgaaacccaattctgctttcagcatagaatctctactttcatggagcacttcatctccaactttagctgggctctctgggaagaactcttctgcacttcatattcctattcaactattatttcaaactaataacctctagtttctttacacttcttaatctcctcttccaactcacagcaaaagataactcctcttacttcaagtgaaataggaggtcattaagcctcaaaatccaacctcgccctcaaactacagacatctacatctacaatgcttcttttatgttccctttctagtctttctttttctttttttttttttttgagacaggatctcattctgtcacccaggctgggtgccatggcatgatcatagttcactgtagcctcaaagtctcaggctcaagttatcctcctgcctcagccttccaagtatctgacagtaccggtgtgtgccaacgtgcttggctaattttaagattttttgtagagacagggtctaactttgtttccaggctggtcttgaccttctgggctcaagcaatcctcttaccttggcctcccaaagtgctgggattacaggcatgagccactgtgtgtggcccctagtctttcaataaaaaatacctctcaagtatgggtaatctccctacacctcaaggaccttgatctagcaattatactctcttgctcccccagaatgttcaatatgtcaacactgatctattttgtcttaaaaaaaaaaaaaaagacagaaagacgaaagagacaaagacagaaagaaagaggaggagaagaaataaaaagaagagagaaagaagacagaaagagaggaagagaagaaagagaagggaagaaaaaaggaaagaaagaaacagggaaagaaggagagaaagaaagaaggaaaaaaagaaagaaagaatgaaagaaagaaagaaagagaaagaaagaaagaaagaaagaaagaaagaaagaaaggagaagagaaagaaaggagagaagaaagaaacaaagagagagggaaagaagaaagaaaaagaggaaggaagagaaggaaagaaagaagagttccaccattgactccatagtgctctctagcgaccagcccatgttctcttcatctcttcaaagccacactttttgaaaaggcagctgttttctttcctcccaactattttcaacacattgttccccttttccttctgcggaaggtccattatgacttccttcttctgaatccagtgaatgtgtttcagtcctgatctcagttatcccgctgtaggtcaaatggaacacaaaataataacaataatttgacaaacaacaccttacaatatatacctttccagtttcatctgttaccttattctttcccccttgcctgtcccagaggagataagagttaagactgtgtttggacctactagattcaagctctggccacacagctcactctctggtgatcattgttggtaagtcatttattctctctgagcttccctccacttccagatctgtaagatggaaattgttatggcccttatcctatcataacaatacttggcacacagtaagtgctaaataaatagtagttagacttattattactttaaaatcagtccattcttcacctcttaactgttcttcaagctatgcttttgcctcaaattttttcactttttttctcagtatcattcatcctttaggaaaccttctctgattttattacccctattagttacaatagatatacccacttttgctctcagagcactagttacatacttctgttaaagtccttaacgcctggcattagaaagtgttaactgactatagtcttcccctcttccctctgcatgctgtaaattccctgaaggccgagggtaggttttatttatctttgtattttcagccaaaaaaaaagtgcctaagtgtttttgcttgtttgtttgttttgttttgtttttgagacagagtcttgctctgtcgcccaggctggagtgcagtggtgtgatctcagctcactgcagcctccgccttttgggctcaagcaattctcctgcctcagcctctcaagtagctggcattacaggtttgtgccaccacactcagctaatttgggtatttttagtagaaacggggtttcaccatgttggccaggttggtctcgaactcctgacttcaagtgatctgcccccctcggcctcccaaagtgctagggttacaggtgtgatccatcgtgcccagcctcataatgttgctaaaagatgtaaaataggctgggcgtggtggctcacacctataatcccagcactttgggaggtcaaggtgggcagatcgcttgaggtcaggagttcgagaccagcctgaccaacacagtgaaatgccatctctactgaaaatacaaaaattagccaggtctcatggtgggcacctgtaatcccagctgctcaggaagctgaggcaggagaatcacttgaacccaggaggcggaggttgcagagagccaagatcacgccattgcactccagcctgggtgacagagtgagaccatgtctcaaaaaaaaaaagatgaaatgaaatgaagcttttattcattatctttcaatttaagatcataaatttaagacttgttctcactagacacacacacattttcagatttattttctaatatttctaggatggaactatcattttctatctctgtggtggagatatttcctcttctaggaatttcttctctcatcaagtccaaactctctccctccttgagaattctcataaatcctattttcctcatgacgaccaccctaattcagttagtttaaaataaacttcatcctcctaacaatcacagcacttttagtagtaggcttttaaagccatctatcacatttgactttgtttctttagatttttatcagtattgaaatatgagctccttgaagacaagatttagcccctaaagcttaatgtgaatggcccaagaactgccttaaatatggggcattcctgtgtgggctgaaatatctgcaggacatattgcataaagctaaatgaaatattgaaaattactcttttctaaattaatcacagcccagtgtccaaaagtcatgcttggaggaaatccctaatgtccctaatttactgatgagataaaacttttctgtaaagattatgatgccagccagccacagtggctcacacttgtaaacccagcactttgggagcctgaggtgggaggatcttttaagaccaggagtttgagatcagcctgggcaacacagcaagacactgtctctacaaaaaatacattagctggcatgatggtgtatacctatagttccagctactcaggaggctgaggtgggaggattgcttgagccgaggggttgaggctatagtgagctgtgatcataccactgcactccagcctgagagacagagtgagactccgtctaaaaaaaaagaaaaagattatgatgccttaatgatgaatatatttacttatacacttatatatcaatgcataaatatagtgatgtttatattataaacatttattacaataattgtatattcctctgaacaaagtatgtatacaatgttctagagtttcaaagttttcttttcttttcttttcttttttttttgggacagagttccactcttgttgcctaggctggagtgtagtgcagtggcacaatctcggctcactgcaccctccacctcccaggttcaagcagttctcctggctcagcctcccaagtagctgggattacaggcacctgccaccaggcctggctaatttttttgtatttttagtagagacggggtttcaccatgttggccaagcgggtctcaaactcttgacctcaggtgatcttcccacctcagcctcataaagtgctgggattacaggcatgagccactgcgcccggccagttttcttcattttaaaaactgatttctccttacaaaatgtgtaataattctttccatagatagctaaactagctgctctctaccatgttgttcaggaatctaaaatttctttttagcataaatcccatctaatccattcccctccttacccacccccatcttcctcttccttcttggtattacggaagacatggccaatccttcatatgtgctgtgggtccccttctctccctaagatttcttaggaatttcaagctgtacttatacctttacctctctggatcatcgtgtcaacttgaaagtttaaatggtgataagcctatatcctaaaacaaaaaaaacacacatatacacatccacatacccctcagtcaatgctctcatgatttttctgtactcattgtccctgattcattattttgtattcacatctaaatccactttaatctgcttacatctccattagaattatccttatcttactaaattttttttttttgagatggagtttctctcttgtcacccaggctggattgcaatggttccatctcagctcactgcaacctctgcctcctgggtttaagcgattctcctgcctcagcctcctgagtagctgggattacaagcatgcgccaccatgcccagctaatttttgtatttttagtagagacagggtttcaccatgttggccaggctggtctcgaactcctgacctcaggtgatccatctgcctcggcctcccaaagtactgggattacaggcttgagccaccgtgcccagtctgatctttctaaattaattgacaaattttagtcttcttcctgatttcacagcagaatttagcagctggctacttggcctgcaaaagtcccttcccttcaattccagggcaccatacttatttccactaagttctcagccaaccctctgcctcctaaacaggctgttgtaccctgcaaggtataataaaatgtatctctactctctcctgctctgttttatccattcctttagcctcaattacctctttacccttaagtatcatactcctgaggaaaaaaagaaaaaaagaagataaccactcaaatgaatcaagccagggctatttattcagagtttacatagcaagggagtcagccagcatctcttgagtttggcagaggaccaagacaggcagagaatcaggaaagcttcattgtgagaaacagagaaggctttaggtatgatgtgactggagattgttggcatgggaaagctgaaggcaggctatctagaagcatgatatcctatttaatttggggagtatatgtggttttcttcagttagtcctaagctagaatcaggggaggagggataaaaaggaaactggtagttcttaaccatctgggaccagctgctgcagaggttgtgatttggcttcctgggctggttgctgcagtttgtgggtcaaagcattaatataggagctggccattgtacacttgtacatattcagtctcccagttcccaatttgtcaccagttcacattacacaagctcaacgactgtttaccttgcagcaaccttcacacctccacttttgcttctcttttatccattcttcgtattatggcttctatacttcttaaggtcctttagtgatttctcattactcttacaattgaaataaaattctgaatgtaaaccacaaaagcacttctctgtaagtttgtcaaatatgtcatgttccttaccacttcagggcttttacacattatttcctccgcctagacgtgcttttttcctactcttcacctttttcctactcaatgaaaattttgattaaatgtcacttctcttgagagtgtgtgtgtgtatgtgtgtgtgtaccatatataacttctttttttttgagacagagttttgctcttgttgcccaggctggagtgcaatgacgtgatctcgcctcactgctagatccgcctcccgggttcaagcgattctcctgcctcagccccccaataacttcttttattacactggccaaagtaacctcggtgagggtggggtgggagtggggatgagggtgggggatatgtgggggcttggagttctttaggtatcacatttcatttatgtcaaaattgtgctggagtttagttcaattttatacttagtcttcacatttttttctaatagcaacatttttatatatacgaaaattatatgtgtataaatatgacatatatacacattatttaaacatatgaaatccatttactgctttgtcttttacttagcatctaagtgacatttaatctaatttactttaatattgtataaatatgacatatatacacattatttaaacacatatgaaatccatttactacgtttatcttttacttagatgtatttatttgtacatatgaaaacagtaagttatttttatttttattttactttaagtttcagaatacatgtgtagaacgcacaggtttgttacataggtaaacgtgtgccatggtggtttcttgcacctatcaaccgtcacctaggcattaagagacggtcactttgaatgacactgtagtccagtcggccctccatatctgtgggtttttcattaaatcagccaatggcagattgaaaatattcaggaaaaaaaacagaatggcagtatctgtactgaacatgttcaaacttttttccttgtctttattccctaaacaatacagtataacaactatttacataccatttatattgtattaggtattataagtaatctgcaaacaatttaaagtatacggaaggctaagtgtaatttatatgcaaatactacaccattttatataagggacttcagcatccatggattttggtatccaagggaaatcctagaaccagttcccagggatactgagggatgattgcatttcactgtatggatagccttaatttatttatcttgactttattgatcaatatttatgttttgtaatatttatttatgctattttgaacaacgctgcagtgaatggcatgcatacgtatttgaacatatgtacacttattttcttgcaaaatactcctagaagtggaattatgaggatatgcatgtttaatttttttcagttatcatttatacacccgacaattcacccatttaaggtgtacaatttaatggcttttactatattcctaagttgtgcaaccatcaccatgatcaattttagaacattttcatcatcccataaagaaaccccattctcattagcaggcactccccatttctccccagctgttcagtcctggacagccactaacctactttctgtctctatagatttccctattctagatattccatataaatgaattcttgtgatatgtggtctttgtaattagcttttttcacttaatgttttcagggcccatccctgtagtagcatgtatcagtactccactctaatttacgactgaatacaattccatgatatggaaaaatcacattttgtttgtccagtcacctattgatgaacatttgggttattccggctgtttggctaatatgaatcattctgctgtgaacattagtgtataagtttttgttggaacatatgttttcagttctctgggaattaaaagagaggaattgttgggtcatatggttatgctatgtgtaactcattgaggaactgccaaactgtttttcacagtagtggcatcatttcacattcccaccagcagtatacgtgggttttaatttctccacatgcttgctaacacttgttgttatagctgtcctagagggtgtgaagtgacaacttattgtggttttgatttgcatttccataatgactaaaatgttgagcatcttttcatgtgcttattggatatttgtgtctctttggagaaatggctattcaaatcctttgcccatttttcagttggattatttgtctttatatcgttgagctgtaagatatatatatatgtgtgtgtatatattctgaatacagggcccttatctgaaatatgatgtgcaaatattttcttccattctgtggatgtctttttttggtgttgtccttggagcaaaaaagtttttaattttattgacatcaaattagtctatgttttctttggtagcttgttctttagatattatatatttaaaaaataatcgaaggtcacaaagatttacatctactttgtcaatttctgcaaagagccatttggtatttggatagggatagttttaaatctatagatcaatgtaacaagtattgccattttgacaaaattaagtcttccaatacatgaaatggaatgtatttctctttgttcaggtctactttaattgcttttgtagtattcagagtacaagtttgtacttcctttgttaaatttattctaagtattttattcttttgatgctattgcaaacggaattttcttaatttcatttttgaattgtccattgctaatgtataggcatatgattgattttttattgatcttatatcctgaaatcttaataaaattattgattcattctcataggtttttcagaaggttccttaggatttgctgtgcacaagctcacgtacaagatcacctgcaaattgagatagtttcttcttcctttctaatctgggtttcttttttcttttcttgcctaagtgccctgataagaacctccaaagtagttcaagcaaacatgtttgtcttattcttggtcccagatttagtctttcatctattaagtattatgttagttatgggtctttgtagatgacctttatcagattgagaaagttctttttctattgcaagattgatgaatgttgttattatgaagggaggatgtttgttttggtcaccttctttttctgtatctaaattatcatgtgtggccagatgtggtggctcatgcctgtaattccagcacttcgggaggctgaggggggcagattgcttgagtcagggagtttgaggccagcctgggcaatatagcaaaaccccatctctgcaaaaattacaaataattagccaagcaggtgtggtggcatgcacctacggtcccagctactcaggaagctgaagtgaaagaatcgcctgatcccaggccaaggaagtcaaggctgagtgagctgtgatcaaaccactgcattctagcctgagcaatggagtgtgaccctgtctcaaaagaaaaaaacatacagaaaaccaaatatatattcacacacacatatatatgtatatatattatcatgtgttatgtgttttgtctcttattctattgatactatgcatcacattaaatgattttcagatgttaaattaacattgtatttccgaggtaaatcccactaaatcataatgttcttcatatgttgctgaatttagattgctagtattttgctgaggatttttacagctacattcataagaaatattggtctgcacttttcttatgatgtctttttctgattttggtattgggtaaccataaaatgacgtgggaagtgttttctcctcttctaaattttggaaaagtttggggaaaattgatactaattattctttaattcatttataggattcaccagtgaagccatgtggttctttttggaaagtttcttaattgctaattcgatcttttttcttgctatatatccatttcagatttttatttctttttgagtcagttttggtaatttgtgtctttctaggaatttgtctattttatctaagttatcaaatttgttggcacacagttgtttatactattttcttatagttattttttgtttctgtaaggttagtagtgatgttccctctttcatttcagagtagtagtttgagtcttttctcttttattcttggtcagtctaaataaagttcatcaattttgttgctatttccaaagaaacaactttggttttgttgatttttgctatggtttttccattctccagttcatttgtttctgctgtaatcattattatttccttgcttctgcctgatttaggttttgtttgctcttccatgtttagggtcttaagtgaaatgttaggtattcaattgggatctttcttctcttttactatagatgtttataggtataaatttctcttcaagtgctactttagctgtattccctaaatattcattgtcagtcatctcaaaatactctcttatttcccttctgagtcttctttgagttactggttgtttaggagtgtgttgttaatttccatatatttgagaatttctcaaatttcttttgttattgatttctaatttgattccattgttgaatcatctatttttcctttcaattctgccagattttgcttcatgtattttagggctctaagtatatatatcttcataattgttctatcttcctcagttgacccttttagcattataaatgtcattctttgtctctagtaataatttttgtcttaatttttaaaactatgacattattagtatattcgcttcagctctcttatacttgctgcttgcatgatatctctttttccatcctttgactttcaatctatttttggctttgaatcagaaatatgcctttgcaaagaacctatggttaatcatgttttttgtttgtttgtttttttaccccgtctgacacaatctgccttttgaatggattatttagtaagttcatgtttaattttattatttatatggttgaacttacgcaattttattttttcttttctatatgtcccatgtctttttttgttcctctcttcctcttctactgctttctttgcattaaatgaatattttcttgggtttgtattttggtcaccgaaaaaaaaaataataaaaggaaagaaaaaataagaatattgtgcagtataacattttaatttatttaacaattttttggccgggcgtggtggctcacacctataatctcagcactttgggaggccgaggcaggcagatcacttgagatcaggagttcaagactagcctggccaacatggcaaaaccctgtctctactaaaaatacaaaaaaattagccaggtgtcgtggcgcacgcctgtaatcccagctacttgggaggctgaggcaggagaatcatttgaacccaggaagtgaaggttgtggtgagccaagatcgtgccactgtgcttcaacctgggcgacaaacatgtatatattgtaagtttgataagcaaaaaaaatccatctcattttcatctattttttacaaaacacacacatatatattttttcttttcttttcttctttatttttttatttttttatttttttgagagagtcttgctctgtcacccaggctggagtgcagtggcttgatctggggtcactgcaacctctttcttccaggttcaagcaattctcgtgcctcagcggggaatataggcatgcaccaccatgcccagctaaattttgtatttttggtagagacagggtttcaccatgttggccaggctggtctcaaactcctgggcttaagcaatccacctgcctcggcttcccaaagtgccaggattataggcgtgagccaccatacccagccacacatatattttttcgagatgagctcttgctatgttttccaggctgtttttaaacttctgtgctgaagccttcctctcacctcagcctccccagtaggtgtgagccatcatgcctggccccatttcatttttatgttcaaatttaggcaatccgagttgagagaaatgattccagaagaggtatctctatatttgtattgctaaattagtcatagttaacaccccactatgactgtgagatgtgaagtgaaagtgaaatgtgaaggaggtggaagcttccagaaatgaagcaagaagcagccttcatgtcttcaggaggggtcccaaaagaaactacctagggaaacattgacaccagtggcgcacacctgtaatcctagctattcaggaggctggggcatgagaatcacttgaactcagaggcagaggttgcagtgagctgagaccgtgccactgcactccagcctgggcaacagagtgagactgtctcaaaaagtaaataaaataaaagtttaaattcagccttttaaagacacataggtgctgcatttctattggaaggtaagaatatataaagttgctttcagcactgataaacactgataaacttccataactcattattaaaaaaaaaattaggcatgtgtttattggtgtgctggatagtatttctttgatgtatttgtttctcccttgcctctcaaatatagatctctctagctaactttactggatctatcagaagaagaagaggagtgaaggaaagacacccagccacacaaaagaacttcatgatgccaacagcgtgattgcttagaagttcctacacaaaaaaaggatcatttgaaagcacctggaatggtttattagcttcacaggattttattcttcttggcttctatttggagggaaaataacataaattcaaaaggattccaatctgaagcccaaatcgtttgcctacataacaaaaatatctcatcttttcctgcacattattattcttttatgggttaaaaagaaaaataccttttagtgttttagaactctctcatggtaaaaagtgcaagaatttaaaatgttgctttcatattcctataattctccaaaagtattaaattcgtatatgtttgagtgattttctaaaaactgctcaacctgaaatcaattgcattgaccatttggcttcgcacaatagggagaaaataattggttcattgattatatagagagaaagactaagaaaagctattaattgctaccaattttatgataagctttaaggtttatgaaagtatgtttttttatttaatgagtaatgtccatttgaagttgaaagaaaacatgaaatcctaattgtagttcattttatgttcaaatgaaaccattgtttttgtttttgttttgaaacagagtctcactctgttgcccaaggtggagagaagtggcacgcttttgtctcactgcaacctccacctcccgagttcaagtgattctcgtgcctcaacctcccaattataggctgggattacaggtgtgcaccactacacccagctaattcttgtattttttgtagagatgaggttttaccctgttgcccaggctggtcttgaactcaggctggaaccattcattttttaacctttctcatcatgtaattataggaacccaacgtttgatttcctttgaagttttgttatgtcctttattattttgtatggataatttctttaaaagtcttacttaaagttgacatctaaaatacagttatgccaatgaagtcccactcagggtgatatctgtatctaaaagatgagtgctcatcatcctattaggctttgtcttggtggtgttcatcctgagatgctgagacatggaaataaaaaatcagaaggaatttagggatatgattactcaaaaaagaaactatcctgtctaaatttgaattgtgttgataactaggtgttccccagatgctaagatgttcttaatttgtatttattgaaggattgttagcttagtgccacaaaatttttcttactttatgttaattccagataagaaatttacaagtttatatctttttttttcttttttttaagatgagatctggctctatcacccaggctaaagtgcagtggcatgatctaggctaactccctggctcaagcgatccttccacctcagcctcccaagtacctgggactacaggcactcacggccacacctgactaatttttgtatttttttgtagagatggagtatcgccatgttgcccaggttggtctcaaactcaggctggtgagctcaagtgatccgcctccttggcctcccaaaatactgggattacaggcatgtgccaccatgctgggccacaagttcatatctggagtagaagttttactttgtaaatattataaagtagaagaaaccataaaccattttgctaaaatgaaaggttggggttaatataaatgtaattttaaatagaaaatctgacaacactgtcgagtttgtcttcctgtcaaagcttattaaaagtgtctttgcggatgaatggtactttccacaagtgcatttgagtagaagcataacctattctcagttatatttatgtttaaaacatgtactggtttgtatattttgtactgaaaaagaaaacactttatagtcaagatacatctcattcaatacaagtctaaactctttcaaatacaaattcgcatattcacagaaaaagttacaaatcagttttactattgtaaagtaatgaaatggttatacatttcttaattgttcaataaaacactcaatgatttgcatgtctggctgtccttactttgtataagaaatgttcagtgttgagtatagcatggtagaaatgttcctgatgcccgtctctgtttccagtgtttgttcctattaattgaggcatttaagactgaacagcctcgatacagcccttaccactgcagatcttttacataattcatgatgatcagagcaagggcaaagattctctcaaagtctaccaaaacacaataaccagtggcacatatgcttgttgacctaccagaacaggtccttgacatacagctatcttttattcaccgggaggtaaatgagaccagaggggtgccaaatctgtgttctttaaactcaacaatttttatgggttggtattcttttaattatctttcttggagatagagtctcactctgttgcccaggcaggagctcagtggcgtgcttccagctcactgcaaactccatctcccaggttcaagcgattctggtgcttcagcctcccgagcagctgggattacaggcacccaccaccatgtccagctaatttttgtatttttattagagacgggggttcaccacgttggccaggccggtcccgaactcctgacctcaagtgatttgccagcctcggcctcccaaaatgctgggattacaggcgtgagccactgcacccagcctaattatttttgtattaaaagttctttgtggccgggcgtggtggctcacacctgtaatcccagcactttgggaggccgaggatggtggatcacctgaggtcaggagttcgagaccagcctgaccaacatggagaaaccccatctctactaaaaatacaaaaattagctgggcgtggtgtcgggtgcctgtaatcccagctactcgggaggctgaggcaggagaattgcttgaacctgggaggaagaggttgcagtgagtcaagatcacgccattgcactccagcctgggcaacaagagcaaaactctgcctcaaaaaaaaaaaaaaaaaaggttatttgtaatttctaacattttcagaacacaaaggaaaagactttacagagcttgatcaagatggttaaggggatcagtagtaatggtgccaccccaatttggatcccagggttgagtcagtgaatagaccagatggagggtggtggaccaaagcaaattgtaaaggctgatcccttctttcatgttttgcccttcttacagcttcctttgaggaatgaaaatcattgtttgctgtacatttgatcagaagaaaaaagaaaaactgaaattagtgaagtcagtgaagtcttcggtcccgtcctgaatcatttttaccctctgtttagggacaggtctagaacgagtgagcacaaaactgaagagtgtgccgaaaatctcagcaatcaagataacatttgaactccatttttgaaaaaaataaaaactaacacccacgaaaaa

SEQ ID NO: 400 - DNA, 7533 bp, Homo sapiens
acccgcttgggtccccttccacactgtggaagctttgttcttttgctctttgcaataaatcttgctactgctcactctttgggtccatgctgcttttatgagctgtaacactcaccacgaaggcctgcagcttcactcctgaagccagcgagaccacgagcccgccgggaggaacgaacaactccagatgtgccgccttaagagctgtaacactcaccgcaaaggtctgcagcttcactcctgagccagcgagaccacgaacccaccagaaggaagaaactccgaacacatccgaacatcagaaggaacaaactccagacgcaccaccttaagagctgtaacactcaccgcaagggtccgcagtttcattcttgaagtcagtgagaccaagaacccaccaattccggacacattttggcgacccagatgggactttcgcctatcaccaagcggtgagaccatcacctatagctgagcggtgagaccatcacctatagctgagcggcgagaccatcacctatcaccaagcagtgagtaccacggacccctttcacttgctattctgtcctatctttccttagaattcgggggctaaataccgggcacctgtcggccagttaaaagtgactagcacggctgccggactaaagacatgggtgtcaggctttctgggaaagggctaacaaccccaactcttcagagttgggaccattggtttgcctagcaccagcttccacttttcctgtacttctgggctgagccaagggtcgacagagaggaaagccatgcagctccagggtcccgacaacaagttggttgaccctgcggccatgagtggaactctcaaaggcctgtcgcccaagtgagactcgcccatctatcctatctatcctgacccttgccccctgggtcctaatgcctgccagacaaacttcctctcgcctctcttctctgaggttagtcctgcttctaaaaattgctacctgtctctggtgcttttctagtttctcctataagaatgatttctagtataaactccaggtctctgctactttctgtaggcacccgggctcaccaatcagaaagacacaatttttgcccaaagccccattgtagtggggactacctggaattttaggatccctcctcagactaacaggcctaacaaaagctattcctgaagctaggatatggggagcctcagaaattgtatccttcctattcatgtaagcgaggacaaaaggtgtcactcttccaatcctgaagatcccttccctccctcagggcatggccctccacttcatttttggggcataacatctttataggaaaggggtaaagtaccaatactgacaggagaatgcttaggactctgacaggtttttgagaatgtgtcggtaagggccaccaaatccgatttttctcggtcagtcctccttgtggtctaggaggacaggcaagggtgcaggttttcaagactgcatcagtaaggaccactaaatccaacgttccttggtcctccatgtggtctgggaggaaaactagtgtttctgttgctgcatcggtgagcgcaactattccgatcagcagggtcctgggactgttgctggttcttgggcaggggttgtttctgctgctgcgtcggtgagcgcaactattccgatcagcagggtccagggacctttgtgggttcttgggcagggggagaaacaaaccaaaactgtgggcggttttgtctttcagatgggaaacactcaggcatcaacaggctcacccttgaaatgcatcctaagccattgggaccaatttgatccacaaaccttgaaaaagaggcggctcatttttttctgcactatggcttgggcccaatattctctctctgatgaggaaaaatggccacctgagggaagtacaaattacaatactatcctgcagcttgaccttttctgtaagagggaaggcaaatggagtgaaataccttatgtccaagctttcttttcattgaaggtgaatacacaactatgcaaagcttgcaatttacatcccacaggaggacctttcagcttacccccatatcctagcctccctatagctccccttcctatgaatgataatcctcctctaatctcccctgcccagaaggaaataagcaaagaaatctccaaaggtccacaaaaacccccaggctatcggttatgtccccttaagctgtagggggaggggaatttggcccaacccagctacatgtccccttctccctctctgatttaaagcaggtcaaggcagacctggggaagttttcagatgatcctgataggtacatagatttcctacagggtctagggcaaaccttttacctcatttggagagatgtcatgctactgttagataaaaccctggcctttaaggaaaagaatgtggctttagctgcagcccgagagcttggagatacctggtatcttagtcaagtaaatgatagaatgacagccgaagaaagggacaaattccctaccggtcagcaagccatccccagtatggatccccactgggaccttgactcagatcatggggactggagttgtaaacatctgttgacctgtgttctagaaggactaaggagaattagaaaaagcccatgaattattccatgatatccaccataactcagggaaaagaagaaaatcctcctgccttccttgagtggctacgagaggccttaagaaaatatactcccctgtcacccgaatcactcgagggtcaattgattctgaaagataagtttattacccaatcagcctcagatatcaggagaaagctccaaaagcaagccctgggccctgaacaaaacctagagtcattattaaacctggcaacctcagtgttctataatagggaccaagaggaacaggcccaaaaggaaaagcgagatcagagaaaggctgcagccttagtcatggccctcagacaagcaaaccttggtggttcagagaggacagaaaatggagcaggccaatcacctggtagggcttgttatcagtgtggtttactaggacactttaaaaaagattgtccaatgagaaacaagctgcccccttgtccatgtccactatgctgaggcaatcactggaaggtgcactgccccagaggacgaaggttccctgggtcagaagcccccaaccagatgatccaacaacaggactgagggggcccagggcaagtgccagctcatgtcatcaccctcactgatccccaggtatgttcaactattgagggccaggaaattgacttcctcctggacactggcgccgccttctcagtgttaatctcctgtcctggacgactgtcctcaaggtccgttaccatccgaggaatcctgggacagcctgtaaccaggtatttctcccacctcctcagttgtaattgggagacttggctcttttcacatgcctttcttgttatgcctgaaagtcccacacccttattagggagggatatattagccaaggctggagctattatctacatgaatatggggaacaagttacccatttgttgtcccctacatgaggagggaatcaaccctgaagtctgggaattagaaggacagtttggaagggcaaaaaaatgcctgcccagtccaaatcaagttaaaagatcccaccacttttccttatcaaaggcaatatcccttaaggcctgaagttcataaaggattacagaatattgttaaacatttgaaagctccaggcttagtaaggaaatgcagcagtcactgcaacaccccaattctaggagtacaaaaaccgaacggtcagtggagactagtgcaagatcttagactcattaatgaggcagtagttccactatatccagttgtacccaacccctataccctgctctctcaaacaccagaggaagcagaatggttcatggttctggacctcaaggatgccttcttctgtattcccctgcactctgactcccagttcctctttgcttttgaggatcccacagaccacacgtcccaaattacgtggatggtcttgccccaagggtttagggatagcccttatctgtttggtcaggcactggcccaagatctaggccacttctcaagtcgaggcactctggtccttcaatatgcagatgatttacttttcgctaccagttcagaagcctcatgccagcaggctactctagacctcttgaactttctagctaatcaaaggtacaaggtgtctaggtcgaaggcccagctttccctacagcaggtcaaatatctaggcctaatcttagccagagggaccagggccctcagcaaggaacaaatacagcctatactggcttattctcaccctaagactttaaaacagttgagggggttccttggaattaccggctttgccaactatggatccccggatacagtgagatagccaggcccctctatactccaatcaaggaaacccagagggcaaatactcatctagtagaatgggaaccagaggcagaaacagccttcaaaaccttaaagccggccctagtacaagctccagctttaagccttcccacaggacagaacttctctttatacgtcacagagagagccaggatagctcttggagtccttactcagactcgtgggacaaccccacaaccagtggcatacctaagtaaggaaattgatgtagtagcaaaaggctggcctcactgtttaagggtagttgcagcagtggccgtcttagcgtcagaggctatcaaaataatacaaggaaagcatctcactgtctggactactcatgatgtaaatggcatactaggtgccaaaggaagtttatggctatcagacaaccacctacttagataccaggtactactccttgagggaccggtgcttcaaatacacatgtgtgtggccctcaaccctgccacttttctcccagaggatggggaaccaattgagcatgactgccaacaaattatagtccagacttatgccgcccgagatgatctcttagaagtccccttaactaatcctgaccttaacctatataccaatggaagttcagttgtggagaatgggacacgaagggcaggttacgccatagttagtgatgtaaccatacttgaaagtaagcctcttgccccagggatcagtacccagttagcagaactagtggcacttacccaagccttaaaactgggaaagggaaaaagaataaatgtgtatacagatagcaagtatgcttatctaatcctacatgcctatgctgcaatatggaaatagggagttcctaacctctggggaaacccccattaaataccacaaggaaattatagagttattgcacacaatgcaaaaacacaaagaggtgggaatcttacactgacaaagccatcaaaatgggaaggagaggggagaacagcaacataagcagctggcagaggcagcagaaaggaaggaagagacaggaagtcaaagaaagagacagagagtaagaaacaaagagaagcagtcagagtgaaagagagacagaaagacaaagtcaaggagagaaaaagagatggaagtagtaaagaaaaaacagtgtaccctattcctttaaaagccggggtaaacgtctatctacccagccaaggcatattctacttatgtggatcttcaacccatatctgcctctcagacagtttgcaagaaataacgaaatctatccttactttacaatcccaaatagactctttggcagcagtgactctccaaaactaccgaggcctagacctcctcactgctgagaaaggaggactctgcaccttcttaggggaagagtgttgtttttacactaaccagtcagggatagtacaagatgctgcccagcgtttacaggaaaaggcttctgaaatcagacaacgcctttcaaattcttataccaacctctggagttgggcaacatggcttctcccctttctaggtcccgtggtagccatcttgctgttactcgcctttaggccctgtatttttaaccttcttgtcaaatttgtttcctctagaatcaaggccatcaagctacagatgggcttacaaatggaacccaaaatgagttcaactaacaacttctaccaagggcccctggaccgacccactggcacttcccctggcctagagttcccctctgaaggacactacaactgcaaggccccttcttcaccccatccagcaggaagtagctagagcggtcatcggccaaattcccaacagcagttggggtgtcctgtttagaggggggattgagaggtgacagcatgctggcagtcctcagccctcactcactcttggcacctcctctgcccgggctcccactttggtggcacttgaggagcgcttcagcccaccgctgcactgtgggagcccctttctgggctggccaaggccagagccggctccctcagcttccagggaggtgtggagggagaggctcaagcgggaactggggctgcgtgcggcgcttgcgggccagctggagttccgggcgggcgtgggcttggcgggccctgcactcagagcagccagccggccctgccggccccgggcagtgaggggcttagtacctgggccagcagctgtgaagggtgtactgggtcccccagcagtgccagcccaccggcgctgcactcgatttctcaccgggccttagccgccttcccatggggcagggcttgggacctgcagcccgccatgcctgagcctcccacaccccctccatgggctcctgtgcggcccgagcctcctcgacgagcgccaccccctgctccacggcacccagtcccatcgaccacccaagggctgaggagtgcgggcgcacgcaggggactggcaggcagctccacctgcagccccggtgcgggattcaccgggtgaagccagctgggctcctgaatctggtggggctttggagaacctttacaatccctgagctagacataaatacaccaatcggcactctgtatctagctcaaggtttgtaaacacaccagtcagcaccctgtgtctagctcagggtttgtgagtgcaccaattgacactctgtatctagctgctctggtggggccgtgaagaacctttatgtctagctcagggattgtaaatacaccaatcggcactctgtatctagctcaaggtttgtaaacacaccaatcagcaccctgtgtctagctcagggtttgtgagtgcaccaatggacactctgtatctatctgctctggtggggccttggagaacctttgtgtggatactctgtatctaatctgatggggacgtggagaacctttgtatccagctcagggattgtaaacgcaccaatcagcgccctgtcaaaacagaccactgggctctaccaatcagcaggacgtgggtggggccagataagagaatgaaaccaggctgccccagccagcagtggcaacccgcttgggtccccttccacactgtggaagctttgttcttttgctctttgcaataaatcttgctactgctca

SEQ ID NO: 401 - DNA, 102016 bp, Homo sapiens
gtattcctactgtgctctctgaggatgtggatgctgttgatctgcggaccacactttgagaaatacacaggtgacagctgtggtggaaagaactcccatccaggaatcaaaacatgtcttcacattttggccatggaacttggggtaagtttctaaacctcttaatctttgttcttttacatatagaaaaagaaatcataaacatctgaacatgctaagctcaaaatatgggtttattaaagtatagctgaactgaaatccagtcatgatagaaagactagttgaggaaagaataattctatctcatatcccctattctcccctgtcactccagcagaagaaaaaatctgccatcagaacaggaaagaaagctcactaaatagcttatttgctaaagaagtccaaggtactgaatttagacaggtaaattgatctattttgccttttcaaagcattaaataaaaaaagaactataaccctaatggacgggatcccctagctgtctctgcccaccctacagcagcttgaaggctgattcgtttcttttacaaatacatgaacatctcaaatatatgtccaaacttcgagaaatctacttttcttatttctgttctttttctattttttttttctgtctaagcgccagacacacactgtctctctctctcccaatcctcctttccattgcctccccatcttgctggtttcaacttcttttccctcctagacacagtattcccctctggatccctccacattccttccctttctaaattcttggcttctctaattcatgtgttcacatacatttccctactcaacacaaaggctcctttccaggagtctggtgggaccttgctttttccttgacatattattattatttgattttttaaaaaactgtgattcaaaagcagaagagcataaaaattagacttgcgtgtttctcttttcagctagggaagttgccagctacatcatcttgtaattcccaactccttttcttacaagggcagactcttaatcactcagcttggcttctctttcaaaggtaggaacagagggaaccatgagagaaaggactgatagaaaggactcgcccactgcctgaggagccacctgagacaaggatagtcagtctagttctgtgagggggagtagatgctgggctgagccagtatgatgcttccttgtgttccaggaagttctttgtataaaaactgaaagaactgctttttaagggctgtttgattctggactcctgtgattaagttctgaaggcctcacactgagaccaaaattccccaattatattctcttgaagaatcaccctgggtgggctcagcttgggggtagagagttgtaactaggcaaaaaaaaaaaaaagaaagaaagaaagaaagaaagaaagaaagaaagaaagaaagaaagaaagaaagaaagaaagaaagaaagtgaactaatatagtttaatttattgcccacatcaggccaagataaaatttctgagatttacatgtccagatatttaatgagcaaatgctttcctttactgagattttttggtagttgtatgtaattcactttgttgcaatttccttgtttattcccatggagcctaacatagtctccagcttcttagggtaagggcagcaaatccttctctgcatacccacagcaatagagtaggggagaggatggagagtttctttgttgtgatctagtcacctttctctcagattcctgattttatgtaataattgtgtatgcgtgcgtgtgtgtgtgtgtgtgtgtgtgtgtgtgtgttggagacatatggtttagtgttaatttaaattaatatgagattacccaaatactttttagaataatttgagtatactttatttatttttattttttaagacggagtcttgctttgttgcccacgctggagtgcagtggtgcgatctcggctcactgcaacctccacctccagggttcaagagattctcctgcttcaggctccccagtggctgagattacaggcatgcgccaacacacctggctaattttttttgtatttttagtagagacagggtttcaccatgttggtcaggctggtctcgaacttctcacctcaaatgatctgcccaccttggcttcccaaagtgctgggattacaggcgtgaaccacactgtacctggatgttacttttgttttgagacaggatcttgctgtgtcacccaggctggagtgcagtggcatagtctcggctcacttcagcctgtaccccccagttccaagtgatcctctcacctcagcctcctgagtagctgggactaccggcatgtgtcaccatactcagctaattttttaaaagaattttttgtagaaacagggtcttactgtaatacccaagctgtgcttctgatataaattgtaagtagagtccacttatacagcagggagtataatgcaagagtgagaagaaaatggactaatgggagaaagctagcccagaagacatgttggtatattttggaaaataacgagttaattttgaaccagattaaggagtttgggtttaaagaaaataaagttctgggtgaaattgatggagattacaagacatttcatgaatggtgaggacaatattctgcagtcatctggataataatccatatatagttagaagttcttaccatcttggaacgaagcttctcaccccccgagtcatactttgcatttataaagtagcttccacttatcaagcacttgctatgtaggaagtactgtttctcaggggtgcagggttccaatcagtgagcaggtttattcccaccatctggtaactcctcttggttacacagagaattgaatgaaaggaaattcaattggcaacactgcagacataggctttgctagttggacaatagcactcctgcctggagaagtgtggacctcagtaaccagtctccatctacaggaacaatattcggtgaccattgtttactgggcagttccgagttttctttttctttttctcttttttgagacagggtttcactctgttgcccagactggagtgcagtggtatgatcatggctcactgcagcctcaagctcctaggctcaagtgatcctcccacctcagcctcccaagtagttgagatcacaggtatatgtcctcatgcctgcttaatttattttattttattttatgtagagatggggtctcctgatgttgcccagcctggactcaaactcctcggctcaagtgatcctcccactcgggcctcccaaagtgctgagattacaggcaagagccatcatgcctggcctagttctgagttttctctgccaagttctttctgctggaggccagggaagtatgtatatgcctctataagttagaatatcaggcttccaggtgcaccagggatagttgtcatgtttgatacatggtcggtagcaactactatactggattttaagcactacatgctcctggattttttgtttttgttttttagtgtggcatatggctaaagcagggaggaggagagtttagggctcttggatgggagcggagatgagaagagttaatgcatcatccatggcttgatagtgaagattctggcttccaaagatgagcaaagtttttccacttccacagcccttaggcagagtaagtcatttaatcttcataaaacttgtggctgtattttctccactttttcagctgagaaaaacaagtctcagagaagtaataacaacttgatcaagggcacataatgtgagcaaagaagagctaggcctcaaacctcaatcaaataacagcagaagtcctgttccttattcctgcacacttctgcctttccaaaatacatcactcacctccactcccaactagggagagtaacaggatgggaataacactgttctgccattctgataattactcctatgtggttagcagtactctccatcccacttttcaaaatgtatttatttattggagatgaggggaaggttctgtttgtctgccaactttttgttctccaaaattgatagatcttgggatttcagttcaaacttcagagtggggaaatctgagcccagtgaaccatgccatggccatatcagggtgggttttttttctttctttcttttttccccccttagccaagctgaggctgaatgaccaggctcttggcaacctcatcgtatctattatgttctgatcattatttaaacaaatggtattcactggggtccaagtcagaggaacaggacacagagaaggctttctatcagtcagctggactgctcttcccctttcacaggtcttttgtgcttcgtgaggatccttcaagtgtggaacagctcacaaaggaaaagatggacacagcctttgtctgggaagggacattcagtcagccccctttccccgtggagatgtcttgatccttttgggtattttttttgtctctattcaaatcaaaaagtgctaataaaatacccaacacagtgttaaggcactatggcaggaggagtagagtgatatgcaggttttatgcatgcccaagtatgataaagtatcaagaagggacaggcaagggtgggctttaggacatgcacagctgagaaggaatagttgtggaaagatgctggctctgcagacagtgtgcctcggttccagtgattattcaagtgatcttgaaaaacaccttaacctagcaagacttagatcttttatctgcaagtggagatagtcatcatagttattttacagctttgacttgtggattaaatgaaagattgcatgcattgtgcttattggcaaatttttgagtttttattaaattttcactcgtataattatagttgagagtggatttatagagggaggtcgctttgggtcttgaaaaggagaaaaattacagaatgtgttagacccaactccagggagtcatggttttggaaaataaaaaaatacatctacaatttacctttttcactttagggtacaaagttagtaaaaaaaaaataaaaaaaaaaccaaaaaacatatttgccaatctgaatttgccaatctgaaatgtctcaagtaagctatccttgttagcacattgaggcttgaacataatttcccaaaccacagatccacaggcaatagtctaggaatttttttttttttgagatggagtctcgttctgtcccccaggctggagtgcagtggcgcgatctcggctcactgcaagctctgcctcccaggttcacgccattctcctgcctcagcctcccaagttgctgggactacaggcgcccaccaccacacacagctaatttttgtatttttagtagagacggggtttcaccgtgttagtcaggatggtagtccaggaattttttattttaagttgcctctttaaaccctgtaaaaagagttttttggtcaaatacatttgaaaaactcagcatatttggagattcataatgaccatttggataaaggtactaagcaggcctctatgaaaataacatcttccagtgttaatcaaataaatgtgaacataacgcatttttgtcattgtttttgctgctgctgctgtttggagtacagaaaggtgcacatatcaatatcctgaagaacacaggtccatggatgcagttgactctaagctgactcacccagctgtctgctgttagctctagtagtgtttgcatgctgggtgtctagtcatcaaagaatgttcttcacatcaattatgctgacaccaggcattgttctaaaatagtgactctaaagagaagtaattctgtagaccaggaacttagtagttgtatctggtagaactaaggctgacttatcttgggggaagcactttatcatgatattgggaacttgcagcaaagttttgactggccttcaatcagctgagtttccaagatgcttttgttatcaacttgcttctgaaaacttattaaaaacttcattccatccttctttcctctcaaagtgtacagagtatatgaaaggcagagtattggtgggaccaagaggatacaggtgtatgaaaagaacgtgagggaagggagaaagagagggaaagagaatggtgaatggtgatgctgtggtctctcaatttgaatctacataatatgcaatatatagattaaaacattacccttacctgtatctatacatatagtccgtttttttgtttttgtttttttccccgagaaggagtttcactcttgttgccaggggtggagtgcaatggcacgatctcggctcactgtaacctctgcctcctgggttcaagcaattctcctgcctcagcctcccaactagctggcattacaggtgcccaccaccacgcccagctaatttttgtatttttagtagagacggggtttcaccatgttggtcaggttggtctcaaactactgacctcaggtgatctacctgcctcggcctcccaaagtgctgggattataggcatgagccactgtgcccagccaatagtctgttttttggagagtggaaaagcactatacataaccgataacatttccaattttcatttatgtatttgcagctatatatgtgtaaattttgccttaatttgggtatgcctaaatttatgccttctgtgaattccttagtatctcacagtttgtggcactgtgtgataagatcttctgaatgcctaacctttttggcctgagcccacccactctgtctaatgcactgtgtctctggaaaatctctttacctttagtatttgtctctgtaaactgaaaataatatctctgtttctgttttttttctttttctttttttcttttctttttttttttttgagatggagtttctttcttgttgcccaggctggagtgcaatggtgtgatttcggctcaccacaacctccacctcccaggttcaagcaattctcttgcctcagcctcctgagtagctgggattacaggcatgcaccatcacgtccggttaattttgtatttttagtagagacagggtttctccatgttggtcaagctggtctcgaactacttacctcaggtgatccacccacctaggcctcccaaagttctgggattacaggcatgaaccaccgcacctggccctgtttctgggtttttatgaagtaaataatataatgaagtcattctccaatacttatccatacatatatatgtgtgcctgtatgtgtatgtacgtgtgtgtgtatgtgtgtgtatctgtatactggactaggcacataacaaagtttttataagcctgtagtaaaataagaaaaataagataagtgtgaagagtgttaagttttacgcagttagaaaaatgaatcccagcactttgggaggccgaggcgggtagatcacgaggtcaagagatagacaccatcctgatcaaccaacatggtgaaaccccgtctttacgaaaaatacaaaaattatctgggcatagtgacgcacgcctgtagtcccagctacaggctgaggtaggagaatcacttgaacctgggaggtggaggttgcagtgagccaagattgcaccactgcactccagcccaggttgacagagagagactctgtctcaaaaaaaaggggggggggagttttttccattctttttgttaaaaaatgttactttacaaaacacctttttgagttttttcccactattttactagtaagggaaatctcaaagtcccagaaccagtgagctgatgatacagaaatactgggctcaacacagatgtgagtcagtgttcttgtgaattttgctatctttttgaagttatccctcttttgatgttagtggcatgttggtttgcaattgtttgtccagcaacaaagatagagagtgttcttcaattgtaattatttttggtgccagtccctcttgaaaacagtgtttttgaatggctgccttataaatgccattggtgcctgtggatccaagcaaggtgaattgcccaagggtgaggacctcctggctgtggtctcattagcactgagctcctgcaggtggcaacagccaatagaaccggtagacagccacggaattttcttatccagatgtctctggccacatcacaaagccaagtattactgctctcctgtgagtcattgtttggcattttctgtctcttctctcccctatttatgttaattgttacagattcatttcttaattcatttgacaggcattcactggggttcattgtttgttaggcatcatgctgagcactttaaatactttattatctcatttaacttacacaacaatttagtgaagcagcattattttaatccctaattttcacaaatgagggaccaaggcttgaatggcgatctggtttgcaagtgccatttcgcaagcgagtcacctagttaggttcacatccaggtgtctcattttccaaaggtcacagtattgattatggaaatacaaggcgattagcagacccaggaagccttacggtggaaacgttaagagcagggactttggaactataaagacctcagttgttgttgcttacgtttttagtttatttggaaaatcaggataataattgtgcctaattttatggttcttgtcacgattcaattatataacgtatacaaagccctagaaacatactaagtttttttcttgtgaagtggtgtctgtcagtaacaatgttaacaatagtaattggactgtgctgtgggctgtatgagactttgccgaagatgagaaaataaatcacaatgttaagtaaagcaggatgttgaggaggagggttcagagttgggtggaagccttgaagggctgtaatgagaggcatgaaggtatctgggctccagtgtgggaagggcttccttgttgagtccgttttgcctggtgggcccgggcaacctcactgatgcagggtcctagcatgtgtctggctgccaagtacatagggatttgtacttttacacctgccagggagggatatgaccaagtgaagaatgaggttcatgcagccgagaccctgagaaatgagtctgtaccgaagagaagctggacttggctctcaaggggaagccctctaccctgcctgtctggctcttgttgagtagtggagtcggtctttgatgaccttggcctaaaactcttcataatagtccaagaactgaaaaattaggatcctttggcagctgctggcatgttctgaaccataaagtttgcatttactccatggctggaaaccagctgccccgtggagtgaaagaggagggggttctctatgtgtaagaacctgaaaggagaaaattactgtggaaggaaatgaagtaatgacatagcctttctgccagactgggggatcttagccacgatttagatatttccagagactaaaatccaccgttacggtgaatatttagaagctggcaaaatttagggagtgtgtcatgtttatttatcatttacttacatacattttcaatgtagacaagatgtctaaggaattataacttctctagaagatgattcatttctcttgtttttctttgtttgtttgtttttttgagatggagtcttgcgctgtcacccaggctggagtgcagtgacgcaattcctcttcgtttttatcttgggtgcttatgtctgagaagtctgagcaacaatgggcttaatttgagtgattttttgtgtagttcttgttcatctatacgtatacatattccccactacccttttacagttacgcccatcccttccctccataacccctggcaaccaccaatttgtttcccatctccataatttttgtcactttgagaatgttattgtcaatgaaatcatactgcaggtgattttttgagattggaccttttcactcagcataatgcctttgagatccaaccaagctgcatgtatcagtagttaactgttttttgtttatttgttttttgagactgggtttcacttttgttgcccaggctagagtgcaatggtgccatcttggctcactgctagctccggctcccaggtttaagtgattctcctgcctcagcctcccaagtagttgggattacaagtgcaaaccaccacactgggctaatttttgtttgtttgtttgtttgtttgtatttttagtagaaacagggtttcaccatgttggccagactagtctggaactcttgacctcaggcgattcccctgcctctgcctcccaaagtgctaggattacaggcgtgagccaccgcctggccagttcactgttttttattgccaagtaatgttctatggtatagaccagttagtttaagaattcctctcttgaacagacattttcgttgatccatttttggaaattacaaataaaactgttatgaccaattatgtacaaaatttgtttggatataagtttgtatttctctaggataaatgcccaggagtgtggttgcttggttgtatggtaagtgtattttcttttaagaacataagaccacatatttcatgatttcatttatataaaacctttccttttggtcaggcatggtatgttcccgcctgtagtcccagcactttaggaggccaaggtgggaggatcacttgagcccaggagtttgagaccagcctggacaatatagtgagaccctgtctctacaaaaaataaagaaaaacattagctgagtgtggtagcaggaagctgtagtccccgctactcaggaggctgcagtgggaggattgcttgagctagacaggtcaaggctgcagtgagctatgagcacaccactgcactccagcctgggcagcagggccagactgtgtctcaaaaataaataaataaaaattttcttttaagagagtatcatactgttttccaggagacatatcattttgcattgcttccagcaatgtataaaagacccagtttctccaaatcctcattagcatttggtattgtcagtattttttatgtagtgatctctcaatcatagttgtttttttttttttttgaaacagagttttgctcttgtcgcccaggctggagtggaatggcacgatcttggctcactgcaagctctgcctcccaggttcaagcgattctcttgccttagcctccccagtagctgggattacaggcacctgccaccatgcccagtgaattttttttgtatttttagtagagacgggagtttcaccatgttggccaggctcgtcttaaactcctgacctcgtgatccacccgccttggcctcctaaactgctgggatcacaggcatgagccatcgcacctggcccaagagttctttatgtattttagatacacatgtttcttatcagatatatggttttccaaattttctcctaatgtgtgggttgccttttcactttcttggtagtgttctttgaagcacaaaagttcttaattttaatgctgtctagtttatctatttttttcttttgtggcttttgcttttggtgtcatacgtaagaaactgttaccttatccacaatcatgaagatttagaccccctttctaagagttttagcttttacatttaggtctgcgatacattgtgagttgatttttgtatagaatgtaaggtagatgtccatattcattcttttacatgtaggtacacattgtcccagcagcatttgctgaaaagactcttttcttcctatttgattgtcgtggcacttttgtcaacaatcagttgactgtatgccatattttttatagttgttttttcctatctcaaatttccggttcctgagaactgaataaatgaaccttccaaatgattagctaaagctggatctaaagccccaggggcaatggttgtttttttttttttttttttttttttttgagacggaatctctctctgtggcccaggctggagtgcagtggcgcgatctaggctcactgcaagctccgcctcccaggttcatgctattctcctgcctcagcctcccgggactacaggtgcccgccaccatgcccacctaatttttttgtgtttttagtagagaaggagtttcactgtgttagccagggtggtcttgatctcctgacctcgtgatccacccgcctcggtctcccaaagtgttgggattacaggcgtgagccaccgcgcccagctggcaatcgttttcaatgctgtgaagagttacttgttcttaaccttaagcgagatccagacactttttagagagcaactttggatttggaagagaaaaaatagaatccattggctttggcagttggaggggagaaggggactaggaggaaaaggtagagaatatatgacaatcctaaaggttgattttccttcttttcagttatatttttaattattcttgggtttcgtttgttggtgtggccttcctctattctccagagagtataatatagcctcacattagacaaatacaggttcaaattctagatctttttttaacctgtttgatttttcaatcttcagtttcttcttttgcaaaatcaggataatcataatatatacctcaaaggattattatgaattttaaataataaaaataaatcacttggcatagtgccatgacatattaaaaatattagctattattatttttcctatccagtaccaaaagttatatgttgtgtgttccattcctttagttcttgttgcatgaaataaaataaactgctaatctgatttttaaaaaatccttactaatctcttagtaggtatgaaatatttttcttttgtgggagtagggaagatttcaattccttttaagctttaatttcctgagtgtgttacaaagtgcattgaattatatttgacatatggaggttctaaagccatgtcaggcttctattaacatatgataatagaaagcaataggaagtccagcaatctgtgagatcccatggcccttccacttcctccccatggctgtaggcacaccgcccatcttctgtgagcttcactttcaccactcctaaaatggggatgaaatatcagcctggactgttgttcagattgctatgacactcaaaggaggtaaaaactgtgctgagtttttaaaattataaagctggctagatctgtaatgtggtttagctcattactgaaatatttagcaaagtaaaccctgtgacaaaacatcaaaattaacattttaattttttattaatactgtattatcatattggtggcctcgagatatagataaaaagaggacagtgtggtcaaaagcttcagctaatgaaacagagcaggaagtcaaatataaaaagcctagttgtcaatcaaggttctaaggcattttgaagttaatgttcagtgtttttgcattttttttttctgaaaccttagtgggctgaatctctcaatgcctcctttcttagcgctatggtctctgagaacaggaaatacaataactcaacttataattttaaaggccttaattttagagccaaaacatggtcccacaggctctggtctcatcatctatgaaatctgatactccactgtatgggtataaatatatatgtgtgtgtgtgtgatttgaagtttactgattcttacagtttaacatcaggttcttctgttaagttcaattaaattatttacatgtatttaaaaatagaatctattttggaactctatttctctaaaagtagcatcaactctttccttttctatctgtatatgtacaccaaaagatgtctagaatgctgtccacctaatgataatcacgattatttctgtgtggtatgattttggggcaaactttgctgtcatctacgtattttcctatattgcttgagggttttttaatatagcttttttatcttaaaatagttataaactctacagtaagttggcaaattagcacatagtgcaccatacctttcacttagcgtctccctatggtaacaacttaagtaactagaataaaatggcaaaatcaggaaactgccattgggaccgtgcaaactgcagactgtattcagatttcaccagtttttccatgcactcatttgtgctgttactccaccttaactctacgtattcctttgtagccctgctatgaggggtggggttgggtagggagcatattgaacttgacagggataaacacacacctgctttgaaaagtcacactgtttgtcattggccggaagtaacctcatccttccaaaattattggtagtgatgtgcctgagctggcttgtgtcagtcctggaggccatttgttaaatatttaggaattttgtcattggtagtttgaaatcagctatggtgaaataattaccttgaagaaatctgcagagtataaatcaagccccccaccctcgcttcctagagcctgtttaccaacacaatactcttggtacgacatttacagttgtcctggttaatccccgttccccatgtgcctctcatctgggtctctcagtaaaacatatttccctaataggacattcccttatcatacatgatgcttcttttcctttcagggtttccaaatagagcagctaaataatttagtaaaaaggcaaggctttctgttaatggattctaatatcttattatatgatccttctgggtaaattacctccattttgcccagggacttcctggaatatagatacatatttaactccaagacgacatttgaggatgtgtgtgtttgcgggggtagcgattgggtagaatcctttcagcccccctcagttcccaccaagcaggcagctgttgatctcacgcacactcaggggccttcactcctcctggtcctgtccctttccttctagaaatgccagaaatgcagggactcactgagtcccttctgttgaggcagatcacgggaactgggaaaagaaccttggtttaaacttgaaaaggaagtaaaaaaccttagggattctttgtggataacagtgtggattcataaccttctaggtagtgaagcgccatatccttttgtctttagtgagaaagacagagcagtgaaaaagagggaagtgagctatgttccctcttaatccttagtacattaattggaacagaaaaagaggaaaacaaaaacaagacaaaacgttcctattctctatcctccccttgtctaaaagtgttgctaacatttaatagatgtgtagattagctcttacatgtgtagcctattccaggtgtagcctgttccaggtgcatggaggaatattaaagacatttattaaagacatttatattaaagacatttatgtctggaggcaaaattacactggcaacataatagtgaaatgaacataagctttggaatcagatctgaattcggattctgacttggccacttattggctgaataaatctgggcaagttactaaacttttatttgttactttcttccttagtaaatgcaaatttgttaggagcatgaatgataatgattgggcttctaccctgtaccaggcattttatgaatattttaaataatgttttaatttaatttaattcaatccttaccataagcccagattatattatttttattttatggatgagaaaattgagcctcagagatgttcattaagtcgatcaaggtcatatagctaatggggaacagagctgggattcaaacatagtattctaaagcctatatcctcagatcactctagaggccatatagccaatttaaaaatgcatgaaaaatttttatacatcgtagggactcagtcattgttatattgttatttatttaatatatagtgaattatatgttagttatattgataattatattaagatatattatataggattatataataaactttaattattagtagtagtattattttttgagactgggtctcactctgtcacccaggctggagtgcagtggtacgatcttggcccactgcaacctctatctcccgggttcaactgattctcgggcctcagcctcccagatagctgggactacaggtgcccaccaccatgcccagctaatttttgtgtttttagtatagacaggggtttcaccaggttggccaggctggtctcgaactcctgacctcaagcgatccacctgcctcgacctcccaaagtgctgggattacaggtgtgagctaccgtgcctggccggattatataatataaattaattttattataatataaaataattacattgttatttttagggaaagttcactaaacttgaagtcagatgatctgacccaggtcttggctcaaccatttagtagctccaccagtaggcaagtcacttacacagtattctctctctctgtttttgagatggagtttttgctcttgtcacccaggctggagtgcagtggagtgatctcagcttacttcaacctctgcctcccgggttcaagcaattctctggcctcagcttcccgagtagctgggattataaggctgtgccaccacgcccggctaatttttgtatttttagtacagacagggttttaccacgttggccaggctggtctcaaactcctgacctcgggtgatccaccagcctcggtctcccaaagtgctgggattacaggcataagccactgcacccattttttttgtttgtttgttttgttttgtttttgtttttgttttgttgctcaggctggagtgcagtggtgtgatctcggctcactgcaacctccacctcccagactcaagtgatcctcctgcctcagcctccacagtagctgggattataggcgcttgctaccatgcctagagacagggttttgccatgttggccaggctagtccaggctggtctcgaactcctgagctcaagggatcctcctgcctcagtctcccaaagtgctgggtttacaggctgagccatggcgcctggcccacttacatagttttctcattcatattcaggcatgcctgccacattgtagttgttcaataaatgtttggtaaaaaaaaaaaaaaaaaaaaagaaagaatgaaaaaatgaatattcttaaggtccttttcaggtcttaaaaaatgactcctgttgtgatagtgacacacgaaaaattaaacaattgatgatcaaatgaaaagttaattgtcagtgatgtctgagaggcgccccaaaccacagcggtttttctacagcgacgccctgtggtgtcggtgagtactgcgagggctagctactgcagggcctggttctcggcatttttgcctaagatttgtttgttcttcctctacaaactattaagccaatcctgaacaggaagactttttttttttggttatttaaataaatcactgcttatttactcaacgttgcagtgctcttggtgatgatgttttgcttagctttttcagagagcaccaggaatcaggggaggatgatgaaggcagggtgtctgggtaagaggcatcctttcatgctcctgttttttcaggctttatacgctcgtattatccttctgcactttatccctttatactaacagatgaactgaacaacataattaataaaagtgtgatttattgagcctttactatatagcacacattgcaactttttgtgtgaatcctgttacatatcttatttaattttctcaacagcctgacaaggtaaatggtatgattatcccatttgggggcagatttaaaatgctcaagtcgcttcttcaatgacacatacctagtggcagagatagaattaggacccagtccgtatgtctcctatatacatattgcctcttgtaacagaatagaaagaaaaatagatcagaaggagtaaaagccagcatcactggatctctgcttaatttccatttgtaattaaaataaaattaaagcacctggcttattttgaatggcgctttcccatagcagcccctaataactgaggaggtacagcactaagaagcagggatccttggtcaattaccgagtgacttataaaatgccgtttatggttaggaatggcagactaatgaaataaaagcttatctagctaatgttttgtaagaacaagaagaaattattgctgttttttcattcttgggattcttgggcggtaactttttgttaaattgtcttttttttttctttaaaaatccctttaagaaacataaaatgttccggcaaaaatatttaaaacattaacaatattattttaaaaaatcaaggtcatccacacaatgggaaaaactctagacacaataacatacctttgcttgtcggttctctggggaaaacttgtttcagaggtggggaattagggagtgaatctgatgaactgccttgacctcttttatctggcgtctgaccaagtctgaaactatttggaggtcgctaagtttcgctgggtctttgtatttggaaatgaatttgctgcctgcggcgaagaaagcaatccagcctccctgaaataaggagaggctacaaaacccgagatagtgaacaatcatgccggaggaatggacaaagcaatgcttatgtttaggttattactttcatatggatgtggggaattgaaatgcaaaaccaaggggcatcaaaatatcacataaaatcagctttaggttttccttgagctcacacttttttccctggacttgtggaaaaatgctaccctcctgtggtcagacagtagaatacagaaaaacagagacctttgaccaggaaaataaggtgaaattgaacagggaatgtggtgatctattcgtaagtgttttctgaagagcttatggcttatcaaaaagacaccttcagaaaagaaaaaaaaaaaaagaacaacagaaagaaaggaaagaataacaaaacaaacaaaaagctaagaataacaacaaaattactttccaataaaatggcccagttaacctatttccaccttcatggggacttctctgagcattcaaacaagaagcaattgctccctccacaattcaatacataaatactagaattaaaataatacaccaagactctgctgtgtgctaggacctgtgctaggtgctgggaatgaaaagctgacaaaggaatatctcttccctcaaataactcagatttcatggggcattaagtggaaagggacagaacaagtaactttatttatttatttatttatttatttttgagacaaagtttcgctcttgttgcccaggctggagtgcaatggcacgatcttggctcactgcaacctccacctcccaggttcaagcaattctcctgcctcagcctccccagtagctggtattacaggcatgcgccaccatgcccagctaattttgtatttttagtagagatgggttttctccatgttggtcaggctggtctcgaactcccgacctcaggtgatccacctgcctcggcctcccaaaatgttgggattacaggtgtgagccacggtgcccggcctgtaactttaatatacatggtaaatagcatgataggtacacatagagtgcgagatcaaagaatattttgttctgctcttaaagaagatgatggctgagtcttccagtagcaataagatttaaacaggtagctgggcacggtggctcacgcctgtaatcctaacactttgggagactgaggcgggtggatcatgaggtccagagttcgagaccagactgaccaacatggtgaaacccccatctctactaaaaatacaggagttagccgggcatggtggtggcacactcctgtaatccctgctacttgggaggctgaggcagcagaatcacttgaacccaggaggtggaggttgcggtgagctgagatcgtgccactgtactccagcctgggtgacagaacgagactctgtctcaaaaaaaaaaaaaaaaaaaaagaaaagataaaaagatttatctagacaaaaaaataggaaaaacatttctagacataaagagcagcatatagcaaaaaatccacagcatgaatttgcctcaaagcctgcataaataccagctcttttgacctgccaaggtctaagtgtatgtgtgtgtctgtttgtgttggagaagatgggacagtgtcacctgtgtgttgcgggaagtcagggaccccaaacagagggatcggctcaagtcgcagcagaagagcataatttgtgaagatttcatggacatgtaccagttcccaaaattaatacatttataatttcttacacccgtctttactgcagtctctgaacataaattgtgaagatttcatggacatttatcacttccccaatcaatactcttatattcctatgcctgtctttactttaatctcttaatcctgtcatcttcgtaagctgagtatgaatgtcacctcaggaccctgtgatgattgcattaactgtacaaattatttgtaaaacgtgtgtttgaacaatatgaaatcagtgcaccctgaaaaagaacagaataacagcaattttcagggaacaaggaaagataaccataaggtctgactgcctttggggttgggcagaatagagccatatttttcttcttgcggaaagcctatagatggatgtgcatgtaggaggaatatcgctgaattcttttcccagcaaggaatcctggggaaggaatgcattcctgggggtaggtctatagatggccgctctgggagtgtctgtcttatgcggttgagataaagactgaaatacgccctggtctcctgcagtaccctcaggcttactaggattgggaaattccagtctggtaaattctagtcagatcggttgtctgctctcgaaccctgtttcctgataagatgtttatcaagacaatgcatgcacagcaggacatagaacctcatcagtaattctaattttgccttgccttgtgatctttattgccctttgaagcatgtaatctttgtgacttactccctgttcatacaccacctccccttctaaaatctcaaacaaaaacttgctggttttgcggctcgaggtcaccatcacggtcctaccaatatgtgatgacacccccggaggcccagctgtaaaatttctctctttacactctctctgtttctcagaccggccgacacttagggaaaatagaaagaacctacattgaaatattgaaatatccctccatacctgtgtaaggtaagtgtcccaggacataaatggtcatgctgaggagagagtttgactttattttctagtgctggattagataaaacagtatgcttgtgtttcatttggctaaagtctcttactccactcctaaatcccatatttatattaaatgcttagttcccataagtatctgagagtcaaccacaggtgctaatgggaatgggaaacaaagaaggaattttaaagaggagaacaacctggtatgatttgcacatgaaatcaagctgaaaacaatgagtaaggtgtattttaaggtggcaaaacttgagttagctaatttaggaagttgctgcaagagttgaggtgaaaaactcttggaagtgatgaagaatagaggatagattgcagaactaaaataaataggacttcggaagaattagttgtagagggtgagggaaaaaaaggagatgacaattaagttcacgaacccaccatatttccatctaacatctctcagtgagttggggaaggtagcagaaggtgcaggtctggaatgaaagattcattcaggatacttagtagcttgtggtatccttatggctttaaccatcctgtgctgagttctactttattgttacagctttatctgtctgactttactgtaaggtcactgagagcaaggactaagtcttctctatctcaatattccttaaaatacattttgaaaaataactcattaagttattaaaaatatcattctcaaacaaacatgtatccaaatgtcatataccttgttaattaaaggaaccagtagaatgactgagctggtttgagaagaaattgaaggatggggtaagacctgctgaaatgaaagctgtatgttagaaacaaaagtagttaatgtgcttataggacaaaaactcaatctttatttgcatggttttattttttctatcaagttgaaaaacgcatcataccttatcatttttctatgaattagcctctaccttgatagaattgtaaaacttctgagctctcttgaatcattgtatttccccaattggaatattataaactacagagaaactatagagacatatacttcttatttgccttatgtctaagttttgaatatttttttctacacacatttctgtggtggctctaagaatatttaatgtgcattttttatattgaatacatatcttatgactgtacaaaaaagatttgaggtaatgtaaattaaaggcaaaatcaaagcaaatgaaaggcaaaacaataaggtcgataaaataaaaaaggctgggtgcagtggctcacacctgtaatccttgcacttcgggaatctgaggtgggaggattgcttgggcccaggagctcaaggttgcagtgagctatgattgcatcactgcactccagcctgggcgacagcaagtcctcactgtaaaaaaaataaataggccgggtgcagtggctcatgcctgtaatcccagcactttgagaggccgaggtaggcagatcacatgaggttgggagttcgagaccagcctgaccaacatggagaaaccccatctctactaaaaatacaaaattagctgggcatggtggcacatgcctgcaatgggctgaggcaagagaatcacttgaacccaggaggtggaggttgcagtgagccgagatcatgccattgcgctccagcctgggcaacaagagcgaaactccatctcaaacaaataaatacataaataacaataaaataacaaagaaaatagaaaaaattgattagatgtcacgattaaatatagatatgtttttgcatttgttggcagtcagggcaaaatgggaacatagtaaattttctcttatcacaagggaagaaaaatctggctcctgaggtggttgttattttttttgtgtttttcttcttctaaattctaaaagaaagtgtcatgtggggcttcatataaatgacacagatgtcatagccctttttttcaatatttttatggtaattacaggcacaaattaccaatgactatttgttatagaactttttgaccaaaaatttacttcatatttataaatatgtgtatgcacaaacatgttttgggttaaaaacagaattttttttctctagaggattttcaatgaggaaaaaaagccttcactatttacttttgtatttcatatgtagctacaaatttgcttaaataaaatgagcattctttatcagccatttggcacaaatcttaacccatggggtaggtaggaatttgactatatctctgcacttctgcgactgtacctgtagatcagaggcagggctatgtcatgagctggtgggaggaattcctttgtgtgggttttgtatgggcctagtaaatgtttccttgtctcactagcactgtggaaggaagtgcctgccgcccactttagcatctccaaaaaacactggggtaattttctctggatctagaagaggccagttgagttgttgacataacacatttgaattatataccaaaactggagttaatcaaaacagagcttttcttttataaagttatacaggaccccataataactgcctgttttatggcatgctgatacgtaaggtacctttctcatagagactcaattgttgtaaaccatcatcaaataatgtaaattgtgatgtcttgagaggtgggcctatgtgttattcttctctgtgtttagaatttgatatagctcctggcatataagtgcttcctatgaatgagtgacagaatacaaactgatgagtgactttttttttttttttttgctaataaagatgaagaggttacaattaaaagaggaaaccttcttgacatggatcttattgagcccattccaaaatactaatttttctttgtttctttgagacagggtcttgctctgttgcccaggctggagtggagtggcatgatcatagttcactgtaaccttgaactactgggctcaagtgatcctcacccctcagcctctcaagtatctgggactattggcactcaccaccatgcccggctaatttttattattattttttagtagagacaagggtcttgctatgttgcccaggctggtctcaaactcctggcctcaagtgatcctcccgcctcagccttccaaagcactgtattacaagtgtgagctacagtatcctgcttaatattacttttgatagttctttatcttttttgttttgaaagttgggggtcttgctctgttgtctagactaaagtgaagtgatgggatcactgtaaccttaaactcttggcctcaagtgatcctccttccttagtctcccagtagctctgactataagcatgttccaccatgccaggtaatggcatgtaaaaaatttttgtagacatgggttcttgtcacgttgctcaggctgatcttgaactcctggcctcaaggatactcctgccttagcctcccaaactgctgggattacaggtgtaagccactgcacctggcctatttttaacagttcttcatggtgacttacaaagttgtacctctattgtgtcatattggtttcttatttggttcatggatacagggattgtttcccacatgagactgtaagctctttgagggtagatccacatgtacataagacataggaatgtgcacatgatcaatgctcacataacacacacctgttaatttgctatatctagtgggtctacaaggtagaaaaaaaggtagatggatagagtagaagaagtaatattcagaataaggatggaaaatagcaggcaagattctctcccaaactatgttcagaacagagatgctaatgatgatagttttttcctcaggggtgtaaattctgctttggcctccttatcatagtgcccatagcacacacagtaacaaatgcagaatgggaagacaagaataaatctatttactgtcctggatatagagtttatttccctacattacactgatagccctgatttgcctcaccctgtttttcaaaagtagattagaggaagggcgctgtcgctcatgcctgtaattcccagcactttgggaagccaaggctggtggattgcttgagcccaggagttcgagaccagtccgaccaacatgacgaaaccccatctctactaaaaatacaaagaaattaccaggtgtggtagtgcacgcctgtagtctcagctacttgggaggctgaggcagaagaatcacttcaacctgggaggcggaggttgcagtgagccagtgagccgagatcgcaccactgcactccagcctgtgcaacagaccaagactgtcttagaaaaaaacaagtggaagagttcattaaacaaacagctataaacaatgaaagataaagtttttaaaaaatgcagcttgttttatttttatataaactaaaacaccagagttcatcgattcctatattaaatacataaattataaaataaccattcataaaactttacatacagtaagttgattccaatctctacggtaatacatacagtacatgtacatattcggtgtacttcagaggatcattctggtgaaactcagtcaatttttatttttctttcattaataaacaagcactgaagtgatatatggagtcatgctaatgagatggaaagaaagaaccccaattgaggcagttgattgaatgaaagctctgtgaaattggacccttggctacattaacacagtaaacacctggggaattatgtattcaaacacattagctctatacttgagtccccaaagtattggatcttgaaggctaaaacatgcatgaaccctgttgagatggaatttttagctaataaagatatgggacttttggctaattttaatactgtagattgtgctgaactttctgttgctctttcaaaaaaaagaaacatcaaccaaccaaccaaacaaataaaaaaaacctatttgctggtttatgggcctggataattgaaaaaccgagtggtctctgcctcagtcaacaattggaaataatagtagtgaacagaaggtggggtaagggagagaagaggtagtcaaggatgggaagagttcaaacactaaatgctcgacaaaaacatgagttcccagcagaagcagcagcagcgcagaaaaaacctttcttgaagtcctgcatcctagaacagaagtacacgtttagtaagcgctcacaccatcatactatgtacagaatatatctgtgcatatatttacatcacatatttataaaaatgtttggattttgatctgcctcattgtgggaagttgctatggttaatggctggtataggcacagtctgtgagatgtcagtcaaatagaagtgttgttactaacagatgctggggatctgttttagttggaaaattgcatcatccactctttagtaagttcgtgggatcttgattgtgggcaaaattgggctcaaagttgtttaactttaccattctcaccctacagaactttgcatataacaaggatgaaaatataagcatgggtacaaagaccgtaatgcagaaaaaaacaaaaacaggaaccctcaccaaatcaaccacgtgtatctctgccacattaatttgaatataggaaattataatcctatttttgctacattgcccctataagtatatctttagtagtttttttcctctctccctcttttctttctttcttttttttttttttttttgagatgaggtctcaccatgttgcccaggccgttatgaaactcctgggcccaagctatcctgccaccttagccttctgagtagctatctttaggaattttgattaagcattggacttggactcccagcaagagatttatttaggaagaactaaaccgccaaactaatgacagcaaaggattgtgaatctgccctgccccattctgaaatggaataatagaatttggcacttgaagaggccttacagggattagctccaactttccattatgtctgtatcttcttgccaatatgcctgaaattagatctcaagatactacattatatagaaatgacaaggcagtagaacacaatgacatctttcctcacttaagacctagaagtctgcttaaagaggggcttgggtccatattggaagcataaactcatgacataaacagtcatctaagatttgctttgaatgtttatcattcaaaagttatattgaattttttcaatgtaatagataaatctaaattagtaaaatgatagaattaaactgccaaaagctgtcattaattaccaaaacactgttatgaaaatttcacaaaaggcaacaagcaatgcaactcccaaattacagagcaaatttctattgctctgtgtgtgtgtgtgtgtgtgtgtgtgtttgtgtgtgtattctgtgccactctttgacagattgaaataatgcaattaaatattttaaaaataaaatttctatgctgtccatctatcttgatgtaatataacacagatgatccaattatttaaacatcaacacaaaaccaatgaatattctttttacagtttctacaaaaacctaggcaggttaaaaagacgtgcttcattttgaaacaatgaacttgtgaattatgttaaagcaaacataagaattacacaatgggtttacaggaaaatttgacagtcaatgggcaaaaaggaacaagtttgccagagatttatttaaaattgaaagcaaagttgaaacaaaatactgcagcaaaatttatttggcaaactttatttctcctattactagtggagaacacatttgctctctacctaagtgataacccaggccttctatatcagctctaccttatggacttgggaagacacatacaacctgtatgagcagttatttgtgggccaaaaaaaaaaaaaaaaattaaatcaagatctattcttccacccctaaaacctaactgttggtaataatttaatttatatagcataagtcagaagggttgtaatttttttcagcaaattctatttcctaaaagtagggtggcattaaagaaaagtttgacattcaatttagtaatagatgctttttaagtatgatagtcaaagatagtctctctatgtttttcccctctttcatgaaatttttctatcctgaataactatttaaattgggtcttttatttatctcaaattatctttagtagtcagttatgtttattttccagggtatgaatattttattgagaaaaattaagttaatgaacccggaagaatgctgttctgactgctacaaactcagtagccaaatgcatctcggtagtacagatgcagaagtggggccacaggaaatctcagttattgataacttttttttttttttttttgctattgctgaacatcccatccaagggaagcattcatttaaacacggtccatttccatggatccatgagtgactggaacacatatccacaattttgctgatgcttttataattgtgaaaatggataatagagagatgtatctattgaaatatttatactttattcaaggatatattcattttgaggctcatgagcaagagttggtaaaaattacagttcagtctatagtcttgagaaatttgctaatctcccagatcttaagcaaaaagaaaaaacaagcaaaccttttgcctggccctaaacacatctaaagctgcttggacaatcatcctagctgttgttctcatatgacttatagcagataagcagattaggtatataaaccataccactttttcaaaaattttcaatcatttagaaatagttactcatggaaataaattttgacttacaaatttcttggtgggtgggaaagcaaaattaagagaaggaaggtgtgtgttggagcagacggaatatagatttactcatatgggccctgcaacagaaagtgaagaaaaatggaaaagtcttagatatgtgagagtaatttatcctcttccatattttctgactcaagttggctagtgttgggtcaccaacactgtagaggcaccctctttcacatttcttgcctaatgagcatatggctcatatttaatctggaacctacctagttgaataaagaatccagcaggaggccgggcacagtggcttacacctgtaatcctagcactttgggaggctgaggcaggcagatcacttgaggtcaggagttcgagaccagcctgaccagcatagtgaaaccctgtctctactaaaaatacaaaaattagccaggtgtggtggtgtgcacctgtaatcccagctactagggaggttgaggcaggagaatcacttgaatccaggaggtggagcttgccatgagccgagattgtgccaatgcactccagcatgggcaacagagcaagactccatctcaaaaaaaaaaaaaaaaaagaatacagcaggatagtctgttttgtatcttcccagtagggcataccacctggctttcctccagaataaaagataatcaagctaattatgtgatactgtcagtttgctccaagcctttgtttaatgactggctctcctgtggtaaaagtggggttctgtatgatggcatgcatatgcaatcaagagagctgggagatgcttatcatagaaatgacacactcttctatcttgttcaatagcatgagatgatctatttcctatagattattaaagatcctggttttgaatctctcaatttttattgctaataatgtcccaagtagcttgataagcaagcttcagtgctatagtgcttaaatttaaccaaactgaagcactattttattacatgagggaatctttttgtcaacaacacaagaaagtcaaataatacagcacttgtaataattacaaagcacattgtgctactttaagcacctcttgttctaaaattgcaaataaaactttatgaaaaagcattttaaccccattttgcagatgaggaaactgaggcacagagaggttaagtgactgggccaaagatacctgggtcagcagtaaatgtaagaacaaaaagtgggaccccagcattctagtttttattgtacattcttcagttattgttctggctttgcaaatgccagtgctaaaactgaaggatgatagtgaacccacatatggaaagatttgtatagcatttcatagaaagagtttctggctccctacacatattctctatgcatgggaattctagccccataaataaaacttcaaaaatttgaaaaattgaggttgttctgttatctacagtaaatgaggtgtaaaattagcttttcaggaacatacatttgctctcagagatgactccaagactcagtaatacacaacttaggaaaagtaccagtcctctaattgtctctggtagaaaatgaccttgtcagtaacataatgttatttccatataaaaaagtagagctatcttgttgctgtcatctgtctgggaaaaaatgttatcactctaaacaagaagaggtcagaatgctctaggcatgtgaggattctttaaaaaataatagtttagtttaatattcacatctctgtggcaaacccgactcttggtagaaatttactcattgattctgctgtgtttttgcccaaatcatatagcatattcatttgcaggcaattttaagcagccatttgaaaaacagtattttggaaatgaaagattcagagatgctctctggcccatgttccctatagatgttggcgttctaaacagaactaagtcagggagcatgtgatttacagtatcatcttcttagttttcaatatgaatgagatcagtccattgttgatagaggaatgcagatgtgagagtaggacaaggaagcatcgaatctgcttttatttcacatgtcacattcgctcgggtcctttgacttcgttaccagttttgttgtggtcactgtgatccacttctcatctgtcgtctgtggaatgaattccacaagctccaccttttgcagaaaaacaaaacagagagtgtttttcttcccatttacgatgcggatgtctctgttcctgagtttaaaacaatcataaagacagaaaagcaaatccctgtagtaagaaaccagacttttcaaatgaaacattttattgtaaatagctcttcataggtattcctcgtgcttcactccccacccacccttgttttttttgtttgtttgttttgatcttttaaaatgatgtttattatcaggactagtgtttccatggggtgtggtgttacattaaaatgacccccctgcacagcaggggttgaatatttcattgtaactttggttccatgcccaagacacatctttgcttgatctgcagaaactagttccattgctgaactttttctttacacaatatatgtttatagttcttctcttctgatttgacatatacatgtttcattaaatgcagcatatattgtagattttcaacagggttgtgtaggaactgtcaagtaagaaaccttgaataatggctttaaaatacacagttgtagtcctggctacagggtagttcttagcttttgatctccctctcactggtgtaaacaattttgccatctttgaaggtttagaagcacttgtcttcctgggatcttatccatgttttcggttactctgcaaaacagaggaaaaaaattatttatatatcaattttgttaatagctgaatcataaaaaacaaactttaaaaaaagacacaaattttttattctttaccactgctttgatgtgtatgatcttatgcaagttacatctctaagcttagttactttaattttaagggagaaaatagaagtctctatgtcaaaggttgttgcaacacaatgcatataaaacaattaatggttcttgtctcaaagtaagttgcctgaaatattattatcattactgctttttcctctgaggccttccaaggtgatagctaagaagttaaattgaataatcatgccccaacatatccatttaagatgttattttatttttgaaacttattttagattcagaaggtaaatgtgcaggttggttacatggatatatttcatgatgcagaagtctgggcttctattgaacccatcacacaaaagtgaaaatagtacccaataggtagtttttcaaacactgccacttctctacctccccacttttgaagtctccagtatctactgtttctgcaagatgttattttaatagcagacctgtctattcccttcagtgacttaattctatgtcacatttcctccccaacaaaattgtaaccattggcaaattgtctccacctaaagtcctgattgaagaactccctgggaattctgccacacaggtttcttggttggcccagagatgtccctgaaaaggtgctaccctggggatgtgccagtcaggactcctagccctgttcctctgtaagtccatatgtctgagttttcacttgtgtagaagtctaggtcgtaatgctgtcttccaatgaaagccagaaatagcacagaagatgtgctatgaggttgtgctatcatgtcctacttaagggaatggcctttagggtctgaacaacatggatagagaaaatgggatttctattttcttgctgtatgcccaaagctaatttatttaacttctctaagcctcaatctcctcatctataaaataaggatactgattctgtagaaagactttactattattccagaaatgttaaatccaaagttaaatgttaaaaccacaatctaaagtggaggaaaaggaggcacttagtaccccaaggatacttctagtctaccaaccaggggcaacttaaagatccaaaggcatatttgcagagccattttgctcccaagacaaggttagactgggatggaagagtgacagagtcacagaggagaacctgtgggaaggaagtacagtggtcggggagagatcacactgagggaatgaggaggaggtacgaagaggcgtaaagatattgatggtggattcacagaggcatacttgcctcctattgctcagacatagactttctcatcttcccttgcttatatgtgagcagagaactgaagagtgatgacagggcagagacaggcgctacagcgtagttgtctccttgctccacactccatcaaaaagctacctccttagcaaaaagctgtgggttgcaccaccaacgaagggagccagtgaggcagtggaagagtctgggccttggccagactgggaatagggcagtgggcatcccctgcacacccttctgaagaattcacacatatgttgcccagaatggccagcctttggtcacctctcatagaaaagatatcaagtgttggtcaacagtagccaaagaaacatctgcaatcactgtcaaaggagctgagagggagaatccttttccctcttcttcctccctgctctccagaacggctgagccttgaagaggaagagaagaggaagagttctcgtagagtcagaccctgaactacagctccatgggggtacttggctcatgcctaagggaggataagggaagaaatgagaataaaacagagtctgaaattgaacttttaaactggcttaagacttttgaggattgaaagtgactgagaagttgggggaccaacctaatatttaattaaaagatgagagagggaaataagacagagcctgagtgaagaaagctatgatttgagaaaatagattgagtacatatttacattccactgggatgagagccccaaataactagttacaaacacaacattctcctattccatggtaaataagagagttgatctgaatgtatataaaaaattcttcagggatgtatttttgtttgtgtgtttttaaatatagaataaatatacaaacacaaaaagtcttttacttgcaaactttcaatgtatagcatatcaaagattaaatcctatatattgtgtcaaagcatgtatgcatcatttccacctatcacaaccgaggtaaaacccctcatttgagtaaacacatgttggttttaaaaaccaatggacttacaggcagtccaggcagtctcctggaatgttaagtttctatgaattgagaagtacttgtaaaaggaactattatttctatagtgaagccagatttattcaaattagcattctgagttattgcagttacccagtgggtaacaggagttctttttaacaggttgcataacagtgctacaatttagtttcctcatctgtggaaaacagcaattgccactatcatttttgagactttactgcatgctacaaattctttttttttctttttgatacagggtcttgctttgttgctcaggatggagtacagtggtgcaatcttgtctcactgcagcatcgacctctggggcttaagccatccttgcacttcagcctcccaagtagctggtactacaggtatgtgcccccatacccagctagtttttgtacttttgtagagatgggatttcaccatgtttcccaggctggtcttaaactcctgggctcaagtgatccacctgcctcagcctctcaaaatgctgtgattacagagccactgtgcccagctaatgccacaaactccaagtcttgagtacggtgatgtggcttctgacttgtggttgtagcatctgtaagggcaccaccgtttaaccagttacaccatctaggaacacaagggccatctctgacaccttccactcctcaccctttatatgcaatttgtcataaagtattcaataaatggtagctattaatattacctccacaatacagatgagtacactgagactgaagattattaaataattggtccataaaaatcctggtagggaagacataataatattgtatgaaatgtaactgaagctggaggatcagggaaagcttccctgattttccactgagacgggaaggatgaatgggtatcaaccatttaatggtgatgtgggaaatgtggtcccagaagatggaagcacatcttgaaaggcatgattcaagacagaatgcttggtatgtctacagacttgacctttaatgagcctttctatgtgccaactactaaactagttgctttacctgtataatattactcaatcctcagaaaaataatgggtgctattacttgctaattttttatattagaaaattaacgtttggagagtgctatattttgaatgtttttgtcccctccaaaattcatgctgaaagttaatccccagtgcaagagtattaacaggtgaggcttttaggaggttattaggccatgagtgcagaatggatgagggattagtgccttatgaaagagctggagagaactaacttaggctcttttgcccctctgttccttctgtcctgtgacacagctttgccccctccaggggatgcaacaacaaggcgccatcttggaagtagacaccaggccctcaccagacaccaaacctgctggtgcctcgatcttcaatttccagcctccagagtggtgagcaatacattactattactcataaattacctagtctcaggtattttgttataatagcacaaatggactaagacagagagttataatggtctccattatgcagaattgttgtaagtattacataaaataataaatataaatgtaccttttgaactgtaaagcaagttgtactctccttccttattgaaatatcattaatattattttaaaagtatttattgattgttgactatgtgctagacactgttggttatgtgctaggtatttggtatacaaggttgaacaaaattatatggtcattatctgcatcaagcttatttacaatgagaaagagtgacattaattaaaaaaatgtgtatttatatatatatttccccaatgtatgtaaaatttgttcagaaaggaagtcaagaaagatgcccttgtgggaatcacaactgaactgagatccgaaggataggtgagtagtaggtgtttactagttaaagcagaagggaagcattctgtgcaccaagtcagcttgggcaaaccctgtggaaggcaggaaggcacatggttcattaagggaaactggagcaacaggaagcctgagagattgcccgtgtggttagaccatgcagggctttgttggccaagttaaaaaattcaaatttgatctttttttttttttaacttgttatcaatagattggttgaaggaacttgatcctaacacagtgatattttcctaggatgggggtcaaggtaaggtttgcctttctaaaactcactctaactgctgtgtggagaatgagttataagaatgtctatagtggaagcactgagcccagttagtgggctacttcagctgtggaggaggggataatatatttgtttatgtcctctttcctttgtcaatgcattctttaaggtagtcttcaaatggtatataaaaaaacaaattgaatatgagttatctttgaaagatacgacaactctattcatggttctgatctaacatatcccaaatctgctttcatattcattttcccagctattcattcatccatctgcctctcagttcatctgtcaatctgaaatttattctgcacctaggatagataaggcactgttatagacactaaagatacaaagatgaataaaacataactcctaccctatgctttattagtacaatttgtgagacaaatagggaaacaatttatatatgactggataaagctaatggatatatttacacaaaaaggaattactaactggcataaactgattcatcttagactttccttatccatgtaaaaactaaggagtaaaattttcctactaatactttatttttttggtggggggatggagtcttactctgtcacccaggctggagtgtagtggtacaatcttggctcactgcagcctctgcctcctgggttctaagtgattctcctgccttagcctcccaagtagctgggattataggcacggaccaccatgcctggctaatttttgtattttttttttttttttagtagaatggggtttcatcatgttggccaggctggtctcgaactcctgacctcaggtgatccgcctgcctcagcctcccaaagtgctgggattacaggagtgagccaccgcgcctggccgatcgtactaatactctaaatgacgaatataatagagactggtcatgtggccatttgttttccccaggctacctgagtaaatatttgcacgttttaacaaataatacagtacttaatttttcttaagtttttttccattagaacaataacatagtattatgtgccttttaaaatttttcatgttattagacaggaagtaaaaatattgggctgtcaagttcaaaaatttatggttaacactggagaaatatcattaaaatttatatacatatatctccaaatgcatgtaaaatttgtccagtgggggacagtaaaaatgagctaggccagtgtatgtggataaataatcatgatcacctgttctgtggtcctcccaacttcataatgagcaaaactggtgctgtcatgttcttcattatttcatccttgctcagaaaaggaggattttcaatgggtcattgcaacctgggtatagcagctaatctggtgatagctatttttgtattcctctaatttttttctttcctttgtctccctgtgtaaccatgtaatgtgacacaatgagtcgttgctatggcttaaatgtgtctcccacaaagcgtgtgttagaaacttaatccctagtgcaacagtgttgggagttggaacctgatgagaggccatgaaggtggagtgaatgcctagtaactccaggtccttcagcctttggactctgggacttgcaccagcagcctcctggggctctcaagcctttggcctttgactgagagttacacctctggcttccttggttcttgggtcttcttattccttttttttttttctttattttttgagatggggtctcattttgtcgcccaggctggaatgcaatggtgcgatctcagctcactgcaacctccacctcccaggttcaagcaattctcctccctcagcctcccaaaagtagctgggactacaggcgcccgccaccacgcctggctaatttttgtatttttattagagacgcggtttcaccatattggccaggctggttttgaactcctgaccttgtgatctgccagcctcagcctcccaaagtgctgggattacaggcgtgagccatcagcggttcttgggtttctgatttgaacagagccatgttgcttctctggttctccagcgtgcagatggcttaccatgggacttctccacccccataaccaggtgagcgaattctcttaataaagccgctctcattttcatctatctatctatctatctatctatctatctatcatctatctatgtatcatctatctatctatctatgctattggttacctctctggagaacctgactaatacattgatatgccattcgtttggaaaaccagaatgcatagccagataatatcttctggaactacttggagtccccttgtttaaagtaaaagtcctgatataatccatgcagttatttagtcaatgccagcactgagtccagtaagggtgccttctagggagcgttcgatggcttctatatcattactgacaataatgacttaggcaattactaaaagaaaaaaagtaggagtctctccattttaaggaggactttgtcatttaagctagtcttgggtttatgaacacaatacaaatcattaatttagtatggaaaaaaatttatcgtaatttgcagtaagctttcactacctaccaataaagaagcactttttcccttacttcttcctatttctatcttgccaactttggagacataagtagcattgatcagttttcagtgatgttttattccctaatattatttaaagccagattattccctgagaagaggagatgaaaaagcaactatttgtttgggtttaggctgaaaactacttggcagtactagaggttataattttgaatttagtataattttgtatactagaatactagtataatttagtgtaattttgaattcagtaaatgtggtagctaatttttaaatctaataatagctaagagttactgattaatgattttccaggcactgttatgcctttgacatgcataacctcgtctcattctctcaacacaacaccctgctgtaggtaacatgattataaccattttgtggaataggaaacctaatcttgggtggattaaataaactgcctatcatcacacaactagtaaatggcaggactcaagctttaaattatatctgacttgtaagctgtgcactctaacctctcagccattttactgcatatgcaatatatttattgcccagattcactgtcacattcatcggctatattattaattatcattatagtcattcacttaacagacaattactaagtgtcatttatgtgctactttggaggaaaaacatcaaatcttgtacatccctcaaggagttacacaaaatgggaaaaggtacagagacgagcacactgtaatttcaaaagccagtagctaagtagtactatacaaatagatgacgcttctgatgaggatacatatgaacgccaatgttgcttgaaacatgggagaaaggcccttttttacttgtgaggcagtttggtggttagaagtggattctgggctgaggctgcctgggtacaaattggtagctggatggtcttgggaaagtcacatgctgtagtttctccaactacaaattagggataaaagcaatacctatcccacaggggatttcatgaggattaaatgtatctattacttagaacagctcccaggacataatcagctttggccagcattgatgttaatgctgaagcctatccattttctacctagtacttacaaggtttgatatttcttctgtaaaccaccatgtattacttgtctcttactgaaatttattttccctacttttaaaatttatttactgttttttttttttttttttttttttggtggggggaggctgtttgtttcctgatactctggtcattttgatcctttactagtgaatctccctccacttcaatttggatattcccattcaatttaagagacttagtcctcttctttccatcctacaaggctgtcatctttcttgacagacaaaggatagtggtcaatctgaaaagaaaatattttggaagaaagaatatagccagagagtgagttatgagttcatatattttctgagcatatctacttaactctttgcttgtatcaggttattctaaagcacttttacttgtctgttccatatccaggtaacagatctcatacctatggagggagaaagtgcctctcttctgttttccaacttgctgtagaaaatgttaaatcacctgaggtccaggaaagatctcaggctaatataatttaataggataatcagagttgacatgaaccatgataaatggatttagaatagccgctggcccttcttctttttgaacagtggtattgagatttgtggtttccctatttggccggccatcagaatcacatagcgtgcttgttaaatacagaccagtccttgctctcatctctcccaccctctctctatctccctctatctccagtgatctgactcagcaagtctgaggtggggcttaaaaatctatatttttaagcactgggaatcactaagattatttatgcatgtattcatgagacatggacttaataatagtaattataagactctcctttttgttttctatattgacattgaaaagtaacttatttgaaaacaagatccacttagcctgctttcttgagttttaatgaactccctagtctctactggggaaaaggggtgaaaaaaacagcagtcattactagcttgttagattagcagaatcagaattttcaagctgaacgcaacactaaagataacgtcattatttattcactttgcagatacagatgcaactttctgcataatgggagactatgatgagaatgctaacaaccacagacattgtgacttcccaaagtaatacagttaactggaacagattcttgattcccagaatatttggtttcttcacttttctaataatcacccaaatagactggatctatttctcaatttatggcatttatgctaaccaaagcaagtgtgtttgtattttaaaaatatagcatagttaaaatatatagaccaggcctgatggcttggtcaacactttgggaggctaaggcaggaggattgcttgagctctgaagttcaagactaccctgggcaacaaagtgagaccttgtctctactaaaaataataataaaaaaaaattagctgagcatggtgacacatgcctgtagtcccagctactcaggaggctgaggttggaggatcgctttgagcctgggagattgaggctgccagtgaatgatctgattgtgccactgtattccagcctgggtgacagaacaagactctgtctcaaaacaaaacaaaacaaaacaaaacaaaacaaaacaaaacaaaacaaaaaactaaagaaaggcatagtaactataggtaacatcctttttatcaaatacctcttagaaccacattttgagaattaaatggaatcttacctttaagaggcaccttgacatcaaggccatagaataaaggcaagagagaagaacaagaatagaaacagaaactgcagaagaaaaagaagaagattatgtaaatctgaatttctgtagtgccattcaggtagtacaaaacctcagcttttccatattgctcaagtctaatcacttcacacatgaacatcaagcacctttttgtttaaaaaaatccacaccttttatgtagctactgacagagtatcagtgttcaactaacattgattcatacattttagaatcatgaggtggtcttacgaacaattggtctaagctcctaattttacagataagaaaaataagcacagagcagtaaatcaatagtttaatttcatacaattttatggcacagtgagggctaaagcttagctagcctgaatcctactttattatatatcactgtctctttcatgcacaagagggtatttcaaaaacacaaaatacgatcagaacatacacttaatcatgcagtactatcttttttggttactatgataggttttaggattaaggcacagctgggagaatattaatctgtaggctaaatatatacttaattactcacagtggaacatttcagagagagaaatggacactgttaataattacattgggttgatgggtaaaaactgggtctgtcctaggcaagtggggacatctggtcatgctattggtataaaacctgcttctgcatcaatgggcatttcacataataaatgcgtgatgttgttccacctccaagatagacttcttcttatttgagtcatggaagttaaatggagtctgatttgtttctcttcaccaaatttttcacttgagaaacagataattggatggacaaacagtgcttgagtagcacaggtatataactaaccgtatactaactataaaaagtcatgggtcaggtcagttttaaaaaaaataattgatttccttggtggttttattttacagagtaagtcttttacttgattatcacactccaggaacataccgttggacacatctgtgaataagggttatgtctggcattctcatattgtgaatgttattagcatatttcctttaatgctactgcttataaggttcttgcttcactatggctaaattctataaacaagttatgagtatggctctaagaggcatgtattggtggctagtctattattctgaaaagcaaaaactgttgcttttcttcattccttgaaggtagacttatagcaggagaagttcgagaatgagagtaatggacgaattcccattcctgctatttctatgagaagatcagatatcagagctacctctttgggcatgaggagatgcccatcacttaatctgtaatgagagtcttaatccctgccgtgtggtgggcagatcatgccatttggagtcagacaccctgacctctggttttgacttgccataaattggttatataattttgggcaagttgtttaatttctttgagccattgttttattatttgtataaaaggggatcataacatctgtagtgtctgtctcatagagtaattatgagaatcagatgaaatgatggcagtggaagtgctctagatatggtgcatacagatattatgctctagataagtgctgcacacagctgaagcaattttgctaggtttgttgttaccaactgattcactgaaataaacaataaagaggggatattacatgtaccctgagtgggtgttcacgtaccacaagggaagaatgaagagtatctctggcatacaggatctttagcctttttactagacttaagggtgaggagaactgaagtccaatgagtagaaggtgaatcataaacctcatctctagtcaaatatctaatcagaagtcaactggattgtttttgaagtggttgaatttgctaccatatgtgaaatatgcaaggttgataattagatccttattttctttgaagtaagattattaccccattatcataaaagttcaggaagttcagacccgtaaagtgtactgagcaaaagaattgtgaaaaagtttacattgaattccaacaatgaacatgatcttaatctcccttcttccaaaatttttgagggttttatttagagaatggctagggtgatgacgttgatagattttgttttctcccctttttgttttttttaaacctcagctggatggggactgaatgggtatcatcgagttttgggggaagaatagccttaactttgacttcttccttgagccagccctagggtagcttatgaattagcagagagagagagctaagagctggccattcacaagtgtggaaaatggaagatattaagtgtggtctttgacaaacagggaagctgaaagcaatccctgccttctgtggggcttcctgccaatcactgggaaatttattgtatgttattgttgcctcactcaatcctgcaaaactaaatagccccttctgaaatgtgagaaattcaaatttaaaattttgcagagaatgtatactttgggtcagaaattttaaaaattacacttttagaatttgacttacacatttttagtgtttcctttttcacataagtgacctcatttgttcctcatggaacccatgggaagaagaagggacaagtgttatcatccctgttttagagatatggcttagacagaggaggtgaagttatttacttaaggtcaaatgagtacctgaagacccaccctatataaaaatctggatgcctggtggtctagctacttgagcccaccaactccctttaacctcacatatatggataattatagaagcaatctgggattaaccaaattttaaccattattgcaggaagggcagatagtttgctactttcttcttgtgtgcctatggaagctattataaaacagccataacattttaccatacagggattcaggtagctactttcagtcaatctgattggaattccagagaaaaacctctttggcatccttgctatttccctcagcagaatattcctggtgtcttgggccagacattttattattattattattattattattattattattattattatactttaagttctgggatatatgcgcagaacgtgcaggtttgttacataagtatacatgtgccatggtggtttgctgcacccatcaacccgtcatctacattaggtatttctcctaatgctatccctccccttgctccccaccccccgacaggccctggtgtgtgatgttccccaacctgtgcccgtatgttctcattgttcaactcccacttatgagtgagaacatgcagtgtttggttttctattcctctgttagtttgctgagaatgactgtttccaacttcatccatgtccctgcaaaggatacaaactcatcgttttttatggttgcatagtattccatggtgtatatgtgccacattttttttttttttttttttttttgagacggagtcttgctctgtcgcccaggctggagtgcagtggcatgatcttggctcactgcaagctccgcctcccaggttcatgccattctcctgcctcagcctctccagtagctgggactacaggctcccaccacctcacccggctaattttttgtatttttagtagagacagggtttcaccgtgttaactaggatggtctcgatctcctgacctggtgatccgcccacctcggcctcccaaagtgctgggattacaggtgtgagccaccgggcctgggcctgtgccacattttctttttccaatctaacaatcatgggcatttgggttggttccaagtctttgttattgtgaatagtgctgcaataaacatacgtgtgcataggtctttatagtagaatgattcataatcctttgggttatatatccagtaatgggtttataatttataatcctttgggttataaatccagtaatgagattgctgggtcaaatggtatttctagttctagatccttgaggaatcaccacactgtcttccacaatggttgaactaatttacactcccgccaatcatgtaaaatcattcctatttctccacatcctctccagcatctattgtttcctgactttttaatgatagccattctaactggtgtgagatggtatctcattgtggttttaatttgcatttctctaatgaccagtgatgatgagctttttttcatgtttgttggctgcattatgtcttattttgaaaagcgtctgttcacatcctttgcccactttttgatggggttgtttgcttttttccttgtaaatttgtttaagttccctgtagattctggataacagccctttttcagatggatagattgcaaaaattccctcccattctgtaggttatctgttcactctgatgatagttttttttgctgtgcagatgctctttagcttaattagatcctatttgtcaattttggattttgttgccattgcttttggtgttttagtcatgaagtctttgcccatgcttatgtcctgaatggtattgcctagattttcttctaaggtttttatggttttaggtcttacgtttaaatctttaatccatcttgagttaattttcgtataaggtgtaaggaaggggtccagtttgagttttctgaatgtggctagctggttttctgaacaccttttattaaatagggaatcctttccccattgcttgtttttggcaggtttgtcaaagatccgatggttgtagatgtgtggtgttatttctgaggcctctgttctgttccattggtctatatatctgttttgttaccagtactatgctgttttgtttactgtagacttgtagtatggtctgaagtcaggtagcatgatgcctccagctttgttctttttgctaggattgtcttggctatatgggctcatctttggttccatatgaaatttaaaacagttttttctaattctgtgaagaaagtaaatggtagcttgatgggaatagcattgaatctataaattactttgggcagtatggccattttcatgatactgattctttctatccatgagcatggaatgtttttccatttgtttgtgttctctcttattgccttgagtagtggattttagttcttcttgaagtggtccttcccacgtaagttgtattcctaggtattttattctccttgtagcaattgtgaatgggagttcactcatgatttggctctctgtctattattggtgtataggaatgcttgtgatttttgcacattgattttgtatcttgagagtttgctgaagttgcttatcagcttaaggagtttttgggctgagacaatggggttttctaaatatacaatcatgtcatctgcaaacagagacaatttgacttcctctcttcctatctgaatacactttatttctttctcttgtctgattatactggccaaaacttccaatactatgttgaataggagtggtaagagacagcatccttgttttgtgccggttttcaaagggaatgcttccagcttttgcccattcagtatgatattggctgtgggtctgtcataaacagctcttattattttgagatatgttccatcaatacctagtttattgagtgtttttagcatgaatgggtgttgaattttatcaaaggccttttctgcatctattgagataatcatgtggtttttgtcattggttctgtttatgtgatggattacgtttattgatttatgtatgttgaaccaggcttgcatcccagggatgaagccaatgcgatcgtggtggataaggtttttaatgtgctgctggatttggtttgccagtattttattgaggattgtcacaacgatgctcatcagggatactggcctgaaattttgttgttgttgttgtgtctctgccaggttttatatcagaatgatgctggcctcataaaatgagttagggagaagtccctttttttctattgtttggaatagtttcagaatgaatggtaccaactcctctttgtacctctggtagaattcagctgtgaatccgcctggtcctgggctttttttggttggtaggcaattaattactgcctctatttcagaacttcttattggtctattcagggatttgacttcttcttggtttagccttgggagggtgtatgtgtccaggaatttatcaatttcttctagattttctatttatttgcatagaggtgtttatagtattctctgatcgtagtttgtatttctgtgggatcagtggtgatcccccctttatcattttttattgtgtctatttgattcttctctcttttcttgtttattagtctggctagcggtctatgtattttgttgattttttcaaaaaaccagctcctggattcattgattttttgaagggtttttcgtgtctctatctccttcagttttgctctgatcttagttatttcttgtattctgctaacttttgaatttgtttgctcttgattctctagttcttttcattgtgatgttagggtggtgattttagatctttcccactttctcctgtggggatttagtgctataaatttccctctaaacactgttttagctgtgtcccagagattctgttatgttgtgtctttgttctcattggtttcaaatagcttatttgtttctgccttaatttcgttatttacccattagtcattcaggaacagattgttcggtttccatgtagttgtgtggttttaagtgagtttcttaatcctgagttctaatttgattgcactgtggtctgagagactgtttgttatgatttctgttcttttgcatttgctgaggagtgttttactttcaattatatggtcgattttagaataagagctatgtggtgctgagcagaatgtatgttctgttgatttggggtggagagttctgtagatgtctattaggtctgcttggtccagagctgagttcaagtcctgaatttccttgttagttttctgccttgttgattagtctaatattgacagtggggtgttaaagtttcccactattaacgtgtgtgagtctaagtctctttgtaggtctctaagaacttgctttatgaatctgggtgttcctatattggatgcatatatatttaggatagttcgctcttcttgttgcatcgatctctttaccattatgtaatgccctgctttgtcttttttgatttttgttggtttaaagtcggttttatcagagactagaattgcaaccccagctttttttttgctttccatttgcttggtaaatctttctccattcctttattttgagtctatgtgtgtctttgcacatgagatgggtctcctgaatacagtacactaatgggttttgactttttatccaatttgccagtctgtgccttttaattggggcatttagcccatttacatttaaggctaatattgttatgtgtgaatttgatcctgtcattgtgatgctagctggttgttttgcccattagttgatgcagtttcttcatagcgttgacggtctttgcattttgggttgtttttgcagtggctggtaccagatttcctttccatatttagtgcttccttcaggaactcttgtaaggcaggcctgatggtgacaaaatcccttagcatttgcttgtctgtaaaggattttatttctccttcacttatgaagcttagtttggctggatatgaaattctgggttgaaaattcttttctttaagaatgttgaatattggcccctactctcttctggcttgtagggtttctgctgagagatccactgttagtctgatgggcttccctttgtgggtaacccgccctttctctctggctgtgcttaacatttttttccttcatttcaaccttgcttaatctgatgattatgtgtcttagggctgctcttctcgaggagtatctttgtggtgttctctgtatttcctgaatttgaatgttggcctgtcttgctagattggggaagttctcccggataatttcctgaagtgtgttttcaaacttagttccattctctccatcactttcaggtacaccaatcaaacataggtttggtctttacacatagtctcatagtctcatatttcttagaagctttgttcatttcttttcattcttttttctctaatcttgtcttcacactttatttcattaagttgatcaatctctgttatcctttcttccacttgattgatccagctatggatactgcatgcttcacgaagttcttgtgctgtgtttttcagctccatcaggtcctttatgttcttttctaaactggttattctagttagcaattcctctaaccttttattaaggttcttagcttccttacattgggttataacatgctcctttagctcagaggaatttgttattacccaccttctgaagcctacttctgtcaattcgtcaaactaattctccatccatccagttttgttcccttgtttgcaaggagttttgatcctttggaggagaagaggcattctggtttttggaattttcagcctttttgtgctggtttttcctcatcttcatggatttatccacctttggcctttgctgttggtgaccttcggatacagtttttgcatggttgtccttttcattgatgttgatgctattgctttctgttagttttccttctaacagtcaggcccctctgctgcaagtctgctggagtttgctgggggtccactccagactctgtttgccggttatcaccagcagaggctgcagaatagcaaagattgctgcctgctccttcctatggaagcttcgtccctgaagggcacacgtcagatgccagccagagttctccagtaggaggtgtctgtcgaaccctcctgggaggtatctcccagtcaggaggcacgggggtcagggacccacttgaggaggcagtctgtcccttcacagagcttgagcgctatgctgggagatccactgctctcttcagagccagcaggcaggaatgtttaagtctgctgaagctgcacccacagctgccccttcccctaggtgctgtgtcccaggaagatgggagttttatccataagcccctgaatggggctgctgcctttccttcagagatgctctgcccagagaggaggaatctagacaggcagtctggctacagcagctttgtggccctgtggtgggctccacctagtctgaactttcccatggctttgtttacactgtgaggggaaagcagcctactcaagcttcagtaatagagaatgcccctccccccaccaagatcgggcaccccaggttgacttcagactgctgtgctggcaggtagaatttcaacccagtgggtcttagcttgctgggatccatgggggtgggatccgctgagcaagaccacttggctccctggcttcaggcccctttccaggggagtgaacggttgtgtcttgatggcattccaggtgccactggggtatgaaataaaaactcatgcagctagctcagtgtctgcccaaacagcctcctagttttgtgcttgaaacccagggcccttgtggtgtaggcacctgagggaatcttctggtctgtgggttgtgaagaccatgagaaaagtgtagtatctgggccggagtgcaccatccctcatggtgcagtccctcatggcttcccttggctaggggagggatttccccgaccccttgcgcttcttgggtgaggcaacaccccaccctgctttggcttgccctccgtgggctgcacccattgtctaaccagtcccaatgagatgaaccaggtacctcagttagaaatgcagaaatcacctgccttctgtgttggtctggctgggagctgcagatgggagctgttcctattcagccatcttgctcgggaattccaggctttggctttttttgttgtgcaagcctgtgtagctcgctgctgcttgttcagcatcccagcctgagctctgtctgttctcccaccccacacgcatttccaagtgccctctgtaagagccatgttgttatatccctcaaaaacactggctgacttggaagaagcagccactctttgagatcactggggaagtgacaggacaacatgattatcatatatcaacccaagtttctgaatttactgttaaggtgaaactgcagcacaaggatgaaaggtctttttatgaatgataatgggaaaggtaaaacaaaggtgctaaaagatttttttaaaaaaagagcaaagtagggtaacaaaacttgaagaaacttttggaaaggaaatgaagataaggaaggggaaactaaggaaagaaaacacagaaaaaataggaaagcaacacaaaagacaaatatgtgaaggctgggttactgatggcagacgctttgctggcattctgtttgactgaaggtgaaagctaggtttactgtaactatacctgcctctgcaagacacacaataactgagaagccaggaagaaaatacagtgagcaaaatcaatattgctttctgattaaacaaataataagatagttattgaatttgacacctaccttttcttctaagtcttttatttgtcttttctggatgtctgttttatcttctaagtcacgaattctctgaagaaagaaaagaaaagaaagaaagcatcagtaggtggtaagttgtgcggaaaaataatttaccaaatgaaaacacgaaacttcctatacaaacctgaatatttgtacaagcagctggaaacatcgcatgtatgttttccccacccaaaaacatgttgcatgtttcagaaattatctatgtttgtggtagaaaatcattgctactgattaacttttcaaaaaatatttgccaccttttctactgagcctatccctgtagaccccttcctagtgaggtgtagattccacaccactgacattgagtttggcaaagagacttgttttggcctgtggaatgcaagttggaataagatttgggaatatcaaatccttgtagagggtgtagtatatctcagaagtagacagcaagaaacaagctttgttatgaaccatttggattgagattttgattgtttgttaccacattaaagatggttgaggctgactcatatagatgtaaacaatccaattgttctttcttaacctttttatcttaaccccatttcaaccctgtttcaggatagaattttctcacaaaatagaattggtaaattcacaaaacaaagtagagattacacatcaacaaacattcccaggagggaactggtaaattaggaaaacaccagaatataacaaacataacacaagtaatcctaaagatgaaaagttccaagactgtctttgaacttacctctcaattatgtaacaaaattccactaatttaaacaccgaatatttgaaatcaacattacataacaactatttacaagtaaaataaagtcttcacatttatatctggcaatctgaaggtttttttgtgttcatgtacatggttatataatgcaggcttcttatttaatacctctgtagggaataattagaaaatagagaaatggagtctatggagaaaacactagaagccaaatgggatgataatatagaaagagaggtttttataatgcaatggtaggagaaaaaaagggaagctagaacaaggggtacttgaacttggaaagcatatctccttctctttaaaagagtagatctcaactgtttgtctctccctgccccagccagggacatttggcagttctgcacatttttttaaagttagttaatatgtttatttattttaagttgtgtaattcagtggttttagtatattcataaaattgtgcaaccatcaccactatctaaatgtcttgacatttttgtactgtcacaactgggagtatgtgcatctagcatctactgagtagaagccaggaatgctactaaacattcgataaggcacagaacagccacccctccccctaaaaaagaataaagaattatctgcttcaaaatttcagtagtgctgaaattgagaaactcttctttaaagtaagggggctaaggtttgtgcaacaagagatggtgtgttttggtcagagtgagaccataaaggttaaccttgaaattataccataatgaatgccggagaaagggatggaactggaatgttgatggtgtgtttatacgtgtatgatttgtgtgctggtgtatatttccatagtgctgtcagtgctccatagctacacagtaaaagaataaatttgctagatatttccaccttgagtgttcacgtaattccttggcatgtctgctggatatggaggcaagtactatatggacaaaatcatgaatatgtaaaattactgcagtatccattcagccatcacatctatgcttgttgggcacctccttacatgctcatgactctgctgaatgtaatggacaatacagataaggcaccagttagttcccagtttcaaagaactatcagatccagatggaatagcaaaactaaatagaaaaggtaaacaatggaaaaaaactgaataactttgtcacccatctccaattcctagtgcagtgttaagcatggagaaggtgtccacacatatttttttgtcaaataaatgtgttatgctacatcatatgacgtatacttgatttctttttgcttcccatccctttgccatccacccaacagaaaaccttgctggatctaaaacattccttttctacctacttctttttatctctactgataccaagttcaccaagtcattgtcttcccttgtcagggctggtgtggcagcttctacctgctcttcctgccttttattttgaccatcttactccatcaatagcagccattgtgaactctcagaatgtaaaaatgatctccatggtcccctgagtttaagcgggtggggaagaaaagaaggaagagttagttgagttgtactcagaataaaactcaaactcctgcaaagccctgtgtgatgtggccctttcttagctctgcaacgtctcctcctatcaacctcactctggctctgcgtgctcctgacattctagcctttgctctgttccttgactattccaaacttattcccatgatagggacttagcccttgctgtccctgtcttctgggacacttggccaagatctttgtgtggctcatttcttggatcgtaggtatcttcagagaggcctcctctgaccagccaacctaaagtggccaatcctactcccaaactcacatacacattgtatacgtttctgcatagcacttattgccactctcagaaattgcctcagtcattgttcatttgttctgtggctctgcccctgtccctctgtgagatagatgagagtagtgatctgtatgtctttgcttaccattatactcccagcacctggtacacagcaggccctcaataaatggttgtgaatgagtgcataacagaatatagaatgtagatatcttgagcagtatgtggttcatttttaaaattttcatcagggagaggatcctgaatgggttggatcttaaactgggactggaaaaatgagaacacttggatcaatgcaatggaaactaatggacactttaggatgagcaattatgcaacaagggcttagaggtggaaaatcacagcacaagtgggaccaggatgttttgcatgagtggagagggaagtatgctctggggttgggtcaaatctggttttggagggcggggtagtcagctactgaaggacctgaagagacctgcgtaagactctactcaactggaaattggatcatggaggctttgaggcaagaatgtaccatgaggaaaaatgagaagaatctgtgatgagatgtgtgttggattgaaaaggggagagctagaactaggtcctcatggcacctgcatgtacttttaaaaatgctatttattatgatatatcataattatttttctttgtgttgatcattttataaccatctatgggtccttcgttttgtgaaggcagggtccacggtgaattctctgtctagcacagtacttagcacctaggaaaaacatttaaaagtttgactgaataaatgcatagatgatggagtcagattcacacagagaacatttggcagtacctggaagctggtggaataatgaaaggtcctgcacgtgcctggggtgacaaaaatgaacaaaatggaccagtatcaaaaacatttcaggggaaatgccagttggatgtggtgctgtattaatgcttacagggaaagaacagagaagactccagtgtttctagccggagtgatttgagatatggtaattctactgactaagacaggcagatggggagagagaagagaagtaaggataagaacgcatcagttcactcttaaacattcaagcagaacggtgtaatacatggttagtgatatactttagaagttagagtgtattacatagttatatataaaaaatcctggccaatatcttctggaataattctatgaaactcagctattaattaaaagggaagaagaagagtaagaaataactgggaaaggcatattctaatgaacatttgtttagaagatggatggaaaatgtcaatgaaactccctgaggttcagaaatgtactatcagcactactggataacttaaacaaaaccaactctttcagaggtgaagtatcttagctaaatggttaaagaaatactcaaatggaatacagtttttatcataaataaatttagataactatgagtccatcttaaaagtaaacacttcagtgtttccatgacataactcccaatttgttgaaagtaattacatgctattgcagcacaagaaatttgtgcagagtacatttttatcccctgctagaagaaaagaatgcatgaagcaatgcaatgatggcatagagtctattattaaagactttaagaagtctttccatgggtcaaaactcaaacttttgtgatggaatctgaaggggcattaataggaacatgtaggtatttatcatttctgggacacgtggcttcagaattctccacctacttgggtaatctattagcctataaaatccacaaagctcctgcctgcatctgaagtgtgctaagtgtcatgtcccccatgaattgtttttatttgcctcataaaagaacccctgcctcttttccacttaccttgattgctgatgaccacacgattcttaccgcctattcataccatctgaattttgtaccagttgtttcttatagcttctgaggattgaatactataacctgacactttcaatgctggaatccttattgaatctgtattttgaccaggacctcagccctcaactgtcaggctatggcatgaataaagagttacaattaaaaatttttgctggaaattagtagtgggtgcctattttggaccttgctgatgaatcacataagtcatggatgacggtacaatacagtggttagacacactgaccttggagttcagcagacctaggctgtcatcctgactgttgcttaccatctgtgttatcttgggcaaatcacttaagcattcttatctacagtattgttatctccaaaattgagataataaaaatacttacctcatagggctattatgaagattaaatgaaatgatgtaagtagagtccttagtttagttactgacataaagcaaatgtcagtaagtaaacagcagctgccaggctttgttggtggtgatgtttgtaatgtgaacggtccttgctctcttttacactattcggattattatcaggcttgtttacggactggagtgagcaatacatgggaagcactatttttgccctggagagtgtcctgcttccctgcataaggcagataatcagacaccatgaaattcaaagggtatttcatgaaaacgtagttctaaaaatagtagcagtattcagtccttctgaaatgccaattttctcaagattgaattattataaaactgtcatttttgtatgtgcatgaaggtagaaaacaatggttatttattttactctctgaaaataacttgtatctcctgggcttctccgtacccatactcaataccgtgtacctagtactaagttccatttgctagtactaaccctacgcagaggcagtgactcagtcctcacctgatgggcttgctgtaagagctccattctctcctgaagaatctgacagtcatactctctgctcttcctcagcatttgccgccgtaacttttctactgccgtcctcagctcctcttgctgtttttcacttaataattcaccaaacttgataacagtttcttgctgtagagcattgtacaaagtagcttctagttcctggattctctggcaaatagaattagaaaagtctaactttggaacttggcattgatatctggtgtgggagtgtatgctatgtatgtatatgtatatggctgccaactttaggcttataggatcttagcaagaaaataattttaaaacttctctagcctaattacacttctgaaaatctccttttatgagattccataagggtcatctagccaattcatgaacttctctagtgagggaacatttgttctttcttgggaccctgtccattttatatacttttcctaactgtagttcctatcctaaagtgtagctgagaataagtgtgttctcacttctacttgacagctctggccaggcacggtggctcacacctgtaatcccagcactttgggagcccgaggcaggcggatcatctgaggtcaggagttcgagaccagcctggccaatgtggtgaaaccccatttctactaaaaatataaaaaattaggtgggcgtggtggtgcgcacctgtaatcccagctactctggaggctgagacagaagaatcactggaacccgagaggcggaagttgcagtgagccgagatcacgcattgcactctggtctgtgcaacaagagtgaaactccatctcaaaacaacagcaacaaaaaacaaacaaacaaaaaacaacaagacagctcttcatacatttaaagacatctaccacggtggccatacttctggaaataaatagtctaagttagaacaaaatactgcccccgttttattaatacatgacaaacctctggtacttgaagatggctttatggtcgccatattttttcttgaaataaaattgagaaataaaatccaaaaaatgacctaaagttttggaattggtctgtttttaagttctctgagatttatggctgctctcattataatatttctctgagtctttcttttgtagatgaaggatgcactgccttcatctttttctttctttttttgatatgcttcagataacagttgctaaaatctacaatcttatcccttctaagtttgacagaagtgaccagacatgctttggtgagaaatattttcctagctcttgtcctgggctaagcaggtctcatctttttaaggataaatatggttttctgaatgagtactcagtagtctcgggacccacataaacacacaacttaatttcgtataggtagaagaggcaagggtgaaaggtagaagtgaagcaaaactcacttccttctctgtctctaattagcatcaaatacccattctcttctttccccatcaaacaagctcagaatctcttactcattttggaatgcaaagacaagttcatctttgttacaagcagggactaagtgcttcactctttccccaaaagtgactcaagctgcttccaggaaagcattataaaaacctctgctaggaattctttgaaatgttcctttaacttgctctttttcttttgattcataattgtgaattaatggagggtggagcataaggagagaagaaatgtgagctgtagttcattatgaagaagcatgcaataggaatttggtagaggggaatggatcacatgtgctccttaatcagcataatcttctgtgggagacaaaaaggcacagcccatttaccatggaagcctcagttactgtggctggattatagtaggccacaggatctggagtcagatctacacactacctatttatcaacttgggcaaagttcttatattctctaaatcttactatcctcgtatgtaagatatgaataataatcttacctatacctcacagagttgttgtaagagataaatgaattaaaaatatgcataacaaacattaaacacattattccaccactagatcagactcccaaatgactggatttggtttaataaaatttctctttaatctacactgccatccaaactgttcttcatttaatattatccaacaacatatatttaattgtttttgttttattttgttttgagacaggatcttgctctgctgcccaggctggagtacagtggcacgatcacaactcactgaagccttgacctcccaggctcaatgaatcctccctcctcagcctccttagtggctagtactacaaagtgcatgtcaccatgattggctaatttttgtattttgtatttttatttttattttttggagatacaaggtttcaccatgttgctcacgctggtcttgaattcctgggctcaagggatctgcccaccttggtttcccaaaagtgctgggattacatgcatgaggcaccacgtctggccttttaattgttaaaaaatgaagtataattaaatatttattaggtattataagaatatcttataagaatcttagaataagtaaagagctaggaatgtatttgttataaaattagatctgaaaaccagtaaatgaatgaactgcatgtcgtgatctattcaagtacatagcatggaaaattaaaaaggatacttaattccacagtgcataactgtaaatactgcgggtgtctctatcacttgttgtacctaccatatatgcttggtcaagagcttgttttctgtagtctagttcttcctccagatagccttttattttgcagaactgttcctataacaaagggccatattgatagagtcagcttagttaactagaaagtgacgtacaaatggtattgattaatgtttcctctaattctaccataagacaaatcactagtatttgtagagtcataaattttgtctgttagggaaatagttcaactctcatagtctcacacaggaatgtgaaaatcaatggaaagcagcataaaagatataatgaaaaatccacatagaatgctctaaaagatttttaatctgagagcacgtgattaagtatagattttgactagtgtttaataataataagcctatctatgtaaaagtattatgataatatatttttgtaagaatgtgataaaatgtaacatagctgggttgcataatcaacaagtttaactgattcaaattcatctgtgtacaactagcaaacataaggacaaaaatagcaacttaaagagtgggagtgattccacccacactgctgcttaatgagtgggtgtctgcttttgccacaaagccagtgtgagctgggaaaagtcaatctgatgttccctctcttgttctcagtttctgtgtgcttctcatattatcagcatcttgccattagcacttaaaactatattttgggtacaacatagtcccaagcacaagtcaattgtttctttgggtgtttaactgaaggaacaaagacttcttccaactctgaagaaaaactcaatggtgttgacttttgagagatcgtgtatctgtatggagtaattttgctgttgactttgctggtgactgctgaattccagtacctagaacagtgcctgatacagactaattgcttaattaatatttgtgtttttaaagagctttcaagggtaattttgaagagaaattgttcatttggaaagctttcttggccaaatataaaaataaaataaaataacaaactgttctttttacatgctttgacattggagcctaacctcttagtaaaatgtgagcactgtataaaatataagcaaattataagctataatgtgccacacaaatgcaagttgtttttataggattccctcatccaataggaatccacgacgttttctagttataatgataacattaatcataatcttgttataaatttctgttttttttttgagacagagcttcgctcttgttgcccaggctggagtgcaatggcgcgatctcggctcactgcaaactccgcctcctgggttcaagcgattctgctgcctcagcttcccgagtagctgggattacaggcatgtgccaccgcgcccggctaattttgtagttttagtagagatggggtttctccatgttggtcaggctggtctcgaactcctgacctcaggtaatctgcctgcctcggcctcccaaagttctgggattataggcatgagccactgtgcccagacgaatcttgttataaatttctatgcattgctgtaagttaataataaccaatttttagacttggtgagtaaaaagaaacttttaaaattgtggtaaaatgcacataacatttacaaccttactcatttttaattcatttttgagtgtatagttcagtagtacaaagtatattcacattgttatcaaccaatgtacagaatttttcatgctgcaaaactgaaactatacccattatacaacagctctatgtttccccttctcaccttctggcaaccacagtctactgtctgtttctaagttggattactctagcacctcacatgagtggattcatatagtatttacaattctgtgaatagcttatttcacttaacgtagtgtcctgaaagtacatccatattgtaacttgtatcagaacttccttccttttgaaggctaaataatattccatgatatgtatacaccaccttttgtttatctgttcatccattgatggacatttgggttacttctaccttttggctattgtgaataatgctgctatgaacatgggtgtataaatatctcttccagactctggtttcaattcttttggatacacacccagaagtggtattgctgaatcacatagtaattctattttgatttttttgagcaaccaccatactttttttcatagtggctgtaccagttttacattcccatcaatagtaaagaagggtttcaatttccccttatctttgccaacacttgttttatctttttggttgtgggaacacagggtcttgctctgttgcccaggctggaatgcagtggtacaaaaatagctcactgtagcctccacctcctgggctcaaatgatcctcttgcctcagccccctgagtagctgggaccacaggcacgtaccactatgcccactaattattttttgtagagatgggttctcactatgttgtccaggctggtctccaactcttgcgctcaagcacacttcctgccttaacttcccaaattgctaggacaggtgtgagccactgcactaggtcttttgttctactctttttttttttttttgataagagttattctaatggatgtaaggtggcttagggatttttaaaatcagagttacaccctccatttctgtaatttttccttgctaattaaataaagtggaaaaattatttagcctaagaaagaaaacataagaaaactcaattttcttcggcattagttttggatattttccaaaaactaacattttttggggggagaatatagcctgaaattgtttggtacttctggtaattttttttccatcttctgtacataaaataataatggaaagatgacaaactttcatcagtgccagataaaactggtagaggcaactttaattttccatttgccttgtaagtttttcttaatttttacaatatctcatcttgtacttaccatgtcactttccaattccatcattttctggtgtagggcagcctcagctccttcaatctgctggatccactaaggggttaacaagacaaaagtgtttgacatggctgcttgatatggtgtatatctgtgtgcccccatgaggtgctccgtctcctccccttatatctcaggaagaagactgagaactgaagcaaaaacaacacctttttttgcttgtttgtttgttttgtttttgaaacggaatctcgctccgttgcccaggctggagtgcagtgacgttatctcggctcctgcaacctccgcctcctgctttcaagcaattctctgcctcagcctcccgagtagctgggattacaggcgcctgccaccacgcctggctaatttttgtatttttagtagagacggggtttcaccatcttggccaggctggtcttgaactcttgacctcatgatccacctgcctcagcctcccaaagtgctgtgattataggtgcgagccaccgtgcctgacccacatttttatctcatagttcagaaacaagactacagtcttccttgtattcattcattcacccattcagcaaatgcatttatggatgactagcaagtgtcaggtgctgtaccaggtcctagggctgcagtggtgaaccagatcaacaagactcctgcccttattggagaacaccataggaggctttcttgtgagtgataattgcactggggtccaaagaatgggtgagagatgactgggaaaaaatgaagaggaagttccaagtggaagggacaacatgtccaatagctctattgttggaggaagcaggatgagagaaagaaggccaggtacactggagaattgggacaacggtaatttttcagtatataaaactgattacagcaaagtggggaagaattatttttgtgaagtggaggtgttctaaatcacataaaaacttatctttcccagtactcagaatatatgatatttatgttagcattgataaacactctgaatgcagactttgaataatgtgaccctaccatatacaggtttttatagaacaaattattataatgaatctctagcaagttaaatgtcagcttatattttagggaagcaattgggcataataattaagtgggttctgaagacagactaccttggccgtaatttcaattccagcttttcatgggtgggtggcatggaaaggttacctgatttctctaagtctcaagtttcttgtctgtcaaatgggattaacaataagtaaagattaaggaagtaaaaaacatgaggcagtatccattgtgtattggatgtactagtggtatctcactacaaggtactatttatttatttatttatttattattattttttgagacaaagtttcactctgtcacccaggctggagtgcaatggcacgatcttggctcactgcaacctccgcctccaggttcaagcgattctccagcctcagcctcccaagtagctgggattataggtgcacgcctccatgcctggctaagtttttgtatttttagtagagacggggtttcaccgtgttccccaggctggtcttgaactcctgagctcaggcaatccagccacctcgacctcccaaagtgctaggattacaggcgtgagccactgcgcccagccccagatagttctttctaggttacctgtgataaattatgcagcacagcgagacttttatacacaacagccttgatacttacaaggggataccatgttcaaccactccttggctgtggggaacatggtgaaagaaaagaggcatgccgagactggagaggtgctaagttctttgcacatacacatggtttccccttgaaacaaatttctgtcaatcatgggttttgtgtaaatagactcatattgcaattgtacccatccaaaacctaaaatccttcatcttgcttgctgtccatttgttatcaagaaacatattttttaaaatcatgtttttaagagtactgtgaactaaagtcattatatcatgagcattagatatagatttgtgtgttggttgctgttccttcctacttgtgtaatccaggacaagttactgaatatcccaagcctcagtttcctcatgtataaaataaaaacaatggtaccccaatgtacattatttgggcggtggatacactaacagccaagacttcaccactacaccatgtatccatgtaataaaagtatacctgtactccgtaaatttatacaaattaaaaaatagtgacagctgtagaatggttgtaaggaacagtacataagtacataatgtacttatggcattgagtgcagtatccagcccctaatatgttctcactcaaggtcactgccattatttttaatacaaagtgacaactgggtttgcttgttggaattttgtctaggctcaaattctggctaaagatcatactcccatataacagagtgctattcaaattggtagtctcaagacattcattgttgttgtttagaattacttggatgtagaaacttttatctgtgaatcccacagacaagagataaatttaatctgtgctttgcaaaagtctgcacaaaaggcagctgaacagaccatgagcactttagggaaggcttgtgtcttgttcatctggttcctagctttctaccacagtgctaagcacagagtcatcaccctgtatttgttcaactggtccctatacctttcttgcaaaaaaagtaagcagaggcatgggctaatttgcctcagctccgacagcccagctcccatggggtctgcaaagcctatttcccacaggaggaggagtttggtgcaagacgtaagatcatgggctttagaaccagactccttgggtgtgaatcctgactccatcaacttcaggctgtgtgaccttaggcagttatctaccttttttgtgcttcagattccttgtgtgaaataaaggtcacactagtacctagtctccagcagttagaaagtgcctatctcaaaaggagcactgcgcaagtcttggttctgataagcacagttgttggttctgataagtacagttgtactgcacccacacagggcagggagcagaagatatttctcccatcagtctcagtaaatgtgagacacacaaggctgtatttcctttctttcacctcctcaatcctcatcttccatagaatcagcccatgttttgtttgtagccctaaacccaggcgattttttcttgcagtaaagaattgcagcccttcatgattccagctgaataaggctctcttgctatcattgccagatgatagcagcactggaggcacagactgtgtttttttcatctttgtgttgtcactgaaatggtgtcttatgagcattcacaaattcacacctttgctccttcagttaacatttattcatgacttactacatgtgctggactagtgtgaaaagctagggcaaaaaacagggggtggggagtggagagacacaactatttgtcctcatgggccttagagtctagtggtagttagatggggccatatgacaaatgcaaatggacagtgtaatgcaattgtcaaaagccatgggagcagtagcacaggccactgtgggaacatagagcaggaacacctaagggggcttggatgaacaggcaggcctcctcattatggggaagtctgatgctcaagatttagccaggcagaggtagaaaggcaagatgggactatcttccaggtaaaaagatcagtgtaaaggaccaagagtggagaatggagagagaaagagagagagaatggagggagagaagggagaggagacactagagaaataggtagataagactcaaatcccagagggtctgtatgccaaattctaaatttggaccttctgttagagataatgaggcatttgctggggagggatcagagaaagtgattaggtctgtaattaaactgtgtaggaagtaagtttttttaaaagaaaaaattccagctttcattttatttcacatgtaaatacttcaatgtgtatctctaacagataaagcctttctgtaaaaaaaaaaaaaaaaaaaaaaaaaacccacaaggttattggtacactttacaaaattaacattaattacttttgtcatctgatacccagtccacattaaatttctccagttgtcaacaaaatgtcctttttaaaaaacacctggttaagtgtctttttatttcatagctatagttctttgttctccctgttttttatttcattcttttgtttgagtaacttaactgttatttggcccgtagaattccctcatttcagattggagagagctgattgcttgctctcattttatccaaccatgtgcacatgactctcaagtatttactggtactttttttttttttttaaaggagatggagtctcactatgttgcctaggctgaagtacagtggttactcacaggcatgatcatagtacactatagccccaaattcttgggctcaagtgagcctcctccctcagcctccaaagtagctaggactataggtacataccatccagccaggctttatgcattgattcatgaggtactctgaatacaccaatttatctggccatttaccaggtttagacacaaggtggagccagagctcagtcagtgttgattttctcctgacagtctctatgtcggactttctgaatgagaaggcaatgagcccctactaagccacaggatcagttgggagcaatggtaggtacacaccccaggataagtctatgataagagcaatgctccagtttatcatcgccccgcagaattcttctttgtggtttcccagcttggtagggattgtgtaaataatgtaatctagaaggttttctgtttttaaaaaattatatatatttttaaggaacttcaaagcaaaaattagccacccatcccaaatcagtgtatagacttttcgtttgggtgttctcattctatctgggttgtactacccttaaaaataaaatgtgtattaggtattcacacacagtcatgtgcagagggaatgtccttcacaccctagtctgctcgttcagtattaagccagacaccgagatgatttgaaatgtttgtacggctcattaccttctctgccagggacagcacagtgctggcctgaattatggccacttgttcttcatttcttaaattctgtaaaaaataagaaaggccgtcagctgaacatactgacattatttaccccaaagaaaatactgtctgactgactgctacagagcattctgtataagcctgtatagaaacttaacaaattcctattctgtttagtaataattctgaacaaagagttaatcaaaacccggaagaagtatattaaacgtgattttttaaatatctccttaacaccgatttgattttgtgtcactggaggcatactttattaatagtcatgttatgagaaaaacagaaaccaaaatggaataaaaaacagtctcttcatagaagttttgatgtaattttactaattctgttctctcctttgataatttttcaagggaaaaacggtgattctttcaacctacaagcaccaatcacatagtatcacaataaatggtcctcccactgaattaatgtgccttgaccctgtctggaagatgttttcggaaagaaaatgcattatagcctcctggtccatttttatggcactgccaacaaccctagtatttagcagcctttgcaaatgcgtgactgattaatttcacactggatgcctttgagctagagtcagacaataattagctttacttattggagatgtggtcgacattcaaacctgaaacctgcccgcaaaaagcactttaccaggtctcatttctgctactaccttccagagatccttacaaccccttagccaagttgtttgataaattgtatattcttcccaaggagcaacatccttaagtgaaatggcatctcacttgctcttactttacacatgatgcattgttaagtatctcttgcctctgtttaggcaaattcatatctatactaaatcaattctttacttaccccattatcacccaagatatcaagctgctttatgagatcagggatgttcacatcctgcaaaatcaagcagaaactcatgtcaaagacaaatgtggcctcctattccatcagtgcctgaacatgaagttagaggaagacattttagggcctgaacttccttgggatgttttcaatctggcacacctagttttaagtttcaattttgcttcttacatgctgtgtgaacttgggtcaggtacttaacagatcattcttaattttgctagttgcaaaatggagataataaattcctacttcataggctgagctgatcttcaggataaacagactgtgtatgaaagagtctagcatgtagtaaaagacttggaatattctcattaactttcttctcatgactgccaaatcttttttttttcaattgtgataggctttcaggtataaaaaagtaataggtaataaatataaagaatcaaccaattttattctaattagcaaaattctgacctgattgaattttgactgccatgtagaaaactatagtgcagtaccatttttttaaaggtggttagcattaatttcatctatcttatttttaccctgttccttgagtcagtttgaagcagctgaactccattcgaaagagttcattggattaggttgtttgtgatttatctgagaaaaaatgcatcgaaggaaaaggcaaagtaaattcttttcatttaattacagtgaaatccaaaaattgctttggttgacaaattaccatgccacccaggaaggccagaagtttaaacaccaggacaatggtttaagatggaaggcaaggaaacacaatattaccaccaaagttttctccactttttaccgtattagtactatgttctcctctttctcatgttcaaacagcagtatagtagagccctaccaccaggaaagggaaagtctagctcaatctcataagtacagagaaggcaactgaagcaagtatatttggcagctcagagtgggagcaggaagggccatgcagaaggtaaggagagaccaggaatagcaggcagcatcccagctttaccccaggaacagatattcacaatgtgatttcactgaaggacaatatatttccccgggggaagagctacctcaattcaactctaatacttaaaatatatccagtagcactaaaaagataattatattctatttaatatgcaacctgttataaaccctaagcccttccaaaagaggaatcctccctaaattaaacacatcaaaagagatgttggactagatgacttcaaaccttttctaactctgcaattccataattatgaattccatagcacctagaatggctcaacaaagggactcaaacttttctatctggcagacttgaaatatatttcttgaagtattaaatcgaattcacatttctcccaggtaattaaggctaattttgatgcagcgtctttcttcatatgactctgttctaaataatcatggatgcctctgtttcttctgttatcatttgtatatctgtcacacattaaaaaacattctgttaattttctagtagaagtgactattttcaattcctacatagtttgtatcaaaatgatgacatccagtgactgaaagacaaaatagtcgtaagtaacctccccttttccaattcccagtttttctaatttctacaaacataaaaaatgaaatatctgcctaccttaacaccttctttcatacagtagatctgtagagcactcacaccatctgagaatgggtgaatttggagattaaatggaggggatcgtctctctctctccttgaaacacagtgaagaatatatggaaattaaaaacaaaactgattaattaaacactaaaccagtggtctctttatgctatttcagcagtttattactgtcatttggcaaaaagaaaaaaattcaatctcaagatgttcatgattaaatgtgacggaaaaagctgactagtcaactaagagattgagaagaagaatttatagatggtgtcatccattcttccaaattttttgatcagggaaatgcaggaagtggagctccagtttaaactgtatgaatatttagagctttcaaatatctcagcgtggtcttgccatgaagttttatggccgctaacagccttttgcatattcaatctattcaagcattatgagaaagatatgtgggctacaaaagaatgactcttcttcactgaagcctactaacacctaactttttatccagacctaattcaaaatagcctaaagaagaactaactggcaaaataacagaaatcaaatgggaatttttcttatactttatatatcaacatacactgaaccagatcctaagtcagattctgcaggatacaatcaaaatctgatgtttccatgttttacttgcaaaataaaaaacaaacacctgaaatttggtcagattaatcaaggtattttctaagacaagttaccttgcttcttagtcttttttttcataaatgcattagggactaaaacgtttacttataaattcacatttacctaaaaaatattttttatatagcacattttgaaatataagtattgaagtaacatgttttaatgagtcaaaatttaattaaggatggacatgagtatttaaaaacaacgaatgttgaggatggttgaaatctattatttaacttatttaaaaattatttattagtcttgctcataaaagatagtaatgttgaaaagcacagtatctaagtagacagttttgagttgcatcagagctttaccacttactagtcacaggacttaggcaagttagttaatctcagttgcctccactatataattttgagggtgattgtgaggtccaaatgagagtatgaatctgaaatgcttaatacagcgcctagctcctcaatgtgctctgtgcatgttaatcattacgattatttttattattatcatcatcatttccttacttctagctctaggtttcgaaactccagcagctcattctggtctctggcgtcctgtagttcttgttgtaaccggtgattttctgcctcctgtttttctatctaataaagtaaatcctgaagttaggtaagcattgagaaaagcacctacaactttgcaaagcatgaatagtgttcagtttactcagtgaataagtcttccagaccatgaaaaaaaatccccaaatagatgtgaataaaataagtatttggctttggctttccttctagttatccttcggttgagttttttgagtcacagagaaaaatgccagaagacatctctgttccttggaattaaaatctaggaattctgtgaatagtgaatctgagaatactcactttgcccttgtgatgggtcagagacagtctactagaaccaaatttaatggtatacataagagggactgatacttctcatttctcgagttatatttgttacagaaattttttttaacagctatcatcatacacaaaactttgctgaatttcaattactacagaagaaaccagctctttaacactgaattcaaaaaccttaataatctgattaccacctagctttccagttttaaatattatcactgtcatctctgcacaaacacacccacacatgatcatgcaaacactagaatctaggaactgtggcctacccaatgaactgactactccaggaactctgtagctactcagctctgcctgaaaatggctcactttatctcctttgctatgtgagcaaattctacacttctttaaacaccttaaagctaagctcttaagcattagcacttaaataagctctaatgtccataagagccttccctagtcaatccattcagaagtgacacctctccttttgttttcctctagactttcttataggacctctagtataacttgaggaagcatggatttcagttagctgtgtacaaatgcaccttcccctgtagacagggttcatgtctgagttatctttggattttttttttttttttttgagatgaagtcttgctcttgtccccgaggctggagtgcatgatctcagttcactgcaacctctgtctcctgggttcaagcaattcccttgcctcagcctctctagtagctgggactacaggtgcctgccaccaggcctggctaatttttgtatttttagtagagacagggtttcaccacgttggccaggctggtcttgaactcctgacttcaggtgatccacccgcctcggcctcccaatgtgctaggattacaggcgtgagccattgtgcccggctgtcatctttggcttttaagggatcagaaaatctttatgaagtacaatggatgttgagcttcccttgatattagctgtataggtgggcattacatacagtaactatttaaaatcttgaatttagaaatacaaaccagggcctttttaccatagcacgaatcttactttcccaagtatttacatttgaagttacctatttaggttcattgtcagttctgccatccctttattttgtttatttattcttagaagcctgagcataaaaattcctcctttagcccaaaaagattaagactaacggaaatcagatagaagacgtaatgggattttttttatgataaagaaatataataacacttattactgggcatctctgaaactaataggaaaagaaagatagggaaatagtgagaaattatgtgacattaataaatgtagtcgagttttctaccctagatatttgtggcctagtaaactttcaaaagtttgtagaagttaacttaacattataaaggagattctacttcctagaatcttctactgaatcaatggtggaatatttcgagagattgctggttctagtggttaacgaaacaattagatcagtggttcacagactgtaattcattcaatgccaacaaagtttctttatagggtcgcttaaccttcctgaaagcaccagttctcgatttttgaatacctgcccactctgtatataacatatacatcatctatacatctatgtgatgaacacatcagctctgtctcacagcatgcaaagcatgagatagaatgtcttcactttgccagactagaggggaggtaggacaagcatctttttcctccttctcatgcttaccagccaggatgttgtggttaatttttattacttgtcagggataagaaatattcataaaaacaattctaaaataatttctgcataactttggattgacctacacaattgtttcccttacacaattgggctttcaaattctgtttttgtcaaacataatatgagattattttgtaatttaaattagtcagatgtggtggcacatgcctgtaatcccagctacttgggaggctgaggcaggagaatcgcttcaacctgggaggcagaggttgccgtgagctgagactgtgccattgcactccaccctgggcaacaagagtaaaactccgtctcaaaaaaaaaaattattttgaaatctttcactagatttgtagaaggtaaatatcaaaggaaaagccacctttgaactgaaaatgtgttatgtttaattgactctatgttcagataaccaaaattaattatatctattcaagcctaagccatgtttttgtttcttaatttgttgagtaatttccaggaatactgttttatgttttaaaaacagtattcatctaaaaaaaatctttcattaaaaaaaaaagaaagactcaagcttaataaaaagactaaaagtgggaatctaagcctatgctaggtttcggcatggtcttggagtcatactctgtcacttcttctcacaaaataacaagttctattcatagaggtttctttgttttgttttgttttgttttttggagatggggttttgctcttgttgcccgggctggagtgcaattgcgcaatctcagctcactgcaacctccgcctcttgggttcagatgattctcctgtctcagcctcctaagtatctgggattacaggcatgtgccaccacatctgcctaattttttgtatttagcagagacagggtttcaccatgttggccaggctggtctcaaactcctgacctcaggtgatccacccacctcggcctcccaaattactgggattacaggcttgagccactgtgcctggccctcatagaggttttgttgtagataaacaactacacaggatgtgcacgtgtgtgtgtgcgtgtatgtatatatatatgtacagtatatatacagtgtatatggttagcaaatcaggaggtttcagggatcacatcctttcaagtctgcacaatgcccagcgcagagccatgcacacgtgccacttcactgatggtgatggcggtgacagggatgcggttgagcacgcagccgaggacagagcagtgccggaaaagcctccccttcccctggcccctgtgccactcctgagagcaccccctgctgctcctggatctctcatgattttctcctctgccccgctagggtgttgtgcccaacataccttttctaaaagctcctggtttctcttaatgaaaagttgtttatcttctacccagtgtgaatcctgtttgacaaagaatatcgcgcagtcagcatttcagagtggcacgaaagagcctgtgttgtcaaaccactttgccagagctgccttctccccaccctgtttgtttgcctgccaaagactggtaagtagcacccacccctgccagctccttcaaagaaattggggccaaagttgccgggaaaatttaacccccttttcatcatcactccctatttctaccttttccagtttgaataatccaggaccagccttctggggactcagaagtgaccacacaggcaaaaagtgaaaagggtcagaatgcacacaggctagatacatatggatggaaaacattaaaatgcagaaccataaatgtagcatagaggcaaagaacgcagctggaggggtgggtcttggtcttagcagcttatgacaactctaggctatttgtacagggttcctcttcctctggcattctctctcttgcccaagctcattcactgttgtggctgggttcatactctggccagaaaaacaccagagacagaagtacagagttgaacattctaacgcagttcgagaaagatcactgtggagagccaagctgtgtcctgggtgcggcccatgcacaggtgagctacaggaaggtcagattgaattgtctgcatctgcagaagagctagcaaccaaatgcctacctgccctttctgagccagagtcgcttccaggtcttcaattttggctttataccttagcacctctgcttggagctgttcttgagcctggtgaaaccaaaattccagaactcagcaagtaaaatggttattcaatacctttcttgactagaactcaacaagtaagagagagagagaggaaaaaaagaagaattttctatgacaaaagaatctttctgatctaaattcttgtttaaaactccctgtagcattctttattttcaggttagtattcaaactcgttagcttggcattcgagaactcccattatatttccaatcttttcctactactcatcagcctagagccaaaccctcacctgctggcataattcttgtttcctaaatatgccttgtaactctccactcttctctttatttgaatgatttctctttcatgaaagccttgttccattttgcctccccaaattcttttgattttttttttttttttttttgagacagagtctcactctgttgcccaggctggaatgcagtggcacaatctcagcttactgcaacctccgcctcctgggttcaagcaattctcccgcttcagcctcccaaatagcttggattacaggcaccggccaccacgcccagctaatttttgtatttttagtagagatggggtttcaccgtgttggcctggctggtctcgaactcctgacctcagatgatccacccgtctccgcctcccaaagtgcacccggcctttccattctttcagagcaaactttgtgcctaaatttaagtccctaaatcaatttctctctgtctttctctttatatatcatattttgtgtgtctgtgtgtgtaagtagttttgaatactaatcttgtatggagcaactttgttgtcctatgtgatttagcttagtaatttgtttcctgcctgtaaacccatttttttgttgttgttttacaatctggataggttttttagtacaaagttgaataaaaacagcgatgaaagatatccttattcattgtgaggagaataattcttttgattgttaaatattacatttacctctatcaggtccaaaaaataattaattttgctaagatttattttaactgtgaattgatgttgactgtaacctattttttcttgtacctaattttatcttttgttttcaacgatgctttcatctgtattattttttaatttctagtctctttaaatttactctgttgttctttttctaacatctttatttcttgtagattatttttctaagaatggtaagttttcctgactttaatggtcagagagaacgctaaacctttatttaggtagaagaattaaatgacacagggaggaatctccaaaaagtaaaagaagtctcctttttttggaggaatctccaaaaaataaaaataaaataatatgctattattttaattccccaatccatgttggtaagaacacttaaccacaaatattatagcactggggcatatatatgacagcctacaggcacattcctttgtaatgattgcttgcctgttctaaattggtgttttttaaaaacctgcttatttacttatatatgtgtgtgtgcatgctactgttgaaaaatgtataactgcgttacatctaccctttcccactgaacaatagtagttctacaaaactcctcagtgcattgtagaccctccagaaagaaagtaggatgaaatcactgggtggtctcggtggtcatgctgccttttggctcatgtaaatttacctaggaggcaattatagcctggtgattatgactgtgaagtcacaaggctaggaaacctaggtaaacctaggtaaataatttaacttcactaaactacatttaacttctactaagctattatttcctcttctatagaaagaagataataatcatatctagctcctagggttgttttaggattatatagataatgtgtgtaaaatgttcaacacaatgcctggaacacagcaagcactcaataaatattaagaattagtatagtacatgtctatcttttctttttgttgaaataggctcatgagaggcagttatgatataaaggaaagaacatttgacccagtaagacttaagttgtaatatcagctttgccatttactatttgtgctatttggggcaattcaattaacctctctgagtgtcaaatttctcttttataaaatatctgccttaggggactgtctcaagggttaaatgagatagtgtctgtgaaaattctggtaagttgtcatacgtaaacgctgggcacttattaacgaagagaagacactggctcactattgcttttgaaagataaaaaagttctttttctaagcaagaaactaaaaaatggcttaacaaaatccaatattgtctagctttgaaaatgtatgttttcaaacagcaagaacaagaactatgtactcaactatctttaaaagaacaaaagcattgatctaagctggttctaatgtttctagagtcaaggtttgttgacataaaagctataacaattcaaaagctgcagaggagagaagaatacagggaaagctgtcttattgatatttttatgtccacagtgcttttatgctgtgactgctgcacgctaattcagagcactctcacagatacacactaaccttggcttctcgttcagcgtcgatgatgcctcccgtctgctcctgtaggagggcatatgctctttggagggcctgatattcttttgttaattgtcgaaatcttagttcagattcttcagctgctaaactcttgaggttaagaaaaaaagccccaaaacaattgtgttatgttcaggtcctgttttcaatgtgaaatattaacatttgcccactttttacaagaagtaaaaggttgtttaacagtctatttgattttatttttagctctgaagtgtatatacgggcacaaatactgtaatactttcaagatggacactgcagaaatacataaatatttattttagtaaaagaagcatttagcatttgatacatttctcattgttaatcatttgagcttagaatgtagtcaattttggatccaaataagaaaaagtcatatccagattttggacctaaatttgaggaaatgataccctagaattttcttatttcttttcagtatgttcatctccagcaacttgttttttcccccagataaatcataaaatctgttttattgcattacatcttaaacttcaggacataacataatcagcagggaattttgggaaacaatgcagactggggtgtttcactcctaagatcctgagtcaggagttgcatggtagagtccaggacttttcattgtaactgagccctctagatcattctgatgaggatggtccacagaacacacttcactcaacagtgtcagaccacatccaaaagcctgctaaggcctcttgggttcctaccttccctagataaagaatattggaaagtaacttttattttgaaagaagtcttcaaattagagagttgaactggagagaaatttctaaaaggtttacctgctataagtgaagctatttttcaagagataataaagtgcagcctcaaaattgtttactattatgagatcactttgtgctgtttatataaaggagatgaaaagtgaaatcctttttcttcccccttaaatcaaagatttggtgacaatatcaccctaggctagagaagtagaaaagcttacttcatccaagtcatcatcaggagtagctggtgttctgtctgttctaaatgaggccatggatgatgtctctgaatccatagagtcctcatcatagccaataaacgggtccaaaacaggcctctaaatggagggaaagtacctatttactgacatagctaacagtagggaaagttgaacgttaaaatactgtcaactggcatacgtgtaagtgaatatagaagacatggatcctctatgcttctttgttgaaataaaaacattaggcatgagcataattccaataagtgtttctctcatattatttcacttctgacatcttaagaaaaattcataatatgtagcttttttcatagaaacactgaaacctctttcatattacattttatatcatgatgagctagtgtggtttactctttcctgtatttaaactatgaccaaaggattttgaaaactcaggtatctatgtgatggagatgatcaaatcttaagccttgtcatccaagtccacattaaaaaccaatggtatacttggtaaaaaccaaaataaaaatcaaatagacaaactgaataacaaaactttgtggattataagaggctatacagatattgatggattgggagcattgctatcaataagattgtctgaatgaataatgaaaatgtattaattgtcataagtgggagacatcaaatcatgtgcatttcttgaatatgactctccaacttgtcaggtaatcctttctacatcaaacctaggggcatctccatttagagaaagttatattaaagcaaacccctttcaggttaaaatttacaacataatcatttttagacttcgaagaaatgtcaacagaaaatattttcttctagcaaataatgcccatggtttgctgcaacagttctggaacacctgattcatcacatctttgtaggaagattccatgccaagcctcatctctctggctgtttgtggcaaatgcctgataactttgatttcttattaccttaattggcttggaacttcttctatgctttcttctacggatgagcttttctcggtcctggaaaacagatgaaagattttcagatccagaattggtagatgtttctttatagttttttgcaaagacagagtgttctttcccataaggcattatatttggaatagaataagactttgttttttaaattttggcaacttttgggattgatacttaaatatattcaaaacaagaatcttctacaactattcctgatgagttatgtggatcaaggagcctcatgatcagaaagtgtactgtgttcctaatcagaatcctgttttatacttgaacatcaagtagctatgaaaatagttacttatattcccccaaagcacagtactttagttctcctagatccaaaattactttaaatttgtgttaaaaatacaatttcacaataaagtaaaaccgtattcttttcatttagtcatttgaaatgcatagaaagctgtctttggcctatttttgcatccttgttctcacctgcagtccctgaaaataggacagggaacagagtagctagcgggttggagccatttagtgtttctgttttgtcttcagtttttaaaaaattttctgggaatctcaaagaatgcctagaaatattgatcaatttcatgatttattgttgctgtgaatagagatatcatgggaatttggggtttattcactaagcactccatgtatttactgtaaaaatttaaactagatagaatgtcttttgaaaagtccgatgagtgtgcctaaatagcccaaaattctataaaaaatttacagcttaatctcaggatactcaaagccaggcaaattcctgggctcatgaatttgtaaaatgtatgagttattaggatgtgaaaatgaaatgaggaaaacagggagtaatgagtaatcttgtttaagccagtggtgttcgggctttttttttttcacctttataagtaaaaatgcagcctctatatatgagacttttacaatttacacattattgtgatggttaatattgagtgtcaatttgattggattgaaggatacaaagtattgttcctgggtgtgtctacgtgggtgttgccaaaggaggtttaacgtttgagtcagtggactgggaaaggtagactcaccctcaatctgggtgagcacaatctaaacagctgccatcacagccagaataaaaacaggcagaagcacgtgaagagactagactggttgagtctcccagcctacatctttctcctgattcttcctgccctggaacatcagactccaagttcttcagctttgggacttggactggcttccttgctcttcagcttgcagatgacctattgtgggacctcaccttgcgatcgtgtgtgccaatactccttaataaactccccattatatatacatctatcctattacttctgtccctctagagagccctaatacaattatatatttaaattaccttcctaatctaatgtattcattgtaacatatagtcaacatagaaattttaaaaaggatgaatcataagtaattataaacagaagctataacctttctctgtctcagtggcagtgaatcacttttctcacctcactctggagactattgcctaactccctccttgcaattcaagtctttaggccttgacttggtcctgaagtgagagcaaccaacgatgtcattcacagaacacagatggagaggcaaagaagaaaacccaaaggcacctagaggtcttagtgcatccttactagcaacacaaacctcagccaaactctgatggaagtaataactgctctacccactcagtaggtactgaagtaatgatcagaaaatctgggctgaaattttagctctgttatgtaattatattgttgctgttcatccaacaaatatttgttgaactgtaactatgtgctagacactgaattgagacctgggaaacaaggtatatatgtgatgttgttagcatagacaacatattaaatctctgagcctcgggatcctgctactggaaggcagttacaagacacacccaacctacctacaaacttatacaacgaggcatttaaaagttcttttaatgtgctttgctgttattatttgtgctaccaaattagttaacaaagggttataatttaaaaggtgtaaagcagttgaacaatataaaatattggaatacagtctctagaacaaaattacatatttaacatatgaacttgggcctctggggttaaactaaaattaactgctttcagtgtatattttgttggctacttgtccttgggaacaacttagggtttacagattgattgacacgtacccttgtgagctcatcaataatgttctgttgctcaatgacctgaagttttagaaactctgtttcttgttcttcattagcttggtcgaggtcattcagagattttaatttcttcaggggtggatgggatgttattttttctctctggattggaaaagaagaaagtacaggtggagactttaaaaacctcaaactttggttgttaacataaaatatctgtagaaagtttatgaggctccagctaaatttggaaattgcccagcctgaatacacatacaccaactaaatcctcaagcacattttatctgccataataagtcattatcattggggattgtcaaagatctctatagatgtattgaaagtctattaaggagtacattatcatttcacttgtccgcatataacacaagtaatggtatctatttcccaaatatcatgcacgatcttagaagacaaggtgtgcctggggtataggtctgtaaatagcatgttagtgaagtcatggatggtttctgtggctaagttatgtcaaagctttccttctccatttccaagctttggaaagtgtgcaaattcctggaagcactcctacagttttgcaaatatagaaacctcataaaattcagagccagcaaccttctcttgctttcttcattaaggcttccttgcttacataaggaaaaatccaaatagcactgtatttttaaaataagctgagaaatggcaataagtcaggttattaaggtaatataatcaaggaagctgcagttttgcagagtctgtgatacacaccatttctgaattttccttggtaacggcttttagtttttcttccatgcgctgcaaggacaccatcagttcatcgtttctcttggcgaggcacttgttcctttccaggagaggtttacattgcttttcggtttcccgcacacgttttaactgggaagaaataagtgaagatttgtgtcttgcgtttgggggacgtgggggcaggggagtaaagtggtgggagtgaaagcacctctggagacagccttgtctctgcttcactatgtggctgaggactgaccactgacatttcaatccttcatttaacagactgtttgctttcttttcagttttctctaacggtttttcatcacagccttcatagccttatatcaatccattgtcttaaggaaagtactccagagactggttttggaaatgctcgggaggacgcgctctccttgctttctttcgcttccccgacttgttactccaccgtgctcagctgcaatccctgcacctggaatgacctgcattagctcagagataaaggagctcacccagaccacacggccactaagtaatgcgaccaggagctgaatccaagcctggttatgtccaaaggtcattctttcagagaccttgtggaaatctcctgactcgcactacagttgttattttaaaagaaattttatcgaggggaaaaaaaccacacgtaagtttgaaactctgtggatgtttgtgtaaggatatcaaattctccccaagcttagtaaagtatgattgtattgttatccacccataattaagagtgagcatactctcatttgcttggttagtctaaagcagggtttctcagtctcggcgtctgtgacattttgagccggatgtttttttgatgtaaggtgtcctgtgcagtggaggatgtttagcggcatccttggcctctgctggctagatgccagtaacactctgctaattgcgaccatcaaaaacatcagatattgccaaaatcgcctgtagttgggaaccactggtctaagtttatgaaaattgtcttgaggggattgtcaatagtcctcccctttacttttaaaacactcctttttgtatatttcatgatcatcctatacattatagattttcattttcagcttctcatgattagcttattcttttcttactaatgattctgaatgtgagtatgtattgggagaagagcaaggaaaaaggagggctgtattcgaaatatttgagaagactttttaaagtgcgcactactgttcttgagattctaagattttgggaagtgctgaggtggaagacttagctaattatgaatatttgtaaaatctcatcttacgattcttaaacagcacttctgcaaatccatctcaatctcaatttcgtattaaagaaataactccatttcatattaaaggccaaaactgggtttatttttacaaataatctgacttagtcctgaagcattaatgccttagtccttagtgcctgaagcattaatattaaatattgcatacatataaggacaataagttattcttattttttaatctgtctcttctgaaggtcaatgatgtgagttttaaatatttaaatttacttattaatacaattcacagaaaatgcagatatacataaagaaaatatctataattctatcacatcatacatcaataaccatagtcccacaatacccaacaaaatgttccttttaagatacaccttaaataaaacacagaaaggttggaaaaaagtgtgtttgtgtgtgtatatatgtatgtgtaaatatgtatgtatatatgtatgtctatatagttataaatacatatatatatacacatacacatgtatatgcacactaacactaaaacaaaaatctgatgtagttcaactaataacaacgactttaagccaagaagtattaccagaggaaaaaaaaagcataatgattaaagggtcaatacacacaaaaaatataacaaatattaatttatattcatctagtaacataatttctaatatattataaatacatattattgttctacatataaagttaaatttaaagaactaagaaggatatagacaaatcttttgggagaacaagcagacaaaaatatcagtaagaattgaaaaattttaaacaagattattaacaaacttcaatcaaactgcaactaataattacagagtatgcctccttttcatgtaaacatgtaacattgctaaaattgactgtatgctgaggtcataaagcaaatctcaacaaattttgaaggaatgaaatatacaaagtacattctctgactatagtagaattaaggtagaaattgataccagaaagataactaaaaaaatctctaaatgttttgaaattaagccatctacttctaagtgacccatatatcaaagaaaaattacatgatattagaaaaatttttgaatgaaataacaatatattaaactaaagcaaggcttagagggtcaattacagcctaaaatgcatatatttgaaaaaaggaaaggctgaaaataactcttatatgaatagctctattaaaaacaaaaacgtaagccatagagcaagatattttaaatgcaaatgtaccacaagtgatgataaaaaaaatcctaatagtaactgaaacagtaaaggcagcataacagaaaatgggcaaaaggctaaggacaaattatatctgaaagactagtaaatatttgaaaagttaccctaccttcttaataatgaggaaaattaaaaccataatgtaaggtgtaagagtatgccctacatccaccaacatgactaacaattatttttgtatgttggaaaagatatggagaaactaccactttcattcattattggtgggaattgtgacaactcactgtttggtaataactattgatgctgactacatccatactctaacatccagtaattctactcctctgcatattccaccagaaatgggcatattttttcagaaacgacatgtagaagcactgttcttctcaaaacagctcagaagttttaagaaacaacataaatgtccattaacaataacatggatcagtatattgtgatatattatttgaatactatagagaaatgaaaatgaatgaattctacatgcaacacaatggataaatctcacaaacaaagctgagtgaaagaagcagaagaagtcagacaaaaaagagaaaatattgtatgatttcatttacaaaaaaatgtttaatggtgatagacatctatggcgattgaagtcagaatagtggttaagtttaacaggatgctaattgggaggggtcacaagaagcgggggtgtgagatgctggtaatcttccatttattcatctggatggtggttttttgagtgtgccactttgtgaatatctattgaatggtatctttattatttgtacacttttctctattatggtacgtatctataacatagtatgtaattctgtaacataatgcttaacaacaacatcaacaaaaatttttagtatatctcaccagttcatttcgttcatctccaagcaaggtattcctgtcttctaattttcttatagtggcattcaattcagctattctcttttgatttcttcgcaaatcctacaaagaaaaattaaaatgggtatttcttcaacaacacttttcacaaagtttgggaatatcacttattattcataaaagtaataggctcagttctcttatctggctcctgaagtgagaataaaatattcttttatccaaagagtaaatatttacccttttataactctcaatattcaccacttgggttgaagaccacgccaggttgtaattgcaaatgaattccatgtggcagatactccctggatccaggactcagggcagggagagtgcagagggttggatcaacttatcagagctgtgtgctgtgggaccaaggtcatgatgtgattacataaggttcaaagggcatcccttgtgtcatggccacacattgcttcccacagcttagacagctgtcctggtattaccattagccacagaggggagagagtaggaggtagggattaatattgtcaattccttcatactcctgaagaaaaaggtcaaggtgagaaaatgttgatgtattaccttcatgtataaaggtcagtagtttataggataggcctgactagtatattctgcccaatgcaactggcttctccactggcagaatggctgtgaatcaccttacacagggcattcatggcttaatttcatgttgtagagttatataagactgttattatcatatgctaacaattatattatcatcttacattttgataatgctgtactgttgacaaagtagtttcaaatacattatatcccagcattcataatatcctaaaggattcagtagaacaggtaaaattcagataggtaataactcctttaaggtcttgtggctaatgtcaaaagataagtaactaatatgtattaaatgctatgtgccagacaccatgctcaacattttacatattatctcttctaatctttagaccagccatatgaggtactactatagcttctattttacacatgaggaaactgaatggtgaagtggtttgcctaaggacacacagtaaatggcagatttgggatttgaaccaaagagtctgactctagagcccattctcttgacaactatgctatattgcgggtacctgtcagtgtcagaactaaaacttacagaaactgctaaatcctagataagtactccttccaccacctactaagattatatacatatatatatatatttattctgaatatcaattcataaattattcattacttagttctaagtagtactttggaacccatctctgttcctaaataatacatttccattattatagcagcaaaataattggaaaggtataagagttatagccaactgcatataagcccatttctattgcgcacttccgaaaataatttctcatataaaatgatgaaaattcatggaaataagtggtaagttcaatcagacaataagtcttcagatgaagattaaaaatggttttgtcttttatgcagttatacattttgacccctgtagatgacaaccatctttatcaatttccaacccaattgttcacaaaagggaaaattaccagtgtaggcaagaggcaaaatattttcatctaatttatgtttcttataatagacttaagtttggataggtattgcctggctagaaaaattctaggaaggatttaaagaaatctatctcatgtgatctgctaatgtagtgcagaccacttagttgtctatgagtttagaaaaccctgttctcaagatactagctgattttatagtagaaggtagattgatttctttgtagtaaacaagaaaagagcttaagtaaaaggtaaaacttgggagctaaataaaagatgacttgtgcattcttaacttcaactagaatggacttacaggactgctgcagtgttcggaaccatcacctgcccttcctggaatttctcgttttgggctgctcatgttgcactcagcctccttgaccagaaagagttgttcgtccaaagcctccttctgaagttggagtttctgtacatagcctgtctgggtctccagttccttttccagggaaaagatgatcctgtccttggctttgatttcatccatctgaattaaatgagacccaggacattttatttaacaatgctgtaaagaaatacatttttacaatggtgtaggtttaacttcttttatctgattgatacagaaaaaaaatcacggatttgataagtgtattggtttcatgagtaagatgaggcaacattgtgtaatgaagaagtatcctgggttaattaggtgtcaaggagagtaattttttttctctctagtatatcctgtgaagatgttttgactcaatatattgtttgaaatagtctgggttgattagatatgcaaaggacagtctaactttaaaatagccattaattttaataaagatgaacattaaatattccactctaatgtttcctaggacattttttgatgtcacttcttctttgggcaaatgggtattcagattcaatcaaaatagctgttgctcctgttagtagctggtcatttgtaactgaagaaacttcagacttcccagtggcctagtcatttttccaagactaacatgcttgcattcaggtgatggatttggagggaggtccttccacggttcatgtgttatatctctttctgttctcacttgtatttcagagcagccagttcttagcaaccattttatcattactataagaaaatcatggttgggattaacaggaatagaaaatatctggcaatattaaccactattttccctcccacatgtgtgagatatatttattgatccaaatatgcatttctgctaagcctgggcatggcctcagaagaatttctcaactaaaggccacaggcattcaataccagttgatttgagttcccttggaatgaaacctttttgccatcctaggatgagggctaatgaagtgaatgtctataaacaatttttaaagagagcatagccattgggtgaaacctttcttatcgtttcactatattctatgtgtacattcaaaatggagataaggaaaagacatttaatacaaacaacattacgctgttttgctttttctaaaagtgtctccttatacaaaacaatacttttgtataaatttttctttgctgtgtgctcttagaccagaaaaaaaaaacctgcaacagaaatggtgttacatagtcacgtattttccacatataaatatctgtgagctactgcctgtgagtcacatgcttaaattttaggtcaattctgagagagctttgggctaaattctgcatgatcttgtaatatcatctgataacttggtaagaattcaatattgtcccgttaattgggaataatagcattgtctttggtttccgtctccttgtagaagacttgagacctgtgtttttcttaactgagcagcatgttcatttgtcagacttgtcaactggagcattacttttatttgcaggttaacatagctctagttacttttcatgagttgacatagctctagttgttttttatgtactcaccttgttaaacttgtcgagaaatcattctattactgcccacattcagcctcattatcaccatcatcacagctgaaatttattgatctttcactatattcagggtactatactcagagcttaatatgccttattttataacaatcctattcagtaggttcagtcgtcatcattttacaggtgatgactgaggacctgaaagcttaaaaacttggtcatagtcatatgtctagtaagttgtgaagccgtatttttaatggaatcttctaactatagagcccattctgttaggtactatgctatactggctttaagattattcatatactttaagcatttcccaaagtggtttcctgtgggatatatagtaattagcattgagaaagctttattgcgtagcagttatgagcatggactctgatctcaaaatactgaaaatcaaccaaagccctacttagatgggaaagggtataaaccagaattctctggggaaattttctagacagaacaactcccatttctctccctttcagttccaaaaatggagcttggggtaggggtaggcacagagtaaaaagaaggaaaaaatgaagatgagtatatctgcgctatcaaaaaagtttcctatgttattctgtgttcatgcagtttgtgaactactcataaggtggctcagatttactttttaaaattttaatgtttattttactttaagttctgggatacatgtacagaatgtgcaggtttgttacataggtatacatgtgccatcgtggcttgctgtacctatcaaccggtcctctaggttttaagccccgcatgcattaggtgtttgtcctaatgctctccctccccttgcccccaccacctgacaggccccagtgtgtgatgttcccctcccttgtccatgtgttctcattgttcaactcccacttatgagcgggaacatgcagtgtttggttttctgttcctgtgttagtttgctgaggatgatggcttccagcttcattcatgtccctacaaaggacatgaactcattctttttttatggctgcatagtattccatggtgcacatgtactgcattttccttattcagtctatataattgatgggcatttgggttggttccatgtctttgctattgtaaataatgctgcaataaacatacgtgtgaatgtgccttttagtagaatgatttatattcctttggatgtataaccagtaatgggattgctaggtcaaaacgtatttctggttctagatccctgaggaataaccaccctgtcctcaacaatggttggaccaatctacattcccaccaacagtgcaaaaagtgttcctatttctccacagactcaccagcacctactgttgcttgactttttaataattgccattctgactagtgtgggatggtatctaattgtggttttgatttgcatttctcaaataatcagagatgatgagcttttttttttcatgtttgttggccgcataaatgtcttcttttgagaaatgtctgtttatataccttgcccactttttggtggagttgtttgctttttcttgtaaatttgtttaagttccttatagattctggatattacacctttgtcagaagggtagattgcaaaattttctcccattctgtaggttgtctgttcactctgatgcgagtttcttttgctgtgcagaagccctttagtttaattggatcccatttgtcaattttggcaattgttgcaattacttttggcgttttcatcatgaagtctttgcccatgcctatgtcctgaatggtactgcctaggtttacttttaaggtttgtatggttttgggttttacatttaagtctttaatccatcttgagttaatttttgtataaggtgtaaggaagggatccagtttcagttttctgcatatgcctagccagttttcccagcaccatgtattaagtagggaatcctttcctcattgcttgtttttgtcaggtttgtcgaagatcaggtggttgtagatgtgtggtgttatttctgaggcctctgttctgttccattggtctatatatctgttttggtaccagtactatgctgttttggttactgtagccttgtagtagagtttgaagtcaggtagtgtgatgcctccagctctgctctttttgcttaggactgtgttggctatatgggctctttttggttccatatgaaatttaaagtagttttttttttttaattctgtgaagaatgtcaatggtagtttgatgggaatagtgttgatctataaattacttttgtcagtatggacattttcatgatgatgattcttcctatccatgaggatggaatgtttttccacttgtttatgtcctctcttatttccttgagcagtggtttgtagctccccttgaagaggtccctaatgtcccttgtaagctgtattcctaggtattttattctctttgtagcaattgtgaatgggagtttattcatgatttggctctctgcttgtctattgttggtgtataggaaagtttgtgatttttgcacattgcttttgtatcctgagactttgctgaagttgcttatcagcttaaggagttttgggctgagatcatggggaattctaaatacagaatcacgtcatctgcaaacagagataatttgacttcctctcttcctatctgaatacgcttgatttctttctcttgcctgattaccctggccagagcttccaatgctatgttgactaggagtggtgagagagggcatccttgtcttgtgctggttttcaaagggaattcttccagttttttccattcagtatgatattggctatgggtttgtcataaataactcttattattttgaggtttgttccaccaatactgagaatttttaacctgaagggatgttgaattttattgaaggccttttctgcatctattgagataatcatgtggttttggtcattggttctgtttatgtgatggattacatttattgatttgcatacattgaaccatccttgcatcccagggatgaagctgacttgatcatggtggataagctttttgatgtgctgctggatttggtttgtcagtattttattgagaattttcacatcgatgttcatcagggatattggcctgaagttttctttttttgttgtctctcctaggttttggtatcaggatgatgctggccccataaaatgagttagggaggagtccctccttttaaattgtttggaatagtttcagaaggaatggtaccagctcctcttcgtacctctggtagaattcagctatgaatctgtctggtcctgggctttttttgttggtaggctattaattactgcctctatttcagaacttgtcattggtctattcagggatttgacttcttcctggtttagtcttgggagggtgtaagtgtccaggaattcatccatttcttctagattttctagtttatttgtgtagaggcatttatagtattctctgatggtagtttgtactgctatggagttagtggtgatagctcttttatcattttttattgtgtctatttggtgtgctctttttttctttattagtctagttagtggtctgttttgttaattttttaaaaaatccagctcctggattcattgattttttgaagggtgttttgtgtttttatctgcttcagttctgctctgatcttagctatttcttgtcttctgctagcttttggatttgtttgctctttcttctctagttcttttaattgtgatgttagggtgttgattttagatttttccatctttctgatgtgggcatttagtgctataaatttccctctaaacattgctttatctgtatcccagagattctggtacattgtctctctgttctcattgttttcaaagaacttcttgatttctgccttaattttgttatttacccagtagtcattcaggagcaggttgtttgatttccatgtagttgtgtggttttgaataagtttcttaatcctgagttctaatttcattgcactgtggtctgagagactgtgtgttgtgatttcagttcttttgcatttgctgaggagtgttttacttccaattatgtggttgattttagaataagtgccatgtggcatgagaataatgtgtattatgttgatctggaatagagagttctgttctattaggtacacttgatccagagctgagttgaagtcctgaatacccttgttatttttctatcacattgatctgtctaatgttgacagtggggtgttagcctcccactattactctgtaggagtctaagtctctttgtaggtctctaagaacttgttttatgaatctgggtgctcctatattgggtgcatatatttttaggttagttagctcttcttgttgaattgatccctttaccattatgtaatgcccttctttgtctttttgatctttgttggtttaaagtctgttttatcagagactaggattgcaacctctgcttttttttgctttccatttgcttggcaaattttcctctgtccctttattttgagcttacatgtgtctttgcatgtgagatgggtctcctgaatacagcacgctgatgggtcttcactttttatccaatttgctagtctgtgtcttttaactgggacatttagcccatttacatttaaggttaatattgttatatgtgaatttgatcctgtcatcatgatgctagctggttattttgcacactaattgatgcagtttcttcatagtgtcattggtctttatattttggtgtgtttttgcagtggcaagtactggttttttctttctatatttagtgcttccttcaggagctcttgcaaagcaggcctggtggtgataaaatatttgcttgtctggaaaggatttcatttctccttcacttatgaggcttagtttggctggatatgaaattctgggttgaaaattattttctttaagaatgttgatggctgggcactgtggctcacacctgtaatcccagcactttgggaggccgaggcgggtggatcacaaggtcaggagatcgagaccatcctggctaacatggtgaaacctcatctctactaaaaatacaaaaaaattggccgggcatggtggcgggcgcctgtagtcccggctattcgggaggctgaggcaggggaatggcatgaacccgggaggcggagcttgcagtgagccgagatcgcgccactgcactccagcctgggtgacagagcgagactccgtctcaaacaaaacaaaacaaaacaaacaaacaaaaagaatgttgactattggcccctactctcttctggcttgtagggtttctgttgagagatccgctggtagtctgatgggcttccctttttaggtgacctggcctttctctctggttacccttaacattttttctttcattttgaccttggaaaatctaatgattatgtgtcttggggttgatcttctaatggagtatcttagtggtgttctctgtatttcctggatttgaacgttggcctgtcttgctaggttggagaagttctcctgcataatatcctcaagtgtattttccaacttgattccattctccccatctctttcaggtattccagtcaattgtaggttcggtgttttaacatagtcccatatttcttggaggctctgttcattccttttcattcttttttctctaatcttgtctgcatgccttatttcagcaagatggttttcaaattctgatctcctttcttctgcttggtcgatttggctatcgatacttgtgtatgcttcacgaagttctcgtgcagtgttcttcacctctatcaggtcatttatgttcctctctaaactggttattctagttagcggttcctgtaaccttttatcaaggttcttagcttccttgcattgggttagaacatgctcctttagctcacaggtgtttgttatttactgaccttctgaagcctacttctgtcaacttgtccatctcatcctccatccagttctgtgcccttgctggacagttgttgtgaacgtttggaggagaagaggcattctggcttttgcgattttcggtgttttttcctcatctttgtggatttctctacctttgatctttgaggctgatgacctttggatggggtttttgtgggagggtcttttgttgatgttgttgttgctgcttttttagttttgtttgttgttgtttgctagtttttcttcaaacagtcaggcctttcttctgcaggtctgctggagtttgctggaggtctattccagacccttattgcctagatatcaccagtggagactgcagaacagcaaagattgctgcctgctctttcctctggaagcttcatcttagaggggcactggcctgatgccagccagagctctcctgtatgaggtgtctgttggcccctgctgggaggtctctcccagtcaggaggcacagcggtcaggaacccacttgaggaggcagtctgtcccttagcagagctggtgcgctgtgctgggagaatctcccttgtcaggatcagccagtatcttcagagccagcaggcaggaaagattaaatccgctgaagctgctaccacagccgcccctcccctcaagtgctgtgtcccagggagatgagagttctgtctgtaagcccctgaatggagctgctggatttcctgcagagagaccttgcctagtgaggaggactctagagaagcagtctgaccacagccgctttgctgtgctgtggtgaattcggcccagtccaaaaatctcccagtcgccttagcacagtcaggggaaaaccaccaactaaagccacagtaatgacggtcactcctccccccaccaaactcaatcatctcaggctgactctagactgctgtgctggcagtgagaatttcaagcaagtgtttcttatcttgctgggttccatgggagcatgggagtgggactgggacccgcttgtgagactgcttggatccctggcttcagccccctttccaggagattggacggtggtcctgactcattggagttccaggcatcgctggagtatgaaaaaaaaaaaaaatcctgcagctcagtgcctgctcaaacagctgcccagatttgtgcttgaaacccagggccctggtggtgtaggctcatgagggaatgtgctgatccgtggattgcaagtgtccatgggaaaagcgtagtaccttgggcaggtagcacagtctgtcactgcttccctttgctggaggaaggaggtcacctggctgcgtgcacttcccacatgaagcgacgccccaccctgcttctgctggttctctgtgggtcacacccactgccaaaccagtcccagtgagatgaactggatacctcgattggaaaagcagaaatcacctgccttctgcgttggtctcgctgggagctgcagacctgagctgtttccattcggccatcttggcccctccccttcacgttgttattaaaagggatttcatgcctacttcagcaatatgccggtgaaaggaagtcgtgcaaaaattagcagatcaagtggatatacttatagattttatattgaaaaccatcaacaaatgaaaatatttaatgcaaagctgccttttcattgaatatttacctgccagctccagagttcgaagtcctgattctttcttcatcagtcactgtcgtttcaaaaaccaaaggcagggcagagaccgatatttctgcactgtgtttggtctttattgtcaaacagtgcaatagaatgagttgacataaagaattcagaaaatgtggcaatggcaatattttacagttacactctattgcagtataaagaaaaataaacattaacttttaaaaatgctctatggtaaccaccttgaacttaaaattaaaagcctagagatatcacccgaggaacataattagaattctcagaaagtaattgcttagaactagaagacaaaaaaggaaaagtgtagtttttcctaaaaaaagccttatttccggagaagcataaagtacattctaacaggcgatagttgatgtgataacattaaagtaagatgtaacagatgctaaacatccgaatgcagatgaatataaaattttttggtctaaaataattaaacaaggtcaacctaggacattctaattttcagatgataattatatttgtattatatttaagcatagtgagaggcctacctggtttttggtcaaacatgttagaaggaaagaccaactctgtaggggctgaggtaagtcttggaaactataaatagcaaacaacctacttagggatgacatccaatttaaaaattataatggctcctgttttaaatgactcctgtatactttgggaaaaatatctatgtttaaaatgactagggattttatcattttgtatcttttttcagtcatggtttctggaagaaaagactcaagatgttctcagtagctgctgttttcagacatcatgaaagtcttctcctaccctctataaaaacaaacaataaaactctacaaaggaaaagcccacaaaaacatgctgactttagaagaatccatgatttagaatatttttataaatatctaagaaaacaggagtcctttccatatatatggtccttggagatactttccatatatatggtccttggagaatccagtttttatgagaaaggtgatttccaaaatctcttacactttacaatttcaattttggcctgagcatatctctcgattgatctacctacctacatactgatctatcttggatagagcactggacaaaaggtaggcactgtttacaatccactgacaagaaaacacatgaagaagcaaaccccacagcgctctgaaacctggaagagatgggttctacatgggtctgatgggattactgtactaaccagcctccgaatatcccgctccgactcccacttgatcttcgagatggcttcttggtgggactgatgctcactccgaaggtccccagccttgattttatctgcttggatcatattgctcagagcctcgtccacctgcttcttggccgttttcaggtccgcaatttcctgtaagagcttaaggcgctctgtgtcaaacagtttccgggcctcctcccgggcctcaatggtgagcgctgtccttactttgtcactgctgccgtcgcggagagcacagagagcagacttgagcctctggatctctccatcacgtaccttcaccgtccttgacatttcctgctcgtgctgcttgataaggttctccctcacagcctgcagctccttcatcttctcctcatggagcttggctttgagttctgtcaccagcaccgtgtgcttgcgctgctccagctcacgaatcctcttcgcttcttgagtcttctctctttcaagctttgatacctaaaaacagagaggcgaaatgatgaagagaaatgagcctcaaaggacgggtgtgctcctaggcaggatttgcagctcaggccgctgtgatctcttaattcctcatctcttttccaattccaggccctctgagaaaaaagaactacaggccttgaagctgggaatacagtgtgtaagaggaggaaatacctgaggatatttatattactttgttcagatgaatatttgatgttctggggccttactatgcaatgtgtggtctgcagacaagcagcctcggtatcacccaggaagcatgttagaagcacagaatccctggcttagccccagatctatgactcagaatttgcatcttaacaaatccccatgtgattggtatacgccttaaaattagaaagtatcgctatcatggtttttccctttacggggaggactgcaaaacagatcgcctggagagctttttagactacacaaccctagctagatccaaactgataaatgtgtgtcttagaatagctcacagtttgatattgtgataaggctaataaattagtgcctcaagtg

SEQ ID NO: 402 - DNA, 117552 bp, Homo sapiens
actgactctcatttcggactcatcccacctgcaccctggtgaaataaacagcttcattgctcacacaaagcctgtttggtggtctcttcacacggacgtgcatgaaatttggtgccgtgactcggatcgggggacctcccttaggagatcaatcccccgtcctcctgctctttgctccgtgagaaagatccacctacgacctcaggtcctcagaccgaccagcccaagaaacatgtcaccaatttcaaatccggtaagcggcctctttttactctcttctccaacttccctcactatccttcaacctctttctcctttcaatcttggcgctacacttcaatctctcccttctcttaatttcaattcctttcattttctggtagagacaaaggagacacatcttatctgtggacccaaaactccggcgccggtcacggactgggaaggcagccttctgttggtgtttaatcattgcagggaagcctctctgattatacacccacgtttcaagggtgtcagaccacgcaggaatgcctgccttggtccttcacccttagcagcaagtcccgcttttctaggggaggggcaagtaccccaaccccttctgtccttgtctctaccccttctctgcttttccggggacagggcaagtaccccaaccccttctctccttgtctctaccccttctctgcttttctgggagaggggcaagtacccctcaaccccttctccttcacccttagcggcaagtcccacttttctggggcaggggtaagtacccctcaaccccttctccttcacccttagcggcaagtcctgcttttctggggcaggggtaagtacccctcaaccccttctccttcacccttagtggcaagtcctgctttcctagggggcaagaaccccccaatcgcttatttctgcaccccaacctcttatctctgtgcccgaatcccttatttccgcaccctgacctcttatctctgtgccccaatcccttatttccgtgcccaaaccccttctctgcttttctggagggcaagaaccccccaccccttctccgtgtctctactcttttctctaggcttgcctccttcactatgggtaagcttccaccttccattcctccttcttctcccttagcctgtgttctcaaaaacttaaaacctcttcaactcacacttgacctaaaacctaaatgccttattttcttctgcaatgccgcttgaccccagtacaaactccacagtagttccaaataaccggaaaacggcactttcaatttttccatcctacaagatctaaataattcttgtcgtaaaatagggaaatggtctgaggtgcctgacgtccaggcattcttttacacatcagtcccttcctagtctctgtgcccagtgcaactcgtcccaaatcttccttctttccctcacgcctgtcccctctgtcccaaccccaagcgtcgctgagtctttctaatcttccttttctacagacccatctgacctctcccctcctcgccagcccaagctaggtcccaattcttcctcagcctccgctcctccaccctgtaatctttttatcgcctcccctcctcacacctggtctggcttacagttttgttcggtgactagccctcccccacctgcccagcaatttactcttaaaaaggtggctggagccaaaggcatagtcaaggttaatgctcctttttctttatcccaatcagatagcgtttaggctttttcatgaaatataaaaacacagcccagttcatggctcgttcagcagcaaccccgagacgctttacatccctagaccctaaaaggtcaaaaggccatcttattctcaaaatacattttattacccaatctgctcctgacattaaataaaactccaaaaattaaattccagccctcaaaccccacaacaggatttaattaacctcgccttcaaggtgtacaataatataaaaaagttgcaattccttgcctccactgtgagacaaaccccagccacatctccagcacacaagaacttccaagcacctgaaccgcagcggccaggcgttcctccagaacctccttccccaggagcttgctacaagtgccagaaatctgaccaccaggccaaggaatgcctgcagcccaggattcctcctaagccgtgtcccatctgtgcaggaccccactggaaatcggactgttcaactcacctggcagccactcccacagcccctggaactctggcccaaggctctctgactccttctcggcttagcggctgaagactgacgctgctggatcgcctcggaagccctgtagaccatcacggatgccaagctttaggtaactctcacagtggaaagtaagtccgtccccttcttaatcaatacggaggctacccactacacattaccttcttttcaagggcctgtttcccttgcctccataactgttgtgggtattgacagccaggcttctaaacctcttaaactccccaactctcgtgtcaacttagacaatactcttttaagcactcctttttagttatccccacctgcccagttcccttattaggccaagacactttaactaaattatcttcttccctgactattcctggactacagtcgcatctcattgctgcccttctccccaacccaaagcctcctttgtgtcctcctcttgtatccccccaccttaacccacaagtgtaagatacctctactccctccttggcgtctgaccatgcaccccttaccatctcattaaaacctaatcacctttaccccgctcaatgccaatatcccatcccacagcatgctttgaaatgattaaagcctgttatcactcgcctgctacagcatggccttttaaagcctacaaactctccttacaattcccccattttacctgtcctaaaaccagacaagccttacaatttagttcaggatctatgccttatcaaccaaattgttttgcctatccaccccatggtgccaaatccatatactctcctatcctcaatacctccctccacaacccattattctgttctggatctcaaacatgctttctctactattcctttgcacccttcatcccagcctctcttcgctttcacttggactgaccctgacacccatcaggctcagcaaattacctgggctgtactgccacaaagcttcacagacagcccccattacttcaatcaagcccaaatttcttcctcatctgttacctatctcagcataattatcataaaaacacacgtgctctccctgctgattgtgtccgattaatctcccaaacctcaatcctttataaaacaactcctttccttcctaggcatggttagtgcggtcagaattcttacacaagagccagcaccatgccctgtagcctttctgtgcaaacaacttgaccttactgttttagcctagccctcatgtctgcgtgcagcggctgctgccgccgtaatattttagaggccctaaaaatcacaaactatgctcaactcactttctacatttcacataacttccaaaatatattttcttccttatacctgatgcatatactttctgctccccggatccttcagctgtactcactctttgttaagtctcccacaattaccattgttcctggcacggacttcaatccggcctcccatattatttctgataccacacctgacccccatgactgtatctctctgatccacctgacattcaccccatttccccatatttccttctttcctgttcctcagcctgatcacgcttaatttattgatggcggttccaccaggcctaatcgccacacaccagcaaaggcagtctatgctacagcacaagccactagcccgcctcttagaacctctcatttcctttccatcgcggaaatctatcctcaaggaaataacttctcagtgttccatctgctattctactactcctcagggattattcaggccccctcccttccctacacatcaagcttgaagatttgcccccacccaggactggcaaattagctttactcaaaatccctgagtcacaaaaactaaaatacctattagtctaagtagacactttcactagataggtagaggcctttcctacagggtctgagaaggccaccgcagtcatttcttcccttctgtcagacataattcctcagtttagccttcccacctctatgcagtctgataacagaccagcctttattagtcaaaccagccaagcattttttcaggctcttaatattcagtgacagactaatagtctattaaaaacacacatcaccaagctcagccaccaacttaaaaaggactggacaatacttttaccacttttgcttctcagaatacaggcctgtcctcagaatgctacaaggtacagcccatttaagctcctgtatagatgctcctttttattaggccccagtctcatttgacaccagaccaacttagactgtgcccccaaaaaacttgtcatccctactatcttttgtctagtcatactcctattcaccgttctcaactactcatacatgccctgctcttgtttacactgctggtttacactgtttctccaagccatcacagctgacatctaccttttatacctgtttttctccttctcttattccatttagtttttcaattcacacaaaaccgtatccaggccatcaccaatcattctatacggcaaatgtttcttctaacaaccccacaatatcaccccttaccacaagacctcccttcagcttaatctctcccactctaggttcccacgccgcccctaatcccgcttaaagcagccctgagaaacatcacccattctctctccataccaccccccaaaaattttcgccaccccaacacttcaacactattttgttttatttttcttactaatataagaaggcaggaatgtcaggcctctgagcccaagccaagccatcacatcccctgtgacttgcacgcatacacccagatggcctgaagtaactgaagaatcacaaaagaagtgaatatgccctgccccaccttaactgatgacattccaccacaaaagaagtgtaaatggccggtccttgccttaagtgatgacattaccttgtgaaagtccttttcctggctcatcctggctcagaaagcacccccactaagcaccttgcgacccccactcctgcccgccagagaacaaaccccctttgactgtaattttcctttacctacccaaatcctataaaatggccccacccttatctcccttcactgactctcatttcggactcatcccacctgcacccaggtgaaataaacagctttattgctcacacaaagcctgtttggtggtttcttcagacagacgcgcattaaagttatcatttttatggtgagaatactttagatctactctcttaggatttttcaagaatacaatctattaataactatagtcatcatgttatacaatggatgccttgaatctattcctcctgtctaactgaaattttgtatcctttgaccaacatctccccgccaactagtccagcccctggtaaccaccattctactctcttcttctatgagatcattttttttttttttagattccacatgagtgcaatcatgtagtatgtatctttttgtgcctggcttatttcatttaccataatgttttccaagctcatccatgttgtcacaaatcacaggtttcattcttctttaaggctgaatagtattctacttacatgaataagtgcatacacaccacattttttatgctaaagatctactctcagggaagtgcaccaggacaccctttacctctcaacacactgttttgaagtacagggtatgtatatgtatcattcaaggtaggactagcttctgaaggacgtggaaaattaacatattgattaagttgtactcatagaatatctaaaagtacttgccaagctcacatggaagcacataataaaaagaacaacagaatatataccaaagttagcttcctctaggaattaggtgtcctctgagaaagaatttcaggatggttgatttgagatgatttctgttcactttctttagaagagaactgttattttataatgttgtttgttctctgaaaggatagttatgcacaacattaaaaaaaaagaagtggagatccgtacaccaaaaactgttgatttcagaacaattgaatcatttattttgtcttgaaaagagtaaaatgctagctcaagaaaaatacaaaataatttagagtaataagaggtaggaaagccaatcacatcaaattaaaaattattgaagactttaattcattctactaataatttattgcttaccgtatttgctagggttttcagagaaagagaatcaatagtatctaatctatatctgtatctatatctaatctatctaaaaggacttattataaagtgttggctcctgtgattatgaaggctgagaagtccctagattatcagtcagcaagctggaaacccaagaaggttaatggtctagtagtcccaatccgactctgaaggtctagaaccactagagctgatattgtaaattccagtctgaaagctggcaggcttgagaacaaagatgagccaatattagattgaatagctcttagctgaaggcagtcaggtaagagaaattcccttagtctttttgttctaatcaggtcttcaactgattggattagggctacccacattagggagggcaatcttctttacacattctgccaattcaaatgttaatttcaaagagaaagattctcacagacacacccagaataatatttgaccaaatgtctggccaacccatggcccaataaagttgacacaagaggctggggggcggtggctcacggcttctgtaatcccagaagccaaggctggctgatgacaaggtcaggggttcgagaccagtctggccaacatggtgaaaccccgtctctactaaaaatacaaaaattagctgggtgtggtggcaggtacctgtaatcccagctactcaggaggctgaggcaagagaatagttggaacctgggaggtagaggttacagtgagccgagactgcgtcattgcactccagtctgggcaacaagagagaaactccgtctcaaaaaaaaaaaaaaacaaaaacaaaacaaaacaacaacaacaacaacaacaaaaaacaactaaagctgacacaagaaattaaccattactccattacttctacagtataacagacacctaactgggtcctggaaatcatgtaagagaaaagttaggtgaatcctttctttgaaatttataatctagtggctcaacccaacttagaaatctcttctgcagtatttttgatatggaatcatattctacttctgtttagatatctctggggactaagatctagcagttataatttctaacacatagttgaccctgcttatgatttagatttaactctaatttattgaaaactattatataccacttctatgtgttctcttgtatgtttcatctcatgcatttgaactcataaacaatactgtgaggtgggtagtcattgacctgtttttaatttccagctgagaaaggtgaggtttaaaataataattataaatgaaaagaaaaattatttaagaattaagctttcacagtgaaactaccctactgtgttagctgtgctaatcaaatgaaaataatggtgctgatattgtttgaaaaggaacttatgctgttttgtaaacagtaaataatagaattgaatttccttgtaaacacaaatgcaagtactttatcaatcttctactaagatttcatttgaagtttggcttaatatagctacattaagagctacattaagtagttttttttctccatcagactaatgctgctctctagtcagaatatcacaaaatcaaattccttcatagtcctcaacacactttgatttttgtatggtcctccccaacccctccatgaccacaaagcaagaaatctccatgtatgcagggattatagttgtgtttttctacagtgactttttcatcctagggcagattctggatccctgtgggtgctcaataaagatttaaataattaatacattactttttaaaatccttcaacataggattataattgtgtacttatgagattatatttgtgtacttatgagaacctcctcaccccaccaccccactatagatttagtttcctgtatggtatggactatgtcccaatcatgtctgaattcccagtattaagcgcatggcctagcctagaataacctcagtcattttatgcttgctaatgaaagagtcctcactgagagtatctatccttctggcacatcgagaatacagacaaagaataaagctgtcaacaaaaaaacagacaggattgtggtaaggaagatggggcagaatacatagaagaaaaacagatgatgaatgggcatttgtctgactgttatcacctcatgcagttcagcccttttcacccagacttattctggggctgtggaaattatgcttggactccagttatttttaataaactatcttaatggtagtcttcagcagagctgagattctcttctcctttgtcaacccatcttctatccactttactgagtcactttttttctggttctgatttatttgctcaacataaaaaaaaatgtttttagcatctaccatgtgtcagacacttgcaatactgatgtcactcaagtatcagaaaagataactctgttctccagagtaccagaggacttgagatgagttctctgacaattccatagcctgtgaaatccccaagctttcgccacagtttctgctaatgcctgaagattaatattctactgtctgtcacttcttcatctccatgtgtggaatcttgctgcatacttggttacagaaacaaatctcagccattttgtgaatccctgaaaagattcacctcatataaaagcattattaaagaggggagaatgttttaaatattttgtggagacctgtgggacaccatcaagtggaccaatatatacataatgggaatgctggaaggagaggaaagaaaaaggaataaatatatatatatatttttaaaaaatggccccaaaacttcccaaatttgataaataaatctatacatctaagaagttcaacaaactccaagagtataaacacaaagaaattcataccaaaaaacattataaactatcaaaagagaaagacaatgggagaatattgaaagcagcaagaaagaagtaactcatcatttacaagggataccgagtacgattaatagattgtatctcagctgaaaccatggaggccagaaagcaatgagatgacatatttacagggttaaaaggaaaaagaaaacatatccagcaaaaaactaccttttaataataaaggagaaattaacacattttcagattgacaaaagctaagggaagttgttgctagtagatcttccctacaagaaatgctaaagagagtccttcagatgaaaatgaaaggacactaggcaatacatcaaacaaataaaaacagaaccccgttaaatataactacataggcaaatatgtaatataacccagttcattttgggggctgctttagggtttctgtccatatatttttaattatttttcccagaaaataggccttacttttctgtttctatgtgttatatttttttgttgtacttgaaaactagacattttgaatattataatgtggtaactctgaaaactagattatctttccctccctaatgtttgctgttgttgcttggtgagggcttggttatccatttgtttaatgactactccagactattttttataaagtctgtatttcctgtcatgtgtggtaattaaaatctctgttccattatttcagtcattagctagtgatctgacagagtttcttaaatttctggagccaaaaagacaacaacaaaactactctcttggtctacgcaggttggctttgggctgaaataatcattcaattctttgccattgtgtctacaaccctgccttggcccttactccctatttatgcagagctgaaacatcagccagaggtccagactaggatcttttcaggccttttccagccctaggcatgtacattgcactttggattttttagtatacatggtagcatttcaaactcttatccccctcaagactcttccttctcagttacctcctttctaggctgtatggtctgtctactgattgccccatctgccatcctttgcccttggcatctacatgtaatatatgtcattttttttctttttttgagacagagtctcactctgtcaccctggctggagtgcagtggtgcaatcttggctcactgcaacctctacctctcgggttcaagtggttctcatgcctcagcctccgcaatagctgggattacagtttcccaccaccatgcccggcttgtttatttatttataggtatggggttttgccatcttggccaggctggtctcaaactcctgaccacaggtgattcacccactttggcctcccaaagtgctgggattacaggcatgagccaacgtgcctgacctcgtaataaacatctttaatgattttgacgtgtgccacccacgctgagaaaatgaaataaaggcagtagtctgcaatggtccctcagggaagcaccagactggtcaaaatgcacaagaacagcttttgaaaacaaggtctttgttgctgcttggcatcatcaaatcacatcaggaatgtggaccatcattcccatggctgtcacctaactggtgaaagggaaatggtgagtaagcaaaagcatcataatgctttcttttcagaatttagaaaccactttcttcattaagcacccctttggttgtataaattgtttattagatataaggattatgaaaacactaatgctgtcagtttttgcccacttaagatactttagtggaaaaatcaattcttagagctccctattttgtaattttccatgatgctcacaaatacataaatacctcttgattcacagaattttcctgtaggattctatcccactgctgtacacatgcacatggcaaaatgatgtttgtctatagttagttattagttttgactttgtttgtaatagtgaatgattaaagacaacaccacattcattagttaaacaaactaaggcatatctatataatggagtattctgtagctacacaaaaaggattaagatctgtttacatttatagagaaaaatctccaagatatattaactaatacaagcaagtgtcagaccagtgtatataatattctattttgtgtgtaagttaggagcacgcataggaatgcctgtatatgtgtgtaaaaatccttctggaacaaggcccaagaaactaataaacggtaactacctgtgaagggcagacagggagtgggaactgtgtacatgggatagagataacaggaagaatttatactgtaaacttccttaaacttgttagcgtgacccatgtgagtgtactaattatcccccaaaataagttcaaaattcaataacttatcattacctttaggataaaatcctaacatcttttcatgaccttcaaggccatgcttgatcctacctctgcctttgctacctcatctttcccccactgtctccctatgcagcatgatgctatcacataagtcaggtttttaattgttttaatttttaaattttatttatttatttttgtagttgtttttttcccagttcctagaattttgcaaattcttttttcctcaaggattttatacctaatccttactctgcaggcatgtatattgctctgaaattcacatgggtggctttttcttgtccttcagctcttagagaaatattttgctaaagctctttgatagggccgggcacagtggctcacacctgtaatcccagtactttgggaggctgagttgggtggatcacttcagcccaggaattcgagactagcctgggtaagacagtgagaccccatctctacaaaaagtacaaaaattagctgggtgtggtggcatgcacccatgttcccagctacttgggaggctgaggtaggaggatcaatttagactgggaggtcaaggctgcagtaagccacaatcatgccactgcactttagcctggacaacaaagtgagatcttgttacaaaaataaaaaataaaaataaaaataaatactccttcatagggagattttcttcatccccagtattctctctcagcacactgtttttctttgtgtccttcatagtgattattcatttgtttgcttttatttgccttttttccctactaaaatctaagacacatgtccaagaattgtatcagtcttgcttgctattggatcccatcagtacgtggatcagtacttggtcaactaacatagtacgttgagtgacggaatgtgttaatgggggaagggggttaattatgttctcatatatgggtgcttgacttttttagattatttgtcttttggtgcagatgcttagttgtatttgtaaaattgggatgctgaaatgtctgatctgtaaggtctccagagagacttttcacaatacttctgcctcttcactcacaactattacacctataaagcttgaccttgttcttttctgtagtaagacagtgagctcctactgctagcaaaacttgccccacctctggtatcacagataggcagaaagtcatttgtcttgaacaagagcatcttctgacactgcacttgtacctgcagaacgtagcatgcagtattgccttttggtatttaccctgtctgtttgacctgaaataaggtctctatcaataggtaaccagattttatttttcctccacttcttctcttatatacagggcccaggcagtaatggatttcaaaacccaaattaaaaatataggccatataggtttaatatacatataaacactttggagccatttggctctgaacaagggtactagcattgtccaataaattgctcaacatagtgaattttagagaagacaaaacaacaaaacacacgtacacataaatacacacccacttaaagttaatactcttgtttccaaagtccagagctcacatggttatggagggagaacaaattggacaccagggacagggttcagtgctctagcaaccaagaacaagggagagagaactaccaagcccgtcatgtggtgcctcagaaggctaacattcagagacccgctagctgaggatgaatttgtatgcatgagtacgctggctgaaatgggggtgggagagctagaacaggaccatgtggggcatgctggcttccttcagtctcgaacgacccatcccacttcttttgcctctgaatctctgtttggagcagccactgaggtgtgctgttcactgggtggttactaatttcaggctccagagacagtcacatctagtgttcatggtgcctagttatctttttgacaagataggacttacccagccatcacggtggtggaaaccatcacagaatacattggatcaagcccctgcactttgcccaagggatgggcttgcttgagataagcccatttctgttttcaaattggctggtgacttctctacctgacagtattcatgtggaaaacagcccaactttctgcctccggattgttctctacaaggagctataaattcaagggccttgaaaaagcagagggccttgagaaaagccatcatccaatactggatcttattaaatgacagaagcataggttttctgatctgatagataagggttagttctagagcattgttatttcaagcaaatagtttactttcttcaagcctatttccaccttggtagaggaaacatctttttcatagatcatgatgaaatttaaattagatcacagttacaaacacctgtctcaatgctttatatagtaattggctgttttatccttctataatatacttttttaaaattaaatcctgtatttatttatagtgattgttacaaaatatttcaactgtagagaaattgatgtatatttatacacaggggaatgttatccacagagtctcttgaggattctaaaactgaaattgctttcctaggctcaaaattctatctctaaagtttgataccactttcacattttctactacaaagtagcattttaaatgtacttgggccacacaaccatcaatcacagttcttccactatgaattatagcattttaaagcttgtgacagtgagtaccgtcatatgtcacattgtgaaaaacacgagaatttcccgtgcacagtagcataaaggacttaccttcagcatgttagaaactgagctagcaatgattggactgtaatcttattttacctgaacaccttatatgccaaaagtagaataataaaattagtgaatgagaaagaaataaacagcatttcaggcaaaaaaaaaaaaaaaaaaaaaaaaggcaggacatcctgaggcctgtgggatagaaactatcaaccccaggcagcctggctctgtttgactccacatccagtccttgtcaggcccttatcctaaagcatttgtatctgttctccactatctcttactgcttaagtgagaaagtgagtctggatgcatagacagatgatgaaattatttaagaccagtttcttaggtaaaaaggagggatgtaccaagggctgacgattcacattctgggaaaggtagacatgagcttttctatacacaaggtgttgaaaaagcatcagggactgtagatcccaggatttggcagaagggttataacagatgtcaagtgtcatcacagtcattctggctggaggaactgtacctaaagagttcacattcatgggctggtttccacttgctctttcaaatatgggtaaaggaatagagaagtggtttccattcttttctatttgtgtatcaaagggtggactgttattggtgcctgctcagacctttgctgacttgtgtaccaagcctagaggaatgagagcagttggaaaatactactaccagctacacacatgcaaactgcagtgagcattctagataccatctgacccctcctgtggccacatgttccagtacttgttcatcctctccattacagggagactgtctacctgcctacacactccatagctcttagtgttataccggtcagctgctgatatccacaggcaaaagtctcagatagcctttaatttggagtcagttgtaaagaaataaaaattaacagttggtgccaaatatgtaacattacttgagttaagtgattcactaatagcagaaccatgacatgttggtgttgggctgcacaggattcagatgagaagcccaagtgtcttctggtataaatgggccaaatgatgttttcactgatgcagaaagaaaaggtagagaaagggagctggaaaagaacagcaaaatagcaaaagaatacaacatggagataatataatatcaaactgaaaggcaggaatgtagagtcagattcacccaggtttgactctggactctgaattctgccacttacctggttcccatcatccttcaattctgaggtttctcagttaaattatttctttgatgattccactagaaattataattaggtcagggcttagcacacaacaaatggatatgctattattattcttcatggttttccatgtaatactcccaactatcttgtgtggtaaatatcttctcaatttttcagttaagaaaactaaagcttggagcctttaaattatttgttaaagttcatatagcaaatttggtattgagatttgacactgtgttctctgaactcaaagtctctatttcccttagaattaacatgtcattttgggacttacatgtctgaattggaaagcagctgatctttttagagatttgattgaatttacatggtatgtgaaatgactctgctcagttcaaggaaggtggaatctgagctgattttctcattttctgaactgaaaaagtcaggcacagtaacctgagctggagaaggcttgggacaggcagacagacacatggatagcccaggtacttgcctcaggagggaccatcttacccctaggatggtcttctcgacccacgactctctgatatgctgcctcctaggcttcctgacccacagttacaggacagcaaatcccttccagatctcattccaaggttagcttcacagacaggctgagatcattctttcagtcctggcctgctccactatgctggtagacatcccgaataaatgagtacataaatgaacaagtgaatgactccatgggaaccatgaacagagtctacatcaagaagttatttaagcttctgcaagatgtatcagtctgctacagaggagcaaaatcacctgcccatctgattgggcaccaggggtgattgagcaacccttacatgggtgatctcattgatttgtgagtttctctgttttattctgcttttgtatctccttagagagactattgcagggctcaatttctctataaactaccttttggggatgcatactattaactgctacagagagactgataaaaacgagaatggatttaaaattagaggactgggtttccagtttgcaattcatggctgggtgatgaataaattatataactactttagattctcaattacattatgtgataaatgagtctgattaaaaaaagaaacctctttatagggctttctgggaattatataaggcagaggatgaaaaaattctttgtaaatggaaaagagttttaaaattgctatttaaaattttggttcacttaacactttggactctgactgatagctatatcttaatttagtcatttgctgaaatatttagttcacacaaattaactgaggaacggctatggactgagattaagcctgggaaaaacatcaaaatatttcctgaaaacatgacaattacattgccaccttggattgtgagatacctgggagacaggaaaatcatctgatttattcttgtgttcccattgtttgtccttgttctaaccctcacactcagcatctcgtgcttgtctcataactggcatttggaatgtatgaaatcatctggtgtattgaagatgaaatatcaaatgaacgccttagccaggtgtcaagcccctatcttttccatttaaatagtccttcaccttcccaatgtgaacacttctgtacagtcccactgttcttaaataccaaggccttggcccactcccaatcttatgtcttatatctacatattcctactttctgcctacataaatgcaatgcgttataaaggctcgtgactttctctatccaagaaaatttcccttatcttttcttccaagctcctagtaccttgaaattctagatttgataattcaactctcaaatgcatatgacctttgggttttttgccttattttagatgttttattatttacatcttttctactagtgaggaagctgggtcaaacacggcattaagtggcagagctaggatttgaactcaaggcttctgactcttggtccagaattctctttctcctacctagtatagggtatcctgaaataaatagaaagttatgatattctctttaccctgaaccccatttttagttagaaaaaacttacctatctctgaaatgaaccctgacacccctcgaatggagttaaatctatgtcttcttaaattatccaaaaaaagtcataccctcttaaaacatttcatcttattctagataaaactaacttattaatcattctaacatgtcttgaaggtattcaccatgctcatttctgtatttggaagatatatttacctagatagggtttacctaactagctgttaatatgcagtgctcttcagagcctggttaggcacaagctgagtttgttgttgtttgttttgtttgttgttttcatttgttgatgaatcaaatggagattccactaggtttactagatggttaaaagtagttagaagtacaatgtaagaactgttataataggggtgggggctaggaagataactcaatcagggatatcagggaaggattctgaggaggagtggtctgaaacagctcttccaggttttgccaggaggagcagttggtgaaggggcatccctggaagatggaacagagttcctatcatttaccatgtctccttggacagaaacatggcatatgatagagcatttggggaactctacgcagaacattattataggagcataaggacaaagtaagaagttagaggcactaagattgaagaaatcagtcaccgccatagtatagcacgcatgtacagcagattactgtgggcattttcccagaatttcctgatttttccattggaaaagcagagtttctttccatctgagggagcttatttaagtgtgttatcaattctccaaagggtagtggtaatcttacagctcaagaatgaagagatgtccacattcttaccacctggctttggaacaaaatggaaatgtccttgccacatttaaagattagagaagaaaaaaaattccattttacagtaattcctcaaaagatacagattacacccttatatctttagcctgtgcttacttggaattcttttcataagataataaaaaagggggagctactacaaactattctcgggaaattgaaatattaatagttgtgaaatattaatagttgtgttttgaatgggcttccttccatagaactgtagagatgttgtttggggttttttgttttatttgtttatttatttacttatttattgagacggagtctcactctgttgcccaggctggagtgcagtggtgctaacttggctcattgcaacctctgcttcctgggttcaagtgattctcctgcctcagcctcctgagtagctgggattactaggtgcccaccaccacgcctggttaatttttgtatttttagcagagatggggtttccttatgttggccaggttggtctcgaactcctgacctcaagtttaccacttgccacagcctcccaaagtgctgggattacaagtgtgagccactactcctggccttatttttgtttttgtttggccacagagaccaacattaaaaaaatcagccaaggacaaaagtaggaagccatgcaagaagaaatagagcttcaagaggtagaataaagctatttttgttttttcaaaaggaatcagggggaacagtgtccaagccattaacaagtttgtgtttggaaaataagctctttcttaaatcatattcttgaaaaatatttaggttttgaaaacaaattgtaagcaactcagtatttctgccagtaacttataaaaacaaaatattaaactttagggttgggaggaatctgaacatctagccagaccaatccctctcactggtcagataagaaaactgaaaccaaagaagcagtttgttcaaggtcaaacaacctacttctagcattcttaacctaggctcaaagaaggttagaactcaaatgcaactcttaaagtttatgtaatatggtaactaaattggatagtccctcaaaacataaattgtctttaagtgacaagatcaacaaaactttgaggatgaaggagcagaggagtaaacagagaaggaaagagagaaggaagctaggtacagtcagatttcctgcttgggtcaatttaaatttgctgaaaataatttttcagaataacggtaactaggactcatccttgtcagaaagttagagatatcccgtggtttgttcatcccataacaaacttcaattaatctttcatttagcaaacagggtggtcttggacatctcatacaacctgtggtgaggaattttgcatgggataactggaatgtttataagaactttgaccagcattaaggtcttgaaatgtagtctaaacatgaagaacaaagatctcacactgggatggaaaaccagtgatttgaagtcagggggctagtgttctcgtccctggtttggcagtttatttaaaacattaggcaagtaacccactcacacatcccctctctagtggccagtaattccatctgtaaaatggtggagttcaccttggagaaccttaagaacatcctcttgtttttatgcctctgtctacaggattatctctgcctggaatatcactcttttttccttctttgaagtcatcttccatgattcttcaggcattgcctctttcaggaaggtttgcttaccatacattcttaccctacagcctgtcctagcccaaatcaggagctcttcttcagggcctcaccccaacttgctcttattatctttatcaaaacactctataaaatattccagacatttaaaaaatcattatgatgataataatcacctaattaatgcctgcacgctaaaacaattcttggagtcccttattttggtcacagaatttagaaaaatgttatctcgaaattatcccttcactcaactatctcttcactatcttcgaggaagcctagaactcatatggaaatttcttggagttcctaaaatttggtaactaaaggatatttcatccaaactataacttgtctttcagggataaaagccacaaaaattatagggtgaatttagtggagcaaaaaacagatcaggagaaaaaagaggaacgtcagggataatatttaatccattctgaaattactagcatcaaactgctcctggtacacagtggacattagacattaaatatgtagttttgaaagtgagctaaactgtgctcgtagtcaagttatctgaaataatggggttataataaaaatccagtttctcataagcccaagataaaggtcaaccttttaagtatttctttcaatgacttaaatggacttatttgcagcagcttcatggcaaagccatgatatcactggtgacttctgtgtcatttatttaagcaatgtttcaattgtgctgtccccaaactgtagccaaaacaagctgtccaattccctgaggcaatggccaaggcttggaaaccatgagtatacacatgcctaattctcaaggggaaaaagcatgcttaaacctttaaagtacttacttgtattcaggtcttcaaagttgttgtttggctttatagtaaacaggataaaactgtctggagaaatgtgaacatttagagaaggagatatgcgtgtatatgctttaatgaaggtggcaactttattctttgaagtatccagagaattatgaaagaagacttagataatcacaaggcaacttctccagaaatgagtgctcatcagtgaaaaccatagtgtacctctgtgtatggttccttgatcctggtgggagaaactgcgattcattatgactgtgtaaacactggtgcagaggaaggagacttgatctagggattggagttgtcaaatgttccagtgaccttctgtgtgaccttcagcaagttgtttttactctctgaacctctgtttccttatctacgatttttctgtaattcagtgatttatatacattgcctggaagagggaccggcacatgagaggtatttaacaagcatatgttttcattccgtgatatgcagccttatcatttgcaacaacttcctagtctgcttattgcaaggtatctgggattccctagataaagtatgcattgccaaggctcatgcttttattttgctctattctctcaggagtgctttcttcctatcttttctgcctaaaggattgtagataaaatgaagggctgccagtgtaatttgaacctcaaataaacaacagataaaactgtagtataagtatgtcccatatattgcacaacacgatctttttgtttgcctaatctggcaaagatattgacttaacacacactaatctgttgacaggtaggtgaaatatttgaacttctacgttgcttctctaatcctgtcctctcttccctttctcatggcgtttagtaatccttttccctgtgtgcttagtagtactttgtccagatttttactgtagtgcttatatgttgctgtgtctatctgtcacttcatcttctctttctctttcgctacctgccacaatacacagtgcatccctcaaactttcaaagatccgatctttcacctgtgttctgagtcccatcccttcatatctttctaaatacgccacactggcctggttttcctcttacctttacggctactttatctcattctctccacatataccactgccttcttcagagaatgcaggtcttttccagggcttctttattcctgctttattgctttctctctcccttattgttttctttctctccctttttgtactctcttcctgtctgtttattaggcagctgaacttttcaagatctcactcctctctcagttacaccctcatttgtattttcagcctagactcttcatttgcattttagacatgcatatgtgatagcctacttgacatgtctgcttggctacattgcattcatttcaggcataatataccataataataaaatgataatatcaacttaaaataaaaaatgtttgagtggaaacaggaaatcaaacaacaaaagatattcattaaaatctcttctgcaggaggtgaagagggaagcatcttctgaaattgaagaacttggattctttaaaaactaatatgttgagaatggagagtacaagggaaatgaatgatgtgacttttccatagtaacaactcacattttccccataacattagaagatttattgaaggaaaatattggccatttaagggtttatttgtctagaaaagacaagtggtgggtgtgggggttaaactcaatgttcattattgatgggggcatgttgtactgtttgaaatgcggtgtttgttgaaattctcaaaagccttatcagaacaatcagtccatataaagccccaacaccaactgtaaaaccatgagagattttattgtatttaatatttctgagctggccaaaaccagcttttattcaagatggttttatgcttccacatttggactgcactagtctgtgaaaacaaactaaggagaaagttaaaaaaaaaaaccaactcttaatcttatggctccttttaaagagaacagctagatttggggagagaaatggatcaaggtggagaacaagacttaatcacttatttagcaaatacgtcatgcactgagcttaatttcataattatctcacttaatcctcactaggatcctgaactataagtatgacccttctcattttgtagataaagaagccaaattttagaaaagttatactcatgacggcaacataattttcaaggaccttgttaaaaaattattgagcatttcgaggtaccagtagcagaacataaaatcaggcatgaggcccttctaagcatagggctttatgtgacttcacaggtcacatgcccatgaagccggcccttgtcagtcaactcactccatggcacagagtgaataaatgggagaatccaagattaatattcacccatttacatttacgctatgattcatgctcctctaaaactctcaagtcaattcagtctttcccttctttcgtttattccccatttagctgttagacttctcttgtactattttacaaaaggctttttgaatgtattggtctttattttttcacatataaaggcttagaagtgagggctgggcactgatcactgtattgggtgatatcccaatgtcccatttccatcctgctcatttctttctcaaagtgtgtttatatgtcagccagctcttcttgtgttttgggcatatatcagagattatcttcaagaattaacatccacagaagctcagcttctgaaagtagcctcctagatgtttatagcccataaaatgcttataggatgtcagtcacactctggcaccacgcatctttgaaacagaaataatcctagcgaccactgaatccttcaatctcattttcgttttaaggttgttgttttgttactctaatttctgttatgatcggtatactgaggcccagaagaatcaataagtcgcccaaggtcatagagtacattaatgacaaatctgggactaaacaagtatcttaagcccaaacatgagattatttttttttaaaaaaatgagcagttgctatctagttaatctcttccttggttcactaaacagattcgtcaagagttagatatgagtcaggcgcagtggctcacgcctgtaatcccagcactttgggaggccgaggcgggcagatcacgaggtcaagagattgagacaatcctggccaacatggtgaaaccctgtctctactaaaaatacaaaaattagctgggtgtggtggcgcgtggctgtagtcccatctactcgggaggctgaggtgggagaatcacttgaacccaggaagcggaggttgcagtgagccaagatggtgcctccacactgaagcctggtgacagagcaagactccgtctcaacaacaacaaaaaggagttatatatgttctcaggttaacagctgaataaataacaaagaatgtcattgtgcctagcagctaagactgtgggaagactgagtctcccgttctatgcctcaccctgcagtataggaagatgccacctgggtcagctgggtcatcttggataaagtggttaccccttaaagactaatgtgccacttgcatggttaaaatcttggctcaagtggcttattggattatacagctttctcatgacagtcgcacgtctctgaaattctcatgaactgctgtttggaaagactacagttgctgaaaataaacaggaaccaaaaaatgcaagctgtcctctgttcccgggaaaacctaactgtgcaaacagcttcctacccatgagggacagtacagagccaggtataggatgactcactggatttatgaatcttctgtctgttgagtaagcaagcactgaggatgtttacgatatattttagtgttctttgaaggtgttacactaaatggggaaatgccctcacccttaatggccttaataatgctaccataatatcctgactacattctcataagcaatcttttctttctttttttgtttttgaagtcatccaggctggagtgccgtggcgcgatctcggctcactgcaaccttcacctcccggtgcaagcaattcttcagcctcaacctctcagtagctggaattacaggcatacaccactatgccctgctaacttttgtatttttagtagagacagggtttcaccatgttggccaggctggtctcggactcctagcctcaagtgatccacctgcctcagcctcccaaagtgttgggattacaggcatgggccatcactcctggctgccataaggaacctttatattagtgagtaatagcagccacacagtaagttcatgttgagtgtcttgtcaaatgctgactagcactatgaatataaaaactgatcacttgattgtatccagcagtccataacttatagaataaaataatttacagaggcatctaattcaggccaagcctcttggcaaacttaattcatgctatgaatatttattgatttaacattatgacagtctctgtgctagaactcaggtaggctgtccaagacaacttagagctcatggcttaactattccaagcacatgagtttactaacaatttccattgcatccaggaagccttcttttcttatctgaattcccattaatctataccattcactagacccttgaattccaggctgggttggaaaatcatccagcccagtatatcacaaagtgaggaatgtgcactattagtggtgtgcaagacagtttggcagtttaaactggtaaactttaaaaaaaatttataaataattaaacactaaccctcacagtgtgatgacaattgtgatggaggtgtgcccaacatggaagcctgttttgcttactgcataatgctgaagatgctagtgatgagtttttcacctgtatttataaaaaacttctcaaatccagagtctgtgtgatgagtggtcataagaatcaactctgatttctaagacttcctccatgtctcaatatcctgtttttccttctcttctttgggtgtctgagatttcaggtgtaaggagagtcttcttggtggggataatgtctaaacagatacaatatttataatctgataaatctcaaaggtgtgtctctacctaggaccatctcaagcttgagaggcttatatcagattgcctgttcaatgtccctacttagatacctagtacatatctttgtgcagcctgatccctgttgggcaccgtttgatgatgaagtggagactaaaatccagacacatctacttggaggaaggagtgcttttttttttctttttcctttttttttctctttttttgcaaaaagacaactttcacaagtcaagtgatgggttcttggggcttcctctacctagaggttcttcctaattctgtacagaaatcaggtctttctctaacttgaacaaatatatcctctaagttagtagtaattttgcccttaagcaaaaactatcatggtatctatgggaaaatgaaaaaaatttaagatgcctgaagaagctagaagtgaataataagactactttcttgataacttctacatatttttatatttttcatatttaaccttaagttgaggtattttgaagggagtgatcttactttactcttcacatatagcaaactgaagaaattttgctgagtgaatggatagacatggtcctagaaaacatattagaagtgggcaaatcacagtaacaaatcaccgtgtgtgtgtgtgtgtctacttagctatacattgatacaaacaattattaaaacaaagtagattgagccgtgagagggcttatttttcagatgctatttgaaaacactcgttaagccatactggaaggcttcaaggagctcactgttaagacaaaagtgaataaacagaggaggtaacaaattatacttagagctaagttagaatgaattcattcttgctatggaataacagaggaggagctttagccaggctggataattttttaaatcttcttcaacacttagaataattttagaagagtgaataggagtgactttatcagcagtacagaggatgaaatgtctaaaataatacttgtgtgagtgaaatgtctaaaatgctggggaaggatgattttcttgactagaggcatctgctgttatctggtggcccagagcttaggtttcaaaaaggtacagaaagggttgtgggaaataaattctggggcccacgtaaatttgaagatcagattggagatgcctcataatctgaaattcctaagatgcaacacatcagtgggtgaactagagaaaaccatgtttttcagaggcatgtgatggagttattggccttggttctgagaggaagaaaaaagaaaattcccttaaaacttcccaatcataagcccactctcactcaggtttagagctgtaattcagacaacctttgtggcacaaaacatgttaatctagactttaaagttctggattggtaatgcctctagacaaatttccgtgaggaatacactctcaacataggttttaaatatttctgacaaatatggacaagtgaattggaactcaaaataaaaaatcacaaagcacataaaaattagtggtattataaataaaacccaggagaaacatcaaacagtatagtcatatgcaaaagactacttgtacgaatatacaatgtaaaacacttttatattcattatgttcttaaaaagaaacaaaaaaatcaataagaagcaagaacttgttaaaaatgggtcaggtaaattaggtaaaagatcagaaattataggaataaaaatatgataattgaaattagaattacattggatatattaaacatcaattaaagctagagagaaaaatcaagaattgacagggcaatgtaaagagattaaacagagaacaatgctaaagtataataagatagaaaatacaggccaggcgccgtggctcacgcctgtaatcccagcattttgggaggccgacgctggcggatcacaaggtcaggagattgagaccatcctggttaacacggtgaaaccctgtctctactaaaaatacaaaaaattagctgggcgtggtggtgtgcgcctgtaatcccagctactcgggaggctgaggcaggagaatggcatgaacccgggaggcggagcttgcagtgagccgaaattgtaccactgcactccagcctgggcgagagtgcgagactctgtctcaaaaaaaaaaaaaaaaaaaaaaaaaaaagaaaagaaaagcaaaaggggaaatgaggagatgtgccatggagttatttgcatctcttggcaatacatgatagattagtaggtctgatacatgcttaattacagttctagacataaagaggcgaacagattgtcaaaaggcattatgcaaagcaatagtagcagtttagtgaatcctaagtagaaagacaaagacacacataaactaaataaattatagtaaaactacagtgacataggaaaacatcaatagcaaagagacattattaaaatatgacagaagaataaaccagcttaagtcaaaggcatgaaagttagactagctgctaactttaatccacagaaagaggagagtggaacatttcaaattattggaaaaaatcaagctggaattgaatatccaataataccaatttaaaaacaatagtaaaatcaagacttcttcagataaacaactgaattcactaccattactaaagtaatttaaaaaaataaaatttgggaaggaaaaaaataatccataaaagaaggtctggaatgcaacaagaaatactgagaaaaaaatgttacccatgtggataagtctaaacaaaccttgactatctatttgaaatctagaattaaaattctgcaataaacagtatatgtcatgtaaggataatgagaattactatgtccttagattcttgtgttcagaaagagaaagtaaatatggactaactttggatgaaatgaagcaggtacagtatttaatttcagagaaacactgtaataatagaaatctagtaggagacttccaaaacagcacagaggagggaacaatatggagtaaggagaaataaatccctaatcagtgaaatattttaaatgggcaaaacatgagaaaaaaggaaaaagcatgagaatagaatgcataaaataaaatgacagaaacaaatccaactatattaatactcaaaattaatggccatggactggagtttttaggttaaaaaaatcgctagattggattttttttccccaaatgagctctctgattttaaaaagagaaacacataaaacataaggccaaaaaaagaagtaaagaatgaaacaaaattttactaggcaaacagtaataaaactaggttgatataatgatcataaatgtagacttggaggtagaactctttaccagaaataaagaggatcactacatgttgattaaatgtttcttttgccaacaagagataatatttgtatgcacatatcatttagtaaaatacagagcacaaattaagaaattttcaaggaacaatggataaagccgctatcatattaaaatatttttaaaaacatcatcttctcacaattattagattagccatttgtttaaagagtctctgaggatacaggaaatgtaaatgtcacaattaacaacctggagctaatggatgagagaagttgtccctggctgtgtgtgtactggtggtatgaagcgtgtgtggatatatcccacacaccccaaaacccaccacaaacccaaaaaccgtgtttcatataacatctgaaaatgctagtttaaggcatattttaaaattagtgaaaatattattgaatattagaaatattagtgaatattagtgaaaatcaaccacataccagttcataaaagaagtctgaagaattagcttatataaaccatattatttaatcaaaacacacaaaataaacaaaaataaaacataatcaaatatgttgacaatttgaaaacatacatctaaataacttagattacaaagaaaaatattacagaaattttagtatgcttacaactgcatgattggaatacaacttaaacaaaatagtggaatccaattaaaagcagggcttagtgactaattcattgttttttatgcttttattacaaaataagaaagacttaaatttaagaaaaaattagaagagatttgcaggaggccattatccttagcaaactaacacagaatcagaaaacaaatactgcatgttctcccttgtaagtgggagctaaatgatgagaacacatggacgcatagaggggaacaacacacactggggcatatcgaaggatggagggtgggaggagaaagaggatcaggaaaaataactaatgggaactaggcttaatacttgggtgatgaaataatctgtaagcctgggggcagtggctcagtcctgtaatcccagcaatttgggaggccgagttgggcagctcacctgaggtcaggagttagagaccagcttggccaacatggtgaaaccccgtctcaactaaaaatacaaaaattagccaggtgtggtagcaggcacctgtaatcccagctacttgggagactgaggcacgagaattgcttgaacccaggaggcggaggttgcagtgagctgaaatcctaccacttcactctagcctagatgacagtgagactctgtctctcaaaaaaaaaaaaaaaaaagaaagaaaagaaaaagaaaaatagtctgtactgcaaacccccatgacacaagtttaccttgtaacaaacctgcacatgtatcactgaacttaaaataaaagttaaaaaagaaagtatttgctcaactataggccaggtggttcatgcctgtaattccagcattttgagaggctgaggtgggaggatcatttgaacccaggagttaaagaccagtcttggtaacgtagggaaaactatgtctctacaaaatattaaaaatttagctcggtgtggcgatgcacacctgtagtcccagctactcaggaggccgaggtgggaggattgcttgagtctgggaggttgaggctgcagtgagccatgatcatcccactgtactacagcctgggcaacagaatgagaccctacctcaaaatatatataataaaaaataaaagaaaaggagaaaaaataacaacagaattaaacaaaaaagaagctagaataaaaaaaaatcagaaaatactatagagcaaaattacaacctagtctcagataagccagaagttttctttttttcttttcttttttttttttgagacagagtctcactctgtcacccaggctggagtgcagttgctggatctccactcactgcaagctccgcttcccaggttcatgccattctcctgcctcagactcctgagtagctgggactacaggcccccaccaccacgaccgcccaatttattttgtatttttagtagagacggggtttcaccgtgttagccatgatggtctcgatctcctgacctcatgatccgcctgcctcggtctcccaaagtgctgggattacaggcttgagccaccgcacccgaccaagccagaatttttaaaaataatatatagtatttaaatgtgtgagtatgtaaaatgagttaaacaattagaaggcttcacaaatcttttaattagcattttgtgctatttaacaatcattttattattattattattgttacttttcaaattttttttagattcagagggtacatgtgcaggtttgctgcctaggtatattgcatgatgctgaggtttggggtacaaatgatttcatcatccaggtattgagcatagtacccaagtttttcaaatttttctccttccttccccactctagtagtccctagtgtctattgttgccatctttatgtccctaaatacccaatggttaactcccaattataagtgaaaacatgtgatatttggtttctgttcccgtgttagtctgcttaggatagtgacctccagctgcagccatgttgctgccaagcacctgatttcattcttttttaagactgtgtagtattccatggcgtatatgtaccacattttctttatccaattcactcttgttaggtacctaggttaattccatgtctttgctattatgaatagtgctgtgatgaacatgtaagtacatgtgtcttctttgttttcttttgggtatatacacagtaatggcactgctgggttgaatggtagtttgaaatttcttgagaaatctccaaactaccttctacagtggctgaactaatttacatttccaccaaaaatgtataagcattccccttaatccacagccttgccaacatctgttgatttttgactttttaatagtcattctgactggtgtgacatgatatctcgtggttttaatttgcatttctctgatgattagtgatgtggagcattttttcacatgttggccacttgaatgtcttcttttgagaagtgtctgttcatgccttttgcctatttttaaaggaattttgttgtttttgcttgttcaatgaagtttttattttgcttgtttaaaggaatgaggaatggtataattacttgcataaagaattgtctaaattccttataaattccgcatattagacctttgtcagatgcaaagtttgcaaatattttctcctgttctttaggatgtctgtttactctgttgatagtttattttactgtgcaggagctctttaatcagctaccacttgtcaatttttgtttttgttgcaattgcctacaaggactcagtcataaattatttcccaaggctgatgtccagaatgttgtttcctagattttcttctcggattcttatagtttgagaggtctcacatttaaatctttaatccatcttgagttaatttttgtgtgtggtgaaaggtaagggtccagtttcattcctctgcatgtgactccttgctcatttttgtcaactttgtcaaatattagatggctgtatgcgtgtggctttatttctgggttttctattctattccacttgtctatgtgtctgtttttgtaccaataccatgctcttatggttactgtagccttatagtatagttttaagtctggcaatgtgaggcctctggatttgttctttttgcttaggattgcttttgctatttgactcttattttccatactgattttagcatagtttttatgatttctgtgaaaaataacactggtagtctcataagaagagcactgaatttatagattgctttgggcagtaaggttattttaatgatatgaattcttccaatctatgagcagaatgcctggtgaaatgtttgggtgcatagtagagagggaccccctgcaccagaatctttgcacaagaaggatgaggtggcttaggctgctgatccaggtgagctggtgctctgaatgtctggggaccttctgagaaggagtgaagagggtcctggtgcatcacaatctatgtcccagaaggatgatgcaactcaggctgctgaacccaatgagcaggtgctacaaatgcctggagatccacctgggcatgaagcagagagggccccactataccacaatctcaggagagcagggtagggcatccagcaatggcacatgcagatcagtttcaggttaccaagctagccctgcctgcaagtgttattgcccaggaagaaccacagctgtaagcagctctcctccagctcttagggaggagagaacaattctagtgcctactgctgaagcattttccactgtcctggttgtagaggcccctagcccactccagagcagatgctcaaatctctgagccaagactaaagtgcctgtgcaagtaagcaactgggttgccaaggctgtaggcacccacattaaaaatcatgtcctgcctgcagacccaggtctggaaaaatgtctgtagcttttcccagagtctttccctcacagcatctccaagactcttcctaagttttttccagggcttgggagaaacaaaatgctctccctcagcctgggttgctcatatccccagtggaaaggtacgtcacagaaagaggctgtctgtttctcttacatactgagccttcaatcattttatcaactggacaccatcacaggggctgtttgccagcattctcctctccggcatctggggtgtcctttacaattccagtgggttcccatttttcttgaattaaagctcacagtgttgatctttatgtgctatcttgctatctcgctatctccaagaggcagaggcatgctgaaagcctctagtttgccatcttggagaaagaataaaaacagagtttgtttctttacataattaaaaccaaatcatagcaagattggacgtgaaagtgtaagagaagaaagagaaaggagaaataagtaaatgatactaaagagaaaaaggacttaatgacgcatgctataaatttttaaatgaaagtgttgtatgaactttcagctagtaaattgtacacctaggaaaggaaataggtgtacactgcagccgggctcagtggctcacgcctgtaatcccagcactttgggagcctgaggcgagtggatcatgaggtcaggagttcaagaccagcctggccaacatggtgaaaccccatctctattaaaaatacaaaaaaagtagctggacgttgtggcaggtgccagtaatcccagctactcaggaggctgagggaggagaatctctcaaacctgggaggtggaggttgcagtgagccaagattgccactgcaccactccagcctgggcgacagagtgagactctgtctaaaaaaaaaaaataaaaaagaaaatagatggacacttgcataatgtaaattactaaggagactagagaagaaaaagataatctaaatgtatttataaaaattagaaattggctcagaatttttctatcaacgaaaagaaaaaaataaagcgttttgggtttccttgcttttattatttttaatttacacataataattgtacatatttatcgggtaatgtgtggtatttcaatgcatgtgtacaatgtgtagttcaaatcagaataattagcacaactatcacttcaaaatttattattttttaaaaaaaccgtttaataggcaaatttaccaatagttatgtaacagatggttgtgattttatatagtctttcagatactggataaaaagagagaacttttcctttttcatttcaaaataatatatcttaataaaagtagacagagcactttcagaatattcatattcatgcacagatataaaaatatcaaagcattcataatctaaacctagcataaatctattaccactaatccagatggcaaagttgatttcaacattataaaatctattaagatatctttatcaaattgatctattaaagagaaaagtaaatatcaatagatttagaaaaaatatttatacaactcaacctccatttgtgaataacaacatcgactctccagagggcagtattttcctaggaagtaaatccacttagtctgaaaggatattgtagcagtcagtacaggttaggttacatagtccatcgtgacaaataggacccaaatctctgtgacttaaaacttcatgatttatttatcccttacactaaatatccagtagaaatcagcggggacctctgctcactgtatgtccttggggactcaggctgaagaagcaacaacttttggatattactagtcaccatgtcagaggaaagaggactctggagagtctcaaatgggcaagtaatgctctgatctagaagtgagacacatttttctgcttactacttattggctggaattagtaatatggtcttgggtaattagggtaggctaggaagtttacccaatcatgtaccgagagaatggataattttttcttttttctttctttttttttgacggtgtctctctctgtcgccaggctggagtgtagtggcacgatctcggctcactgcaacctccgcctcctgggttcaagttattctcctgactcagcctcccgactagctgggactacaggcgcacaccactacactcagataatttttgtattttcagtagagatggggtttcaccatgttggccaggatggtctcaatctcttgacctcgtgatcccccaccctcagccttccaaagtgatgggattacaggcatgagccaccgcacctggccaagaatggataattctttacatttagactcactaactataaacaactcacacaggactcacaagaactcactaaggacccacatagccagctaccaaaactgtatagctaccttcatgcttagtggcaaaatgttaaaacctttttccataaatccaagaaccagacagggtttaacattataatagagatcctaaccagctcatcaaggcaaaattaatgaattaattaattacactaataactaatatatattctttatgtatgaaatccaaaacaaataaattaacaaataaaattaataacaaagtagaacaagcttgcttaatgtaagatttatatacaatactcgatagatttcttgtaccaggaaaagttagacactttagttagaaatactatttcctaatagtaaatagatgaggtacctaggaatgaatctaacacatgatgtgcaagatcttttgtgtagaaagttaaaaaaaataacttgtatcacaaaagattttttaaaagtcctaagtggagagacatgacatattcatagaaacaaactactgaagatattaattcttcccaggttgatagatagatttaatgcaataccaataaatatctctgcaggattttcttttttgtggaaatgatgggtgaatcccgaaatttatatcaaagggccaggagcttgtcttaactttaaaaacaagacagggaaacttgttcaggcatataaatgagttgtttaaagccataataatgaaggcattttacatttctgcaggtatagacaaataaacaaatgaaatcacatagaaagctaagcaatgaaacaggcatttacgtaaacagtatataccaataatgacgttgtagagcaataaaggaaagcctgactaattcaatgaggcttaatgttgacttttcatacagaaaattttaaaataatgtttccttatataacacgcaaacactaattaaaaactacaagtttagaaaagagaaatatatatgtgcctgtggggtatgcaaataagaaaagctgttacacacaaaagcaaatcataaagaaaaagactaataagtctaactgcattttaaaaataagagcttctgttaatcaacagacatcatagagtgccagtgccccccacacatttggagaatgtatttgcaacattcaacaatgttgcaacacaacaaataaagtgttagtatatagaatatataaagtataatgcatgtaaccatatataaaagttaacaaagacattgacattttgtagaaacaggagcatgaacaaccaataaacatttgaaaaatgcttgttctcatcagttataagggaaataccaaataaaatggcataagattaccatttcacactcttgtgactggtgaaaaagaaagtacaatgatactgattgttgtaaaaggtgtagagcaatagcaactttcatatgctgcttatggaatgtacattggtccaaatatatcgaaaaataaattggtattgtctactaaatttcaaaaattcctacaaccaagcaattagattcctatgaatatcacctaaataaacttgcacatgtataccaggaaatgttctacaagcatgtttccaacaacgttgattttactagcaaaaaactggaagcatcttaaatccccatcatcagtagaactgacatactgtaaaatagtaattgcattacatactatgcagcagaaagaacatacagcaacagtacaaaaaaataggttaatttcaaaacaagattgattgaaagtagtatttcatgagaaaatatttgcagtatgatctcctttatgtttataccacaataaacagaggaatatttgtgaaaaaaatctatccagaaaaacaagatataattaacataaaattcaaaatagtggtcacctctgaaggctgggagaatgataatggaatgcacatggcagggccacataggcagctccaaaggttctttaacattctatttcttaagccgggtggagtatatatggctcctggttttcttagtatttctttttatatccatccatccatccatctatccatgtatccatggatctgtgtatcaatctatccagctatccgtctattcatttatctacctgtcttggtccatttgggcttctataacagaataccaaagatggaatcatttatagacaacagatatttacttcttacagttcaggatcaaggcactggcagatttagagtctggtgaaggcctgctttctggttcatgcacaactatattctgtgtctttacatggtggaaggagagagggagctttctggtgtcctttttagaagagcagtaatcccatttatgagggctcctaattacctctcaaagattctattttcaaatacagttgcattgggtattaggtttcaacatatgaatgggggaggcaaacattcagtttatagtgctatctatctatctatctgtctatctatctatctatctatcatgtagctaactagctagctagcttacatgtatttttctatataagatatagagtatttcataagaaaaaataaaatttgggtaggattttggcaacaaatagataaaggataaaagaaaaatctggagaatttcacaggcaaaggcactgatgcgtgaaaggcatttatgtaaataagcatgtacttttgaagaatgacatctaattcaagtatgtattcttgatgttagaaaaagtttcagagtcaactgaaaggcaggcaaaagcactgctgtttagatatgtggctcctttagggtggcaaattgaagacaaattcccttgtattattttccctttcctggatatttagccatttcactctcagggaaagggaggatcttaagagaggtacaagtggactgcagtcccaggagctgtagcttgtctggggggagaagcacagagctgcatgaacagggccttgctcaggttggcatcactaatgtgtaacccgttgcatggacatgtaatgtggcattagtaatgtacttactgcactgcctggcacacagttgtgctcatgaaatatttggggtatgaatgaatgaataaagcctttgacaatgaggagtcatgggaacacgtctcctttgttgatgctgtctccttctcctttttctttttttggttattttcgctttggctagagaaactttataacatttttcccctttccttttcagtagctggtaggggtgggaagactcgaggaggtccaagactaactgtgaatgggcctgatttccaatgatccttgcagagtgctgacagatgtctgacatgagagtgagattgaagaagctgccagctggagccagtagccaacctccttttctgtggaaatctccatagatggtggcagatcagatgtcaccgcatacaggctctacgctctttcctctcctctcattacccctcatttctccagctcacatctccttctaccctctatctgcttattctcctttgcttatgctttttcaatgaaccatttttgtacctttgctttgctcaatttcttcttgtactctttggaccattatttctctttttggcctagaggatctataagaaactaggagtatggttgaggcaacatgacttgattataaatctcatgcttttgagagttcaatttttccacctgtagtgtaatttccttctagatttagtttcctctcatttttgaattttattatagtttatctttaacagaaatataatgcaagttcattataaatgaaattcagagaggcataaaagagaaaaactataaaaatcatccagacagggcagctctttatgtatttgggggggatattattcttctagtctttgtctgctttttactattatttttccttttggaaattaagggcaccaatcacttcatattcttccttttcaggctgtaactagtgtaagaaagaagcaggagtgaaacgtggagctaataaaaatagaggctcgatagtttccaacttgtgaggcttctttataaggcagaattggagaatgtggctgggaactgaagtcaattgtcctctgataacctgaccagcaaatctatgcttccagacctactgtgaggagtattagatctgattatactgcactcacctcactacctgcatggaaaatagtacttgccttagaaacacagaataaagagcaggggacagagggtgaatagcaggagttcaggctcacctttaggcagctgagcctgcccatctccaggtgttcttagcctttgaaattaggaaaaccaaagaggaatccaagcccttctttcagatgtttgaggcagagaaacatgactgcctatttccaaactttggtacaaagtagcctcacccattcgtacaagtttgagtttgtattaggaaagaaccaatcaggaaaacagaaaccaactaatcattttaattatttaaaaaaaatttaacatgtagaatttaatagaaaaaatttaatataggaaatctaatgttgaagaagtaaaagaaaaaaatagcaaagggataaatgaggtaacaaaaggaaactgtagaaagcagggtgccagggttggggaacaaagggaaaaggctgggtttctccaagcataggagtatagaggagtggtcctagtcccaggcacaggactgtgttgggacttcaggaacttgaaggaggggctgcaaggagtgatgacttagatttagagctacagatgcttattgggcacccacaggtcttagtaacaggatttaaaaaacaatcacatcaattaaagaaaacaaaagctgcctctgcttgccagaaagagatggccccacataaacaagactgtattgtctcacatccagaggtggacagagacaaccagggaggtataggtcatgctttactttttaaaacaatttaaacagtacatcatgaatatacacttatttaaattatttaaagtttactaaaatccatagatgaaaaagtacacgttaccttctgctcactactctaaatagacttctaggccttttggtgaaaaacgtatacatacacacatacatacatatacatacacatacaatatacagtatgtaaatgtatattcatgtaatttggagttcctttagacattaatgggatcacaaaataggaagacaagtgcatagattctttttaataattttcacccaatattatttatcagaaaatttctattctttgtaaaggctgcactgttcttacaggaagaatcctttcaaattaatctgatcttttttccactattggacattcagttttccatttttcagagttataaaaatgttacagtgaatattcttaggcatatatctttatacagatgtgaaaataaatctgaggatagtgcctaaactaagtatttgataaaaagttaaatgcaatgcaagtttttaataaattcttccaaaaaagtattggtataaattatcagcaggtgttcctttttaaaaattatcttaccataattgatttttttaaatatttcttagtactgtcattttgatggggaaaatatcccattgtaccttcatttttaattgtttaaacacataaactttttaatgttaaagattaaattcatgttatctgtaagaaaatgatgtttaagctgtgtaataacaaaatattatttctttaactttcatattaaatcagacagaagctctttgaccacttactttttgtagagatcgggaatggggtctcactacattgcccaggctagtctcaaactcctgggctcgatcaatcctcccaacctggcctcctaaagtgctggggttaccggcattggccactattgcctggcttatagaccagttacttttaatgacatgttatttctagaaaggaaaagttactggtttgaataacttttcagaggattatttgtacaacttgagggcatttttaaaaacaactattaaatataacacacattccttgcatacaatttttattttccaagaagacaggtttacagagaaatttaatggatcagtaagagatatttcatagctacctgagatggattaggatgaatctgactgggatgaatatgcttgcgtgcctctacctttttctatcattccttattgaccttcaaggcaactcgatgcaaatcacccactttaaaaatcttcttcctgagacattgtgatatttttcccaaatgaagtttgcacttcctattacaacctccataggatgttgacagaacacttgtataataatttgtgtcaattcctgctatctctgctagaacataagcctagacaaaagccagggtgtcatggtctgacgtgcttggcgctacatccctagcacttagcacaaggcatggggcatatcataaattttgtaatatgtgatgagtgacctgattttgtgaaatgaaataaaactctcccttctacaaaagtgtcgaggaccattgagatgttgtatatggttaaaagtataaatttgctaagagggcagatcttatgttaaggctttttatcacaaaagaaaacaacagcagccgcagcaacaacaaaacccaaaatagaaccaaagggattgagatgaaagctttggaggcaatgagtaaatgtatggcattgactgtgattgatggtttcataagcgtatgcttatccgcaaaaacatcactttgtataaattaaatatccagagctttttgtgtgtgtatcaatctcagtaaagtagcgaaaacacaaaacaaaacaaaatgtaaagccaaacttatagcatggtgaaaagcatgatttcaagataactcactttcatatttaggtaattcagttgtcatttggctcccctgatcacaccccattctccttctctgctgattctatgacctgtgcatttccagtgaaagtcaaaacctaaccaaatattccacagatacccagcaactgatttctcggggcctcctctgcctcctgaactccttctttctctggtctctgttgatcttataacatgcatgatgttatttatttattttttttaagacggagtttcgctcttgttgcccaggctggagtgtaatggcgcatctcggctcaccgcaacctcctcctcccgggttcaagtgattctcctgcctcagcctcccaagtagctgggattacaggcatgtgccaccatgcccaggtaattttttgtacttttagtagagatggggtttctccatgttggtcaagctggtctcgaattcctgacctcatgatccacccgcctcggcctcccaaagagctgggattacaggcgtgagccacctcacctagcccatgatgttaatttcaataagaaagtcagtcatgtccttcagctccataaatccctattcacacaagggtttgtatagctctattaaaaaaaaaaaacatcccacatcaccaaggacttctactcatcttccccaatctctttcactctctaatcatccctttctccaaaggaccacagatccactcctgtaccccacatcccccattcttactcagagtgacttggcctgttttctctgaagcactggaattctccaacctctaatttattggaatgtaaatttctatcacagccatatatcaagaaaaatttttccagtaagaggtaatttactcctaaagaggaatctggtgctggttggtaaagaaataatattgtgctaaatttacatttacacatattacatctaaaatctgggaatgttttacatatgtggagttcagtctggcttttataaacaaatgagcactacagtaattactgcactttccttccataaattgttgggcatgcctatgttatcattcagagaaagcagagctagcttctcttgacccattcagaaagtggattgtgaatcaggcccagaaaaacatgcctttaaccccacagtaatttatgaggagagtagtttcaaaattttgctgagaattggaaaaaaaaaaaagcaaaagaaaagaaaaaagcagcataggagaatgcaagtgcaatagtcattacttttcaagccagtaaggacaagttttgaattaaaaaaagggaagatatgagttatatcacatcaaatttataggatattctttgtgagcccaccagaacaacgtaaagatctttactgaacaattaatttaggtgatttaggacaagatttgtttaagaatttttttggcatcccagtaaaatatagcagacctatagaaatgggcacaaatcacaagtgcatggctgaaaaaatttcacaattttattatcattattattattttgagagagagtttcactctatcgcccatgctggagtgcagtggcgtgatctcagctcactgcaacctccgccttccaggctcaagcgttcctcccatgtcagcctcctgagtagctgggattacaggcatgtaccaccgcactcagctaatttttgtattctttagtagagacagagttttgccatgttggccaggctgtgttcaaactcctcctggcctcaagtaagttctgggattacaggcgtgagccattgtgactggccaaatttttcacaatttaaggacacacccaaaccagcagacagatgagaaactgaacatggtcaactccccagaaaccctcctcttatgcccttcagtatcttccattagggtaactcctcttctgctgatacatagcttctaagagattacatttgcctgttgttgaaccttatattggtggaattatatagcatgtactccatgtattcttaggaatctggctttttaaattcaacattatgtttttgagatacctcctcactattttatttatgattattatcattattatttaatactattaatttcctactgtaaattgcattcattgaattgaaatactgaattccttctgttggaatagatttaccttttcttattgtttgtattttttctcttttattaaaaaaattaaaacaaaaccacagaaagtataaatcatctataatacacacacacacacacacacacacacacacacacacaacttatgctttccagggagtggaaactgactttacttgtgtcagattcttattttaggttctaagtctcaaatgatcttcttctcctcccttcccttctcttcctctccttcccctcctcttcctcctccttcttcctcctcatttctctctctctcacacacacacactttttgagtcaccctttctgttcaatgaaagccagtattatgaatagaccaacctagatctcccttagttttataactggcagctacaagaatgccgagcttccttctttcaccaggaccatataacttgggagaggatttttaccataggaaaggggattctataaagataaaaaggggggttgcataatcagactaggtaggagaaaatatgaacaccacagtacaccatgcttaggatccattatagctagtccatagatgaggtcttaatttgtgtcaatacaataataactcaatgagctaggaacagagacttttagtcagtttcacacctgaagtctagatgtgaaggacttatttgtttgatgtaaatatgtttttagcagaatttatggaaagcttggcatggctcctactttgattggctcagaagtcaagcatggccccattatatctacagagaggagtgatgagctgtgtgctgctggactaaagcccaagcgggctagccaagccagagcagtacccaccacactggccctggagcaggaccaatgcatgaatatcctccctagtctacctctgggtgctaatgtttccaatgagattgggaggcctgggcccgtctactggaggaatggatctcaggctttcaaactggctgcagaactaactttacatatatctgacttccctgacttattagagcctgctgaccctgggagatgacagctttggttggatggatgaaggtggggtgagaatgattaataaccagagtttctctggaatcaacattcatggcagaagataagtactaatcggtatagttgttgcacaggctgctagttgtgtgtattttcagataacggggttaggatattctcttacagaatattgttacacatcttatggatttagagaactggtaatatgtagaccctcttatactgtgggttcttggtactggcttagagcatttagctactgtttattgggaatacatagtgaaagattaaaatagaataaaattatctgatgctgtgttaattttcagagttgttaaaattatgttatgtgtaaaggaagggatatttcctattcatacatttaattagatagatggtgggtagatagattaaaaaaaaaagacttctaaatgctaagaattcatttaagcagtgcatgagatgctcttcatttaatccttagcacaggtctaagagttaggtactgatattattctcaagaacctggatttagaaaagatgataacttccttgcccaaagtcatacagatagttagtgaaagacctgcactctaaatacgggatgtgtgcttccaaattttaagctaagtttctacagtgtcccactgcttttgagggactcaacacataattgactctcattccctttccttcacgcttgaccaccacgtctgctcacagcaagagcaaatgccacctgctttctccacatgcattcagaacagctctgttcacaccaggggcattcttcccagctgaaactctggcctggagtctgttcacacagcctgagctaataaagatccaagaagctcctggcttcactgaaaacatcagaggcaaaagaatgcagaataggagcaatggatactgtccagaggaaaatgggctcctgttcgagcagaccttgtttcacctctcaagcaagggcagaatgtgggaatatgaggagtcccaagctgccatggaaacaaatgaccacaggttgtaccacagcattatttcatctttcctaacctctccctttaaattctcatattatctgcactagtatatttagtcatttattttttaacccaatcattgtttcagcatgcatcatttgtcaaatgctatgtttggtgttggagagatgataaaaggataaggcaaccctgcttactacctgctagagtctatttatctggtgggaaagtcaggtgtctaagcctagacttgaaggaagagtgggaattctccagtaattgggatgaggatggaaagaactgttttctgtatgaataggaaatgtggtgaggcaggagggttggatttgagagtgcataggatgatttcacagaattcagtcattcagtgtgacttggataagatatcacaggtggagagatacacggctgagtattaggagacgaagctggcaggaggtgcagggccagattgtgaatggcagtctaagcctctcaaagagtttgggttttatgcttctcaacacacttaggaaagacaaagtttatactgtatatcacatacaattgttaaaattaaggatcagatcatagaaatgaatcacttgaagccagattctgcagccaaatttggctaaagaagcaacagggtggaagaaagagaaatgatagaaagcatttaagagtgcaatttgcttttctcacctgaaggtgctggtgcaagttaggtttctgacctctccaacaggcatcttgtgccctgatcctcatcacccatcaatcaaagaacagccctgcctatcctacttcgtagttatgaagactgctacggttttgctgtgccccacccaagtctcatcttgaattgtagttaccataatacccacgtgtcatggtggggggcctcgtggcaagtgattagattacagggcagtccccccatgctgttctcatgatactcagtgaattctcatgagatctgatggttttataaggggctttccttcatttcatctgcacttctctttcctgctgctgtgtgaagaaggacgtgtttgcttctccttccaccatgattgtaagtttcctgaggcctccccagccatgtggaactgtgagtcaattaaacctctttcctttataaattagccagtcttgggtatgtcttcatagcagcatgagaatggactaatacaaagaccaaatgaacagtgactgggaaaggactatgtacttatttatctcctctctccttttaggtctctagcttgagatagagatatcactctatggcccacaaactaggaggttttattcttcagaagccaagagattctttctctaacagagtttcccatggcctggaagataacctatgactctctaacccagtaagcatggctgctggcctcttctctgttcattctactcatgaacccgatgctctggtcatgtggaattccaaatttgatatgctaaaaatgaagaaacaaaacgaaatgattccttgtatattctgtaagttgattccccacatccccacacagatacaaggcaaatgcaaaacactcagctaagaattcagccatctctgccttgcacatgtttccattgcccagatttcctcttttgatggttgtccggagttcacctgttctcagccctccctcttctgggaagccttttctgattttggtgcagccatcagtgagatctcttttctttgtacccacagcaatctacaattccaatattgctttaacctctacaaacaaccccttgaactcagagtgaaaatagagtcacatttgttggatgtttccagttgatctctcaggtccccagatgcttcatgactgcatacatcactccatcctatgacttcattattgtacagtgttaaatttttggagtactctctcaacagaaaaaaaaaactgttaaaaatgaacaagcagaacaaccatcgcaacaacaataaacacaacatgagcttatgaaatccccaacctctaagataaagcaagaggaggggtgtcagataagagcatttctctcattgctttcagctgccaaatctgtccctttagaaactgctaatctctgctctgacaggccatacggctcatcttgccacaagacctcacttgtccaattgtcatgccacctgccgtggttcttcaagggagaacatgcttatatattcttagctgagccaggcaaagaggtccccaatgtggagttctctatttgaaaatcctcatactcagctctctcaggtatgtagccaagttatctgctagacccaagaattctggtcaaggaagtgactacgtctgctatatcaccagcctagaatccctgtgccctttccttcctgggaattgacttaagggggcaggcagatttttcatgcacaaaggatcagactgcccttcccttatataatggggtgacagtctcatccttccaagagatgtgtccttagttcctcagttttcttttatggaactctaacctcagtgacaaaagagtgatttatctttccagtagaggctcatcatgggatttcaaaatatctacatgtatgttcagatttgcaaagtaccctattctctttttccccagttctaggagagactgctcttgatgaatcaaaaatggtttcctggcatgtgtcttgttgagaacagaaggaaaaacaaaatttaatcactggcatatatcccaccacaatcaatttcacgattctataatgcaattgcaccatttcttgctaatatgtgctattagacagcagatttgttgagagtgggaattacatcttacctataaccattaaggcattacaccttaattctatccatgcacagtttctaagctagaacctgctgcggagttgcactctagtgatttatttattatttcactaaagaaagaagactgaatgagtgcatggatctcctcctagagtcctttctgggcaccatgttcaaaatgaaaaaggtcttttatctgtggtcaccaaaattatatttctgaaaaagatgctgaagtttgtctttgataagctctcttacatgtaattacctatgttcctggctatcttttataaagcagcaataaactcaagattgtctaataacaataccagtggaagtactatgtgcaaagaccccttgggaatcccaggatggaaacaccttccattaaaaaaggtaacagtctcttccttggcaatacaggataatggtgatatcagaatatttcagaacgtatgtgcctacttatcaacaggtatcagtgtgaagacactgtgtacaggttctggctctagctctgctgccaacctactaagctagctttgataagtctttgtccatctctggggctcagtttcattttctccaaaaagcagtggaaggaatgtattatctccgtgatcacttggaaaaccacatccctgcttattaatctcctggaagctcctatggattacgtacctaaaatcagacatgctggtctagctcacaggccctttccctcaacactgaccctcatctgactggtgggccagccaagacttaatatttaccattatgttgtgtccaaagagaactgctgtgatctggtagtggggatttggagttttcaaaatcctgaacagtggctctttactgctccctggtggtataagtgggcttctgatgatgtccaaagaaaacgttttctctctgagatgtagactccgctcttatcttttggaaggcttaatgagccaaatatgtaacatgccagcacaatgcctgctaccaagtagctgctgaataatgcatatttatttgtcccttccaaaggaaattggctacagatagttatgttttgaagattctttaaaaatattaccattatagagtaggaatttagagcatacaataataatgataatgataataaataataatagcagtaaatcatgggtatttattatataacaccaaaaaaactaaaagtaatcaagcaaaagaggggtatacaaactctgaaaaaaatgaaaatttatgtatttgctcattcttttatttataatttgtgaagatgataggaataaggggagtctaacacttattagagtctatatttttccatgttttccatgttgatatttaacacctagaaaaatctaatcatgcagaagtgaatagcctcattctacataggagggaactgcggctcagggagacaaatagcgtgctgaacgttccaagagcaatgtgtggccagcatctataatttaatccaagtatgccttgccccagacctttgctgtttctaacatatcatccagctttctgggggctttaaaatcacttcatcgtctaccccttgaaaagacggagaaacaatgactcagagagagatgctctttctccagtggtatgctggtaaatgtttaccaaccaagtcagggtggtggtgggcagggaccaatctatggtatttgctgatttctctgtttaaaaaatactctcatcatgatctattttattgaatgtggagttggaaagtaacgggctctcgtgtgctggcagcacatgactgctcctaaattttacagtgacagcttacaaatatttattgagtatcaacatattccagactgatgtgaacaagaactcaagtgtctgggccaactccagctcccttctgctttctggctctggacaatagaatctgagatgtcattctgctacaacctcaccaattggccattttagcctctgattctgcccttttcctatgactctgacttcatgatatgagaatatttagtatcaaggtgaggtggcaagacattcatagagacttaaatgagtcactgtctgcctatagtaatgccccttagtatgggaaagagatgcccctctcatggtgtggtaccaatcagcatcaggatctctgcaatatgcttatgccagtggactctatgcttcatgaaggcagaatatctatctttttatatacagttgcatttctagagcatagaaagatggactgatccactgtaggtacataataaataattgttgatggccaggatattagaatttcactgtttatataaattgcttattattctatgattttggaaaggacatttaaaacctctggaagtcagtttctctatcattgaaatgaagaaaatactagctactatgaaagtttttataggattaaaatactgtacatcaagttctaggtacatagtagaaaataaacaaagaaaattattcttttccttctcctccttctcctcctcctcctctttctcttcctcctccttctccttctcttcctcttcttcctccttctcctcttcttctttcccactactttttgtttttattattattgtcactattattattactattattatttaattattttttattttcaagaatgccataatataaaccaggcttatgagacaggtagattctgatcacaacaccttatatatatttggcagacatatttacatcatgcatctcagccaatactcataacttccctctcttaaataggtatcaggtagttcattttataggtgaagaatgaggtctgcacaattagtacctcctgggatttttgcacaaacaaaaagcttctctgcttggataactcttctgtggtgtgctttaaagctaagcttgtttgttctactatattcaaaggctacttcctctacctgaggcagagtttgctgtttctctctttgtgctcctgttgcatgggataactttatctaccattgtagcttttacttgtcatttattgttccttttattaaaagcctatttcttgacaacctcctggctgtcagaaattttgctcaggctttaggaatgtagtgagtagcaaaacagataaaactttctgacccaacagagcaaagatgtcatgagacatagacgttaatcaaatagccataaatacactctatatgaaataaacaggcagctggaattgagagagcgaaaggtagcttgagattagactgagttttttaagcaagggcaacattatccataattgtcctactaaggatttcaggtttttatcctaagaataataggaatcttcaaaatagtttaaacagaagagtgacttgatcagaatttaattttaaaatactactgtctttcttttatagagaatacagctattttccacactacttaaagacacagaccatgttcagtattcctgtagcatctagcaaaatagttggcatatagttggcacctaggattgttgttaaaatagtaaatgaaatacagcaatagctgagatttatatatatttataaattatgtaataatttttatttataaatcatgtaataatttttattatactttaagttttagggtacatgtacacattgtgcaggttagttacatatgtatacatgtgccatgttggtgcgctgcacccactaactcgtcatctagcattaggtatatctcccaatgctatcctcccccctccccccaccccacaacagtccccagagtgtgatattccccttcctgtgtccatggatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttatagtcctttgggtatagacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgaacattttttcatgtgttttttggctgcataaatgtcttcttttgagaagtgtgtgttcatgtccttcgcccactttttgatggaaccaaaaaagagcccgcatcaccaagtcaatcctaagccaaaagaacaaagctggaggcatcacactacctgacttcaaactataccacaaggctacagtaaccaaaacagcatggtactggtaccaaaacagagatatagaacaatggaacagaacagagccttcagaaataacgccgcatatctacaactatctgatctttgacaaacctgagaaaaacaagcaatggggaaaggattccctatttaataaatggtgctgggaaaactggctagccatatggagaaagctgaaactggatcccttccttacaccttatacaaaaatcaattcaagatggattaaagacttaaacgttagaccttaaaccataaaaaccctagaagaaaacctaggcattaccattcaggacataggcatgggcaaggacttcatgtccaaaacaccaaaagcaatggcaaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcagacaaatttacaagtaataatttttatatataaattatgtaatcatttatatataaatcatgtaatcatttttatatataaattatgtaataatttatcatcttgtcagtgatctactcaagtagccactgttatgccagttgagagttgagaagactaaaatcctgaaggatggtgttaattggtagagttggcaggtggtgaagccagaattcaaacttggcctatgagattccatcgtggctgcattctttccacagaagtatgccctgacccatgctacgttttgtggcctcttatggagtctgtgcaacaaggtagattctgagagaataaaagcttttgccaattaccccttctcccccagtttcttaggcattggagatcattctcatctaatacctctatgacatcagaaacatcctaactgttcagtcatctctccatcttcctgttgcatcaccttcaagctccagttgatacagtaggccccctgtatagctgtgtaacttgggataagtttcaagattcccagtagatgcctgaaaacacagatagtactgaaccctatatacactgtatttttttcatatgcatacatacccatgatagagtttaaattataaattaagcacggtaaaatttttacaataactaatactgaagtaaaacaattataaaaaataccgtcccctatttcatggatagaagatttgctctcaccctagatcttagcaatgtcagcataccatttttattttctcattaggtagagaactttcaccttttcacttaaagaaagcacttttgtgtggcttctctctggtatatctgaattgccagcatcactactcttgccctttgggattattattaagtaaaataagggttacttgaacataagcactgtgatactgcaatagtccatctgataaccaagatggctgctaagtgactaacaggtgggtagtatagatggcatggagacactggacaaagggacaattcatgtgtcaggctgggtggagcaggactatgtcagatttcttcacattacagaggatggcataaaatttaaagcatatgaattgtcaatttctggaatttttcatttgatattatgagaccacggatgaccatgggtaactgaaatcatggataaggtggtaaggggaatactgtactcttcttcccagcatcaatttcaacaccagcttacagtgcctcaccatcgttcaatgtctctggatcccaatcaatgtgggtcaaaccagttgctcttcatttttctttagctagctatcagaaacacatagtccagtgtcctagaaggctgctcccaacttctacagcaaatctattctacagagttttgaactcaaggtcttctatggtgttttatagctcatgtatcaatatttgctttgactcccagtaagagaaacccttaaacaagtgtcataaataaatcatgaattttcttactcatatacaataagaaatgtggaggcaagtaatccagggcttccatggctatttcaagatgccagtggagactcaggctcttcctgttattttcactgagcctttctttagcatgtgtttccaccaaaatggcagatccacttccagcatcatagtcatgatctaaaccaaaaaaagagggaagggcaaggcataaaaggtacatgctggctgagtggacccccttttaaagacctttctctgaagccttacaaatagctctgactatgtctgattggctagcccagtcatatggccactcccagctgacgtttttagttgggctattaatattactattaatgttaccaaagcagtcatttactaaatgccaagatgctctccatcttatctcacttatttctcagaacagccccttgaagaatacattatgaattggaggtatagagtgggttttctgctttctggagctacaagtagaattggatcttgactactccagtgctttctcaaccactatggcctttttttctccctctgagatgatctttcatgaaaaaccacattatcatttggtgtcagcattttaattttactataattaaatagttgtttttctgtgaaattacatggtacccacaaggctgagaattaaggaaagcagaaataacctaaagggtatgaagaggcttcgtagaagctacacactggagatgggtaggcttttaaaaattcctaccctaacctctattccagtggttcttaattgtaaccaatcatcagaatcatctgagaaggtttagaaaatatatatatttctgaatctcaactgaagagtctctacttcaggatacttagcatggaaaccactgctctattttttagatgactctgaaggtctctgaagttggccccctctgcatagaaactggcttattctttctgaatacataagtattatcatgaactctctgtatgctttgtgaatgcagcacctcatggaaacctaatatttgtatgatataaatagcactttttattcccattttccagataatgcaatagaggcttatgaagtaaaagtcacttgattaaggtcatataactaatatatggtgtttccaggatcccaagccaagtcagcctgactttaaaaccatggatttttccactctgacatgttgccacgaactgagtctgtctagggagaacattcttcaggcatgctagaatcatttctcaccagcatccccacagactccatgctgactaataaatgcctacacaaatcttatatcattgcttcccagaagtccctgcctccatggtttccccagacctgttctgaaggccccagaggactgatagatatgatctattcagacaaattgggaacaggttgaaggagggctgaggaataaatgggaatatcaagccaggccagaaaattgacattccaaacaattttcagttggcacaaagtgatttttccttcagcatttttcctcttccaattttgtaattcatgtttatttcaagcaaaattcagtccatctgtatctgattcattcacacttaatttatcagcagactgctctgtcagagaaatatatgccaatgtgcctctaaggttttacaatgaaatctgggtctgtctgaaatgccagtgcaaagtggcctgtgagaaatatatagaggagcaggtgaagctggcttcacaccttcttttccaacacacacatccctcccttttgctttctgtttgtcttaagcagctctaatggtctttaaaaatagttttataatcagccttctgtaccagtcttttttggtcttctggccttgtttcatctactcataaacatgctcacatttctcatcctaaacacaaaacaaacatgtcctcagacaaaaaaaaacattaactccaaatacccttctccacctccattcaccctcaaaagcttctccataccaacttcacagaagtctgcaccatgcaccttgtcgcccctactttctcattcctctgtcgtaggcatctgtgtcccccactctgccaagtccttctaatgaaagtcaccttggaattgccaaacccagtggttatgtttttcttactatttgatcaatctctctgttgcatctgatgttgttgacagttccttctttcttcacactctctgctgtatagctgttggtttccttccattcttcccctcatcttagctttcttctttttggtctcaaactttcctatctttccatattgaaaaacaatgtattctatgctctccattcttaattgaaggccctgataacagaatatctgggttcaaagcccactctgccacttcccaacaatgtgactttgaacaagtttattaagattctctatgcctcagtttcctcaactggaaattagagaaaaacatagtccttctctcacagagctgatataaagattaaatgaatttatcactcagaacattcttcaaacagcacctaatgccataagtactcaaaagatttaactgatagttgcagtactaaacacaatctaatgatttgtaaatgcttatgtagtaaggttgatgatagaaaataacatattctaatgaaatcctcatgatttttaaaaaattatgttgaatgtatattctactcgataggaaacaatgtccaaatctctagatgtaaaagagtctatgtggttttactcatgtatattacctaaatttagaaactaagattaaaccattgcctaataattcatcaaacaagcaaaataaaacctaacataataatgatttattgtttaattaatattttaactttcaaagtgcttttctcatgctttgattgaaaacaaaaatattggtcttgtgtggtatacactcaaggtttctagaattaaagaacacttctatttaaactggccaaaataatagtaaacataccccacaaataattttttactgaatgcaaaatagtatgcaaattattattgatgctttttgatttatttggcaatggaccaataaaaagtaatatacacattgaaacaggttggtgtattagagtaatggggttttaaaacaggagacacttggcccttgaaaaataaagtgaactgggtgaggtttacatgatttttttattttagtttttccttgagacattccccatatcatgtagaaagaggaagctggaactcaagcaggaatcatcatcattgttggcttgagaagtaagcaaagtttggatttgccacaatggcttgaaagtgagggaaaatcctgcaaaggagagaacataaaggagggagctcccaagtctgcatataaacactgcccaatgttggctgactatgcaagcatgagagagattctgaggtatctggcagaaaactgcagctagaaatatggaagacatttacatttctctcatcctgaaacatttcagctgctgctcactcatggggagacagaatatcaaggttaaatcaaattaactatgtggtggaatgaaaatcagtactcttaagaggaaaatacagaattcagtatctataatatataattcacaattttcaacatacaataaaaattactatacctgtgaataaggatttataagcaacgaaaaagaaactatgcaagcgaagtccctgaaatgatccagatgttggaaatagcaagaactttaaagcagctattataaatgtgttccagaacttaaaagaaaatacgaccattacaaacattcattacaaatgcccaaatattaaccaaaaaataaaaattctaaaactaagatgtgaaataagtagaattttaaaatcactgaatagcttaaacagaatattagagaaagcagaagaaagggtctagaagacagatcaaaagaatgtattcaatctgaagaacagagataaaacattaaaaaaataaagcagggagttggggggaggtggggatggttaacggatttaaaaaaatcagttagaaaaaaattaataagacctagtatttgatagcacaacaattttctatagtcaataatgatttaattatacattttaaagtaattaaaagagtataattgggctgtttgtaacacaaaggatacttgaggggatattccattttcaatgctgtgattatcacacatttcatgtctatatcaaaacatctcatgtacctcatgaatatatatgcgtactatgtacctacaaaaatcaaaataaaaaatacttcaatatttgtggaataatatcaagcattctaatataccaggaattggaatcctagaagaagaggagataaaggaaccaaatattttaattaagaaaaagagtattatgcagccagaaaaaagaatgagttcatgtggtatgatgcagccctaaaaaagaatgagttcatgtcctttgcagtgacacggacgaggctggaagccatcattctcagccaagtaacacagaaacagaaaaccaaatgccgtatgttctcattcgtaagtgggagttgaacaatgagaacacatagacatggggaggggaacatcacaaactggagcttattgaggagtggggggcaaggtgaaggagagcattaggacaaatacctaatgaatgtggggcttaaaacctagatgacaagttgataggtgcagcaaaccaccatggcacatgtatgcctatgtaacaaacctgcatgttcagcacatgtatcccagaacttaaagtaaaattaaaaaaaaaaaaaaaagtaaaagggttttacttggatttgatgaaaaaatagatacttacaggtgaaaaagcccaggaaaccctaagctaaatgaatacaaataaactgcaactatgaacattgtaggcaaacatcttggaaaagattgggtcggggggagaagaaacagagagagagagagagggaaggaatttgaaagcagccagaaaaaaaaaaaaaaaaaaaagaaaagaaaccttgacacattacatacagttgatcaaataaacaaatgatggtgacattattagaagcaataatgctagggtgacgtgacaatagaagagcctcattaaagtaccaaaagaagaaacaaatctactactagctcataattctataagaagagaaaataccatccacaagtgaaggtgagggacttctgttgttgtctaaggtacagaaaactggaaaaaaagtgtaactttcatcctgataatgagaaaaataccagttaagccacaaaatcacagctttccttgaagccatcagaaagctgagttcacacagccaccaggtagctgacaggatcctctaagagacatgagatgggatcctctcagctgtggcacagcacagaagcaagaccttgccaccatacaagcagctaaaaaggaatcagataaagtagtaacaaagtggttcttaggatttgcttatttttaaaaaaagatttgcaaataataattgtatgtatttatggggtacaatgtcatgttttggtatatgtatacattatgaaatgatgaaatcaatctaattagcatatccttcatctcacctacttattattttttgtggtgagaatgtttaaagcctactttttagatcctggagcatgtgactgctgttgtgggccatgggctgctgactgtaagggatatttaacaagagagaggaagagaagatggcatttctgataaaggttgtgatacaaccacaggattaaccctccctcttgaagatcatcctgtaaatgagatgctatgtataccaacttcccaccacctttgtttttctgttcagtaatcctggtgtggataaatgaagtcttcgcgtgtatgttaaaaaaaaaaaaaaagtctacccttttagcagttttgaaatatacaaagccaagtgtgggtgagtgtgagagtatagaaaccctggaagcctcacattaagaaaaggattcacagccacttgctgggtcatttccatggaccatcacatggtgctcaggagacagaagaggggcaggatgggagactgaacagggcctccttttgcattgcaggcatgaagtaggagagggacaagctggacttcctgctcagaacctcttctcaaaatcattaagcctcagggggagtgcgagcatcttctatctctcctagggcatcagaaaagacccattgcttcttggaggggaaagtgtagcctagagcaaaaacattctctaccccagagagaaagaggtaagaaacagtttcatgttagaaggcttctaaggcagtgcctagagaaaataaaatagtttcaatgtttatactagaaaagtaaagatttagaatcaacgatctaaatgttcacattaacaagatatacaaataaactcgaaattagtaaaagaaaggtaacaaagttcagagcagaaatcagtaaaataaaaaatcaatagagaataaaaataaagtgaaaagtaggtccccaggaaagtgtaaaactttgataaatctctaatgaagactcatcaaaaataaaaacataaattccttatataatagagatgtaattactaaatgtcccatacatattccaagcatagtaagagaatattaacaacatgccaataaatacaacatgccaataaatacaacatgccaataaattcaggtgaaatgggaaaaacagtcttgaaaaacaaatacaacttaacaaaaagtgaccaatacaaatttaaagagctctatatcttttaaaaaccctggttctcaaagttgaatccccaaaccagaactattagcatcatgcagtaccttattaaaatgaaaactctgcagcttcacctcagaactactgaacctgaaactctgaaaatgatattcaacaattcgtgttttaaagcccctacaggtcattctgatgtatgccaaagtttgagaattgctatttttaacaaattaaaaacattactgtgaaaaatatttccacaaagaaaatctagcttcagctgttgttactgatgaatgttatcaaacatttaaggaagaaatgatagtaattacaaactttcagaaaataggaaagaagagaacactttctcaccccttttatgaggccattgccctgagagaaaaacctgaaaaagatattctaagcaaagacaaaatgtagtacatatacaccaaggaatactatgcagctataaaaaagaaagagatcatgtccattggagggacatggatggaactgtaggccattatccttagcaaactaacacagaaacagaaaactaaatactgcatgctctcacttacaagttggagctgagtgatgagaacacatggacacaaagagggggacaacacacgctggggccttttggagggtggagggtgggagataagaaaaaatgactaatgagtattaggtttaatacatcggtaatgaaataatctgtacaacaaacccccatgacacaagtttacctatgtaacaaacatgcacttgtacacctgaacttaaaatttaaaaaaaaagttaaaaagaaaaaagaaaagaaaatgacagaccaatacatcttgtaaatttaagggcaaaaaaataactaaaacattaacaaattgaatccaacaataaatgaaaagaataaagctgcctttgtcccaagaagggaaagtcattcttttatattttaaaagtcaagcaatacaatttattatgttaacagaataaaaggaaaaaacacaataatatcttaataaattcagaaaaatcattggaaaaggcccaatgctcactcatgataaaacttttaataagctatgaatagaaagaaacttttctcaatctgattaagtatctagaaaaagatttagagttcacactgtacttaattattaaaaattaaatgcttctttgtaaaaatcaagaccaagataagaatatccactcttaccattttgagtcaacattttactagaggctctggtctatggaataaggcaaggagaaaaggcatggggtttagaaataattaaaactatttgcattgttgtgtatagaaagttctaagaaatataaaaagcaattactagaaaaaaatgaacttaataagatcataggatacaaatggatatgtgaaaattatctttctatatgtcagcagcaaacaattgaaaaataatttttaagttatactatagcatccaaaaccatacaatatttaggagtaaatttaataaaatttgtgcaagatatacacattgaaaaccacatttctgtgataaatttaaaaagatctgaataaacagaaaaatataccataataatggactggaaatctccatattctaagatgtcaattctcaaattgttctataaattcaaggaattcccatttaaaaactcagcggacattttttgtaagaaattcaccagtagattccaaaatttacacagaaatgtaaaaaactgggaagagttaaaacaatttttaaaaagaagtacaaagttaaatttgacttcaaattttactatggaactgcagtaatcaatgtttgtatgagagcagacctacattagcaggaaacaatacagaatccaggaatgtggcacactgatatgttctatttatttttatcaaatgtgccaaagtaattcaatggagaaaggaatgtcttctcaacacatggtgctgaaaagcagcatatctgtattgaaaaaaaaatcttgacccctgtcaaatcatatacaaaaattaattcaagatagagcagaaatcctaatgtaaaagctaaaattaattattttctaaaagaaaacttgaaataggtaaagattgctcagacaggatcaatcaaatttaaaactttttctcatgaagacatcgataacaaagttaagaataacaagccacattatgggagaaaatatttataacacgtatgtctgaaaaggtcttttattttgaatatacaaaattcagatatcacgataaaaatataaataatgaaataaatgaaattacatcaataccaacaaaggatgatatatgaatagctgataaacatataaaaaattctcacatcaggaaaatgcacacgcaaaccaaaattaggtaccactaaaagaatagtggcatcaaatattagtaaagttggatgataagcagattctcatacatttctggtgggagtaacaaattaaagaactgctttggaaaaatgttttggtattttattatgaagttaaatatatctctgttgtctgacttggcaattccactcctaggtgtttagccaaaagaaatgagcatatatgtttacaaaatattttctaaaatatattcacagaaaccctatttataattgcctaaaactagaatgaataagctaatcatggtataatcatataatgaagtaatattaagtaataaagatgaacaacttacatactcagcaacatggccagatagcataaacttaatgctaagaacaaaaagccagacaccaaagaggatgcactgtatgatttcatttctatgaatttctcgaataggcaaaactaatctatgttgaaaaaaattattcagagtggtgcctcctggtgatattttaactaataagtggctaaagggaaaattctaggttgacagttacattctatagataggaatgtgaattatatggatggatgcatttgtcaaatcttatggaattacaatttaagattgtgtatcttccagaatttcatttggtcttaaaaaaggaaccacattaaaaaaaatctgtaaacctctctgaatccacagccaagactgctggtttggttgaccttgaatgcaaaaatgttgattaaactctatcctcaatggaaagacacgaaatgcagtattgtaaggctcctcaaagtcttccatatttgaattagtgtgtgatttctgctgtgttgaagccaacatcaatatttatctgtaagtgggaaagcctttttcttgccagaatgtgtaagttctcttttcctcttgctataaatgggataattcctaccaaacagtttttgaaaacgaatgagtggaacattaatttctctacagcacaattctctagctttccaacagtgtcaactgtttgcacatgtttagcctgccattggtgaggctatggatttctgaagataaatctttaaaagaaattaaaatgtttcttagtttatgttttccctcaaatcaattttcaaaacttaattagcttcttttcatcttaactttgcttagtaggaaaatgcatctggaatcatctgttggtgtcctctccatggtaaataaaattctgatggcatttttgttgtcgatttatgttaaaaatagtattatgtattatatatttttaaaaattgaaatttcattcaatgcctggttgtgctataagcctgacaagctgtaatattctattacttcagtaaagacttgtgagaacctattgaaagtacagagataaagacaaacctgtaaccagaaaatgtactttataatagaagacagacaactacactaacaactgcagttattaaagggtgtgagaaagaccaatccatacaaatagttggttgactttgggtataattatgagtggcagatagcctaatgctgggggaagtatattagacaagatttcagaattcttttccaccttcgttactgctgcccccatcaccttagtctttgactggtttatttcaatttcttttagatctcagatcaaacatcatgtctttagagatcttttctaaaccttcagcctatgaggtatccttgttatgtactttcacaacacccttcaattttctttataacctttatcacaattgcaatgaagacatttttgtgtaattattcatctaacatcgatcttacctgctgaagtgtaggtaactcatttgttttagtgtttgttattatgccggtgattatcatattagttggtacatattgggtgacaaaaagattcttactgaacaacaaaaacacacaaaaaagaaagaatgagagaatactcgagggaccaatttttcagtacagaacctttctgagttctttttctctgtcacctaaacgaacaacatgcaactggtatggctacgccagaaaccaacaatgggcatgcatgtagtgtgagcaaaattaaacccctgctgctatcagtggctaagattccagggctgtttgttgtaacaacataacctatcctaatagaagcagtggccacatcccaagttcacttctgctcgctcactcagtaaaatgtgtaccaaatgccatggtgatatctacaggttaattagatgtgggccttgagctcctggagctcacagtcccttcgttctaatcaaatatagccctccctgagttcagaagaaatgctttcttcttacataatatgaaatttcagatatgagttgtgtagttatgagttttgaagttagatagatctcagttataaaacctagaggtttaaaagtttcttaacctctctgaaatttatatatattttttaattttttgctggtgtcgctgttaagacaggaataagattgctcatgtaggggttaactcttatcatgagtctatcccacaccatgcattcaatggcggttatttgtaataaaataggaaaagggagaatgcattgttattattctgtgaattttgcattaaattcctttatatgaaatcacctcgtactcgctgttaaagaaggcctctgtgtcttccttgtcttacagtatctacacagagctggacctgcagcatatactaaatgaatgttgactacaattctttgaggatttagaggagagattcaggaatttaaagcctaagggtgtcaggggaaatttcaaaatgtcaagaaatttgacacatttaaagtgaaattttgaagggtaggcaaaattttgatatgctggagacagggcatgattatcagagaaaatagcacaagcagacatgcattaggaacttccggggatatgtgagacaaatagtaagtggttcaatttgggtaggtgcagagcatataaaataagaaattttgcaaataggtaggccaactccagaatgcagagcatcttgaaggacaaataaggagttgagcctaaagtctatgggaagcagagctattgagagcagctaagaaagaagaagtggaaagagcagtgcttctggaagtctgtcttgaaatgcagtgctaggttgactgctttatacttaaagttgtacaaacaacattattttaattttatgtatgagaaaagtgagattcagaagttaaataacttgtcctggttgcaaccacccgtaagtggaaagataccatataaattcagcattgtgtttgatgccaaactatttagtttttttatttaagacaaaaacgataaatttcactttttaaattttatagaaaatttatagaaaaatgattttttaaatttatagaaaaaaactactcatagataatgcagctctgtggtgtcttaagcaagtccaaatgagtttccttaacttgtttatatttttcccaagatatattttgaagatgcttgtgaagtatagtgttagaagacaagccattaatactaatgctaattagaaaagtttcatttagaatgtctttagaatgtctagatcttttatcactagtaaaaaaaaagattactacattaatatttgatttctaactttcttatttacaatatctacaaatcaagaaattcattaacatcgtagaaattcatcttagtgcttatcttttgttttagtttctgtgggagattaaataggtatccaggctatgaaagttcaacaaaatccaagttcatgttccatactggaggtgaaaactgaggaacaatttggtggtgcaagatgtagcctacttagtccaagtgacacagaactatgcactagggcttcgtattgcccaaaacagaaaaaaaaaaaaaaaacaaaaaaactaagaaggatcctagtgtgtgtgttgagcatatattcttagtgattcattgttcacattcagagggtaagtcctaggaaagcatatataaagaagcttggtataacaataattgtcatttattaaatgcctactctgtgctggattttaaaatccatattatttgtaacctttacaactccttttcagggcatgtactgccatctctatttgatgaacaaaatgaggatcagaacactttaaaaaatatatctaactcttctagctagtttgtgcctaattgaagatttttgacataccttttaggagtcagacacccacatgcttttatgtcagccactttgctcaaggcctctttaactttgccatcttgtgatcctgccaatcatatccagttccttctcttaaaatggaaagagaagatgagtgcagttgtgtgcagataagtaggcttgttccagtcaagaatgaactcattggaacattgtcttcttggtttttgcttctcttttgttctacggttcacagccaccctttccattatacttttgatgaacaactatggacataaagctctattaggcaaatggtcactcctgttgccctgaagaagttccacctctcctcattctaccttgtccttcctagcagaaaggatcagtgccctgcaaatagtgagaatttagcctcttacgagactgatgttggatagtgtgagagtttcttgaagtaaagaacatcacagcataaacatacagaacatggtccaactcaatctagacttcaatgtctcaagtacacataggaatcaattcctaagctcagcaggaatcatctcactcagtctcatgagaaatttaataattgttgtttattaaagctgtctgtatttgcccaaaagagtaaagacaaaaaaaaacttcaaaagaattttggtgtctcaggactatagggagtcagaaggacaggtggagaataattctttaagatccggctctggcctctgctcccagctcccctctacaaacattgcaaacaactttaaattcttattaagtagttatgttcttcccaaagtctttttccttcagttcactactaggattgtttatcctcttctgttttgcgagcaggaataaacttttcagactctctcctcaccttattcttccaaacacagttattaactaaaatttaactttattaatcccattaaaagtgggcaaagaactgaataggtatttttcaaaagaagatatacaaatagccaaaaaacttatggaaaaaaatgctcaacatcactaatcaaaagataaatgcacccagccgggcacgatggctcaagcctgtaatcccagcactttgggaagccgaggcaggtgagtcatctgaggtcaggagtttgaaaccagcctgaccaatagggtgaaaccccgtctctactaaaaaaacaaaaattagccagcgtggtggcatgcacctgtagtcttgagccaagatcgtgccactgcactctaggctggggcagagccagactccatcttaaaaacaagaaaaaaaaaaagataaatgcaaattaaaaccacaatgagatactaccttacaacagccagaatgaccattattaaaaagtcaaaaaacaataaatgtatagattttggcatggatgtggtgaaaagggaatgcttatacactgctgatgggaatataaattagtagatcctctatggaaaacaatgtggagattcttgaggaactaaaagtagatctaccatctgatacaacagttctactactgggtatctacccaaaagataaaaagtaactatagcaaaaagacacctgcatgcttgtgtttatgcttatgtttattgcagcacaatttacaatcgcaaagataggaaatcaacctaaatacccatcaactgatgagtagataaggaaaatgaggtgtgtgtgtatgtgtgtgtatatatatattaaatatataaataaatatattatatattatataattatatattatacatatttgatatatatatttatatatttgatatatatatttgatatattatatatttttatatatcaaatatattatatattacatatcaaatatattatatataagatatatatcaaatatatcaaatatataatatatttgatatataatatttatatatttataaatatgtatttatatataatgcatatatataacatataatatatattttatagatatatatacacaccatgaaatacttttcagccaaaaaaaaaaaagaagtgaaataatgtctttggcagcaacttggatgaaactagaggtaattattttaagtaaagtaactaaggaatcaaaaactagataacttatatactcacttataagtgggagctaagctatgggtacacaaaggcatacccagtggtataatggatattggagactcagtcagaagggggaagggtgcaaggtgggtgagggctgaataactacctgttgggtataatatacactactcaggtgacgagtacactaaagtcttagacaatccatacttgtaaccaaaaacctcatatacccctaaagttaataaaataaaaaaattaagaggaaaacttaattatcttacctttgtattatttaaaacaacttcagatctttctctgctttttactaccctcccaaattatagacctagacccatcaggatgttcattaaaaagagggcagaagtgcccgtcttcttaggagacacctaaaacattactcactgtgatggttaatattgagtgtcaacttgattggattgaaggatgcaaagtattgttcctggatatgtctgtaagggtgttgtcaaaggagattaacatttgagtcagtggactaggagaggcagacccacccacaatctggctgggtaccatctaatcagctgccagcacagctaggataaaagcaggcagaggaacgtggaaggactagactggttaagccttctggcctccatctgtctttcgtgctggatgctccctgccctcgaacatcagactccaagtttttcagcttttggactctttgacttacaccagtgatttgccaggggttctccagccttcagctacagactgaaggctgcactatcagcttccctacttttgaggttttgggactcagactggcttcctgtctcttcagcttgcagacagtctattgtgggacttcaccttgtgattgtgtaagtcagttctcctaatacactcctatagggggaactcgcccccaatatttcaatgtaggttctttctaatttccctaagtgtcagccagtctgagaaataaagagaaagagtacaaagagaggaattttacagctgggctgctgggggtgatatcacatattggtaggtccgtgatgcccacctgagctgcaaaaccagcaagtttttattaaggatatcaaaagggtaggggatgtacgaacagggagtatgttacaaagatcacatgcttcaaagggcaaaagggagaaagatcacatgcttctgaggccaataaagatcacaaagcaaagggcaaagcaaagatcacaagtcaaagggcaaagcaaagatcacaagtcaaagggcaaaatcaaaaactcctgatgagggtctatgttcagctgtgcacgtattgtcttgataaacatcttcaacaacagaaaacagggtttgagaggagagaaccggtctgacctcaaattcaccagggtggggtttcttccccaccctaataagcctgagggtactgcaggagaccatggcatattttagtgcttatctcaactgcataagacagatactcccagagcggccatttatagatctctcccgaggaatgcattccttttccagggtcttaattattaatattccttgctaggaaaaggcactagcaaaagttggcagcaactttaatggatattggagactcagtcagaagggggaagggtgcaaggtgggtgagggctgaaaaactacctgttgggtataatatacactactcagcgtatatattccctacttgcatgtccatttataggctctctgcaagaagaaaaatatggctctattctgcccaaccctgcaggcagtcagaccttatggttgtcttcctttgttccctgaaaatcacggttattctgttctttttcaaggtgcactgatttcatattgttcaaacacacatgttttacaatcaatttgtacaatagtggccctgaggtgatatacattctcagcttacaaagataacaggattaagagattaaagtaaagacaggcataagaaattataaagtattatttgggaactgataaatgtccatgaaatcttcacaatttatgctcacagattgcagtaaagacaggcctaagaaattataaaagtattaatttggggaactaataaatgtccatgaaatctccacaatttatgttcctctgccattgctccagctggtccctctgttcagggtccctgactcccgcaacacattccccttcatatatacatctatcctattaattctgtccctctaaagaaccctgaccaatacactcactcagggcgctttgtcatttttttccccaaagaaatgcaataccttcttaaagaaacagtttaatgaatatggctgtctgcattcaattacatgtgtccttaattactgggatgtcttctttgctggctattgagccatctaaaattcttagacatatgcagagcttagataaagaaataaaactagttagtgtcagaagtagcaccagttgacttgatgtttttcttccatatccaaaatagtgtgagaaatggatactagatttaaaaaggaaaggaaatgttttccactatttatttctattttcttatttactgtactaggcactttacaagcatacagtctttcattcctcaccattgtcctgcaagatatacattatccccatttgacagatgagtgaattgaggctcaaggggatgaagccctttgcctatataggtctttctggaaagctttggtctttccactgtgtgctttgacacagtgcaatagtgagctacttcggggaggattttttgggcagattgatttttattggtattattttagaaagaataccactgtaagtctgaactttcttgcattggatttatttaaagaggaggtggcctagagtgctttgattggattatcggagtttgtctccataaagacaaaaaaaagagctaaaatgtccaatgcatatttacatatcaagccaaggggaaatgatcttgctgtagtgatgcactagagcagtcgcctgttatgcagagaagcttcatatattatttcacaggggacctcctgggccaggggacatgaaaatgtaacatttggtagtggaggttgtagtatgtttcattgcagcctcatgctctggggtaaccacagaatgttgtatctggcctgctagggtcactgtgaaatgacttggacaaattgtatgtggcttttctaggagcaatcacctcattgagtctttcgtgggaaaactattggtaggaaaaatgaaagtgaggattgttaatatattgctgaagcttgttctgtctaatgtgggtgatgtaactcagccagtaagatgtgtgcctctaggacacagacattgaagtttattcattgcagtatttcctgcctcagggatattttttgtggtttgcctttaatccagtctaccatgcctgacaccatctgtggctcagtctgaaaaaataggggaggctggaacaagtacaacattgcagataaggcaatgtttaaattaatcttacagaaaggatagtaattagctggcaaagaggaagtgaggacagtcgtctcaggaaaacagtaagtgcaaatgcactgaagatgaagcagtagcacgataggtttacacctgtacctgtacctgaaatagaggtggagaggaggagaggatgaccagagacgatgctgaggagcttgccagtaactacatgttgaaagagccctttaattcagcaaagggattaggatcatattctgaaggcaaggggcagaaacccaagggttttaagctgaaggtcagatttttgttttggaaatttgactctatacaaaacaaaatgaaagtatcccaaaacttgcatacaataaaagatacctaaacaaagaagaaaggcaagtaaaataaagaatgccaatacacgtcctaaacatccctaataggaacaggaagttcacagaagagatctcattttatacttaagaaatcatgctcaatctcactagtcctctaggtaatggaacataagacagtaagtaataatttgtgccactctgatcaacatgttttaagacattggaaaacatctactgcttatgaaagtatatatacagtgttggtaaaattgccaaaggcttttgggtaagttatttggtagcatcagaaaacattgagaacttctaaaacccttagagttgacagtctcacaactagcaatctatcctacagaattaaaagcccagtatgcaaagatatacacatgacattcattatagcattgattgtaaaaagccaaacagagcaaaaactgagaaggaatcatttgtgctgggtagtctccttttacctttccagatccattctaagtgtctgctgactccatcatgtgggcacctggccctctggtatcaggtggacattagaagaaggtagatgagagaagctgggtatttaaccttcattccaccctgctcctctttgcaggtgctggtcttgattgtggctgtttctccctgatatgatcacagttttactacaatggccatctctttctcacaaccacagatcttgccaggccctggtaactatactcttttctcctcccctttcaggttttctatttccttatttactgtgctaggcacttcacaagcatgcactctttcattcctcaccattgtcctgcgacatatacattatctccgtttgacagatgagtgaactgaggctcaaggggctgaagccttttgcctatataggtctttctggaaggctttggtctttccactgtgtgctctgacacggtgcaatagtgaactacttatttcacgggggatctcctgggccagaggacatcaaaatgtaacatttggtagtggaggttgtagtatgtttcatcgcagcctcatgctctggatcaaccgcagaatgttgcatctggcctactacggtcactgtgaagcgacctggacaaactgtgtgtggcttttctaggagcaatcacctacttgagtcttttctgggaaaactattgtttcctagtacctgcttattcaactctctttagtttaccttttgagtgtgatttctctcctatcagaactcaaatgaagagtagagggtgaattagagggggtaagattggaagcagaaagacagctgggtgggcccttatgggagtcctgtgtgacatgagggagaaactaggaatgcattctagttatatttaagacaatagattgtgtaatacataaagtcaatctctttttcaggaactttcaatgaattgtaaactcagcgttgcttaggacactggggtcagggaaggagggtcaaaaagaaaagatgtgttgtcctgatcatagaagactattacggggacataacttgccccaaacttgccccatctcttgccccagaattatttgttaattctctgcatgcttctagagctcatagaggcagtggagaaagcttctagagctcgtagaggcagtggagaaaacatgcaggttctggtagccagctccctgagttagcatcctggttccttattatttagctcagtgatgttagcaagacttaatctccctgtgcctcagtgttctcatctttgtagtggggatacgactagtacctttcagtttagcagttctgaggagtaaatgaattgctacacataagggttttagaactattctggcacatattaaagacaaaacaaatatgggcaatcattattatctactcatccatggtcattacaaacaggatggacacagagtctagatgcaaggacaaaaatgagaaaatgaggaaggtggtaactcattctgcttctttgcctctgcatgtggtttggaacctacaaccatgtacaaagagaacatgtggaagtcattatccagacagtctcatttccttttttgatacagttaccagactgacggattgggaacagctttggaagcagagagccttggttttaaaaaggcatctgagaggattgtcccttgggtcagttcaaatctctccctctcgggaagtttccagagcacctgcagtagggttattctctacctacattacacacaagataccttgagaacttatcctcttcagcagggaagtcaatttgtcctttagcagggtcatttatatctgtgcatgatgtacccctaaactatgaactgctggagatcattgtctactgatatgtaatgagcagtcagtgcagtgcaggggttaacacaagcagcctaagctttaaagtcaaaccaccatgacttcaaatgcttgttctgtcactcatcagggtatgctcttgaacaagttacctagtctcacagttttaattccttcatctgtgaactcgagctagtaatgcctttgttactatgaaagctcactaattgaccacttactttgttacaagtgaggtctcacatcactccatgagagaggtagattcattattaccattttacaaagatggataaattaaggcacagaaaagtgtatagcaaagctcacccaagtttacacagtaagtggtgcagtcagaatctggccccaggcagctggagcatcaagcttgtatttctaaccattgcactacacagcttcacagataggctgtgcctagtttatgacagatgcttagtgaatttgctccttgaacaaaggcttactaagttcttaggacatgcctggtactagatgctggacacagagcagtgatgatccattgaaggtctatgatctcatagaccttaccttacagtggctaagatagacaataatcaaataagaaacaaaataaagaactatagattgtaattagtacactgaagaaaataaacagcgaggaaatagacaagatttggatagtagagaagacttagtgcaatatcttggagtgagtagggactcatctttattgattttaaatattcatggaaaagagtaatttttggcaaccgtaaagagctaggtagatttaccacttgtaaactaaccccttccaaagaatgctgatcagtacactgctgtaagtttggagacagtgcttattctggtcaggccctgaaacatctttaaaaattatatctggtttaataccatacagaaatgatgagattcgatttttgagagatgcaaatattcaaatcagacagagtagaaatgatagagaaacattcactttcttttgcaaaatattatggaaatcttttattttaaaggtacacaaacataggattttatattgaaaagccccactatttctaaactacaccttctattttgcttcttcatatttcaatggttagctaagaatacacagactatccttactagccaagtctcctttttggagcctcaacattggttccaaggtaggtaaaatgttccaagtgctttcaacaaatgatttctcatccacacaccaaataattgatgaagaaagaaaaaccacaatatttggtgtcatacaacaataatcataaacatgtagcatgcataccagcaactttccgttttctattcctttaacttggccccaggtccacaggctctgaattcctgggaaaggatgttatcttaataacaatggcctcagaaatttgacaccagctagtatcttatgcagaagtcaaatgctaacttcaaaaaatgttagtgagttttgttgagttctaggtatgcaccactatgaatgaatttgtattttattagcagataaactctttgcatatttttaacatgctagaatttgttccagaattgagtatttgaagtgatgcagaatacagaatactgaaagagaattataaaaggcttggctatggaacaaagcaaatggagtgagaaaagaactcaggaagaattaggaggcctatttgtcagagctggttctgtcactgactagttgtgtcattttggacagtcctttacacattccagtcttcttacatactctaggattcaacttttctcttcgcaaaatgaagacatagaacaacataaaaggttgcatccttgttccatagtaaaaacctaactgttgacttttgtgttatggctttgtttttttgtcagttaaaactttattttttttttgagtttttatgattatattttaaaaaaaattttaatcatatacaaagattgtaaaaatagtacaaaggactctcgaataatagagattcaccaatggttatgttatctttgaatcatttgggagtaagctggagaaatcacgcttttttatcctaatagtttcagtatatttcctcaggacaagaaaattcatatatacaaccacagtatgcttatcaaaattatttgcactattattgtcatcaaattctatccttgtattctataagcctaatgaataacagctttatagttttttcctaatgtaataattttttaaaacaagatagttataagcatgaatttatattcttttatattttttatgtagttacctttattgatgatatatatctcttcatagggatttatgttactatataatgtaattttggcctgaaaaactccctttagtgctttctgtacagcagatctgttagaaatagattttctgtttttgtgaacttgaaaatttcttaatttattttttacatttattttttaattgacaaataaaaattatatatattcatgttatataacaattattttaaattcctatagctttattggtagagtttctggctatcacatcttataaaagaagggtacctagacatagaattgttaattgacaagaatttggcttccattgttcctaataacaagtcaactcttaatcttattgaaggtcccttgatacttttccttctgctgtcctcaagatcttatctttgtctttgatttttgttgatgtgactattttttttaggtgtggttatctatgaatttaatctacttgaagtttgttgaaattcttagatgaagcctcagatttggaaagtatttggtcattatctcttcaaatatttttctctcttttctttttctcttctccttatataattcccattatgtgtatgttagcacactttttggggggctgggggtgggtgtcactctatcacctaagcttgagtgcagtgaggtaattatagctcactgcaacatagaacttctgggttcaagtaaccctcccatgtcatctttctgagtagctaaggtaaaaggcacataccactaagccaaacaatttttttttaatctgtagagatgaggtcttgctatattgcccaggctggtctcaaaatcctgggctcaagtgatcctcctgccttggcttcccaaagtacaggtattaccagcatgagccaccatatccagctcacttgatggtgccccatacatccctgatgctctattcattttaattcattctcatttctgcacctcaaactagataatttctattgatttatcttcaagtttgttgatcctttcttctatttgctctgacatgttgttgaattactttgaagttccatagtttcttctacatagatactagtttttatctgtaactttcacttcagaattttgaaagagtggattttagttattttgcctgtatttttcttgtcatagtatgaaagcaatttcatcaggtatattagtccattttcacactgctataaagacatgcctgagactgggtaatttataaagaaaagaggtttaattgactcacagttccgcatggctggggaggcctcaggaaacttacaatcacggcagaaagcgaaggggaagcaaggcatgtgttacatggtggcaggagggtggagggaaatgtcaaatactttaaaaccatcagttctcaaaagaactcactcactatcacgagaacagtatgggggaaacttccccaattatccaatcacctcctaccagtccctccctcaacatgtggggattacaacttgagatgagatttgggtggggacacagagccaaaccatatcactctgccctttcccctcccaaatcccatgctcttcttatatttcaagaccaatcctgctttcctaatagtcccccagagtttaattcattccaccattaactcgaaagtacaagttcaaagtttcatctgagataaggcaagtctcttctgcctatgagcctgtaaaatcaaaaacaagttagttctttccaagatacaatgaaggtgtaggcattgggtaaatgttcccattccaaatgggagaaattggctaaaacaaagggaccataggccccatgcaagtctgaagcccaacagggcagtcattaaatcttaaagccccaacataatcttctttgactccatgtctcacatccagggtatgctgatgaaagagctggtttcccaaggccttgggtagctctgcccctgtggctccgtggggtacaccccctgtggatgctttcttgggctggcattgagtacctgtggctttttcaggtgcatggtgcaaaatgtaagtggatctactattctgttctctaggggagagtggcgctcttctcacagtgatgctaggcagtgccccagtggggactttgtgtgggggctccaacctcacatatccactctgaatggccctagtagaggttctccatgagggctctgatccttcagcagatttctacctagacatccagacatttccatacatcctctgaaatctaggcagaggctcccaaagctcaactcttgtcttttgcacacccacaggcccagcaccacatggaagccactgatgcttgggagttgcagtctttgaagccacagctcaagctgcaccttggctcattttagccacagctggagctggagtggcttggatgcagggcaccaagtcctgaggctgcacataggagtgggatgctgggactagcccacgaaaccatttttgcctcctaggcctccaggcctgtgataggaggggctgccatgaagatctctgtcatgccctggagaaatattttttcattttcttggctatgaacatctggactccttcttactcaaatttctgcagcaggcttgaatttctacccagaaaatgggtttttcttttctactgcatggtcagtctgcaaattttacaaacttttatgaactgcttcccttttaaatataagttccaatttcaaatcatcttttttgtgaacacatacaactgtactctttcagaaaaagccaagtcaccccttgatactttgttgcttagaaatttctttggccagataccctaaattatctctctcaagttcaaatttccacagatctctagaacagggtaaaatgctgccagtctctttgctaaagcatagcaagagtcacctgtactctagttcccaacaagttcctcatctctatctgagaccatctcagcctggactttattgcccatatcactatcagcattttggtcaaagacatccaacaagtctctaggaaattccaaagtttcccacatcttcatgtcttcttctgagccctccaaactgttctaacctgtgcctgttacccagttctaaagtgcttccacattttcaggttatcttgaaagtagtgccctgctcccagtaccaatttcctgtattagtcaattttcacgctgctataaagacatacctgaaactgggtaatttataaaagaaagagttttaactgactcaatgttccacatggctgagaggactcaggaaacttacaataatggcagaaagcaaaagggaagcaagtcatcctacatggcaacaggagagagagagcaggggaactgccaaacaattttaaaccctcagatcttgtgagaacttcctcactaacatgagaacagcatgggagaaaccaccctcataatacaatcacctcccaccaggatcctccctcaacacatggggattacaattcgagatgagatttgggtggggatacaagccaaaccatatggccagagttcacacttttcttttctggatgttgatctttatatgtttcttcttgagaaagatttgatagtttgtgtctttctaggaatttgtttattttatttaagttgtcaaatttatggacataaagttgatgtagcattttctttccatgcttttaatatttgtatgctctacagagatgcctgctttttcattttgatatttgtaatttgtgtcttatctctttttcttttttcttgatcattctggctacagttttagccaaagaatgacctattggtcttattttttttcggtattatccttttttgtttccatttttattacttctcttaaaaattgttcttgtatttctgcttccttttgttttaatttgttcttgctaggtccttaagatggaaacttagattactgttctttgacttttattattttccaatatcgtgctatatattccctccaagtaagtcagtattgttttctaatttcagatattgttttcctaattctagaattttgatttattcatttttatattgtttatctttctcaggggagattcccattctttccaattatcatgaacatgtttcctttctgtcctcaagtataattataacagctactctgaaatatctgtcagctaattataacatctgggtcattttattttggcctttatagttatatagttttagttatatagttaactttcttatgatttgtcatatacagatgacaaataaggttatataaaaaggttttacattatacatcatcagggaaatgcaaattaaaactacaatgagataccactatacaattattagactggctgaaatccagaatactaacaacatcaaattctccaaaaatacatggcaacaagagtgctcgttcattgctcgtgggaaggcaaaatgttccaggcactttgaaggacagtttggtggtttcttaaaagattaaacacactcttcctgtactatactacactatactatgctatgctataccattactagcaataatgttccttggtatttatgcaaaggtgttgaaaacctattcccatacaaaaacttgcacatggatgtttatagaggctttaatcataataaccaaaacttgaaagcaatcaaaatgtcctttaataagtgaattgataaactgtagtatatccattcagtgggatgttatttagtgattaaaagaagtaagctattaagccataaatagacatggtagaaacttagatgcataatactagatgaaaaaaagccagtctgaaaatgataatatgctatatgattccaattacagtcatacactgcataatgacatttcagtcaagcaactgggcgcatatattcctgctgttgtgtataccataaggttataataaactgaaaaatttgtatcacttagtgacattgtagctgtcttaacattgtagtgcagtttattattttgtatagatttagtgtagcctaagtgtacagtgtttataaagtctacagtagtgtatagcaatgtcctaggcttttcacattcactcaccactcacagactgactcactcagaacaactttcagtcctacaagcttcattcatgatatgtatcctatacagatgtaccattttttatcttctatactataattttactgtttagatatgtttagatacacaaatatttaccattgtcttataatagtctaaataattcagtacatactattgcatactacacaggtttgtagcctaggaacaataggctatatcataagcctgggtgtgtggtagggtataacattcaggtttgtgtaactatatgctatgatgtttgcacatgaaagtcacctaacaatgcatttcttaaaacctgtctctgttgttaagcagcaaatggctgcatatttaattctggaaaactcaaagctatagaggcaataaaaaggttagtggtgtgcaggagttaggggatacagagacgaataggtggagcacaggatatttttaggtcaatgaaaatactctgctttacagtatattggcaaatacatgtcatgatacttttctctaacccacagaatatgcaacaccaagagtaaactccaatgtaaactatagagtctgggtgacaatgatgtgtcaatgtagtttcatcaattgtaacaaatgtaccactagatgggggatgttgataattgaggaggttatgaatgtgtgggggcaggaggagatctttgaacctttctttaaatttttttgtgaacctaaaagttccttaaaagatgaaatctttaaaaaatatcaggaatggtcatattggttaaaaagcagagcacaagcatgtgttgcttataagaaaaccatgttaaatataaacagaaacataggttaatgttcaagtgattaaaaattacataccttgctaacggtaataggaagaaattttgagtggctacaattaatgtaatctaaatatatttcaaagcaaagaatattgctagtgattaagaaacatttcataatgacaaaagtgtcaatttattaaaaagtcacaaaaattctaaagaaaagcccaaaataaaatacatgatgcaaaattaatagatatatacagggatacataaataaatacaaaataatagttagagattttaccactccttcctcaataattaataaaattagtagatacaaaacattaagaatatataaattagaataaataaacaaataagaatagataaaacttgagcaattttctcaaccaacttaaccaaattgatacttataaaacattccactaagcaccagcaaagaacaatttttttcaagtgcccatacaacttttacctaggtagaccatataatgaaagataagttcaataaatttaaatatatttaagtaatacaaggtatgttttctgatgacaactgaatgattttaggtgtcaatagcaggaagatattcagaaaattataaaacattaggaaataacattttttgtttgtttgtttctgagacggagtctcgctctgttgcccaggctgcagtgcagtggcacaatctcgtctcactgcaacctctgcctcctgggttcaagtgattctcctgcctcagcctcccgagtagttgggactacagctgcatgccaccacggatggctaattttttcgtatttttagtagagacggggtttcaccgtgttagtcaggatggtctcgatttcatgacctcctgatccgctcacctcggcctcccaaattgctgggattacaggcgtgagccaccgcacccggcccaaaataacactcttataaataacaaataggtttgaaaagaacccaaaaggttagaaagtattctgaaattagtagaaacacaacatatcaaaatttattgaatatagccaaagcagtacttaagaaaaatcttataacaaacatctttattagtaattgatgaagatgtcaatcaatcacctctgattacaactcaagaaagtaggaaaaaatcaaattaaacacaaagtaagcagaagaaagaaaataacaaatatcttagagaaacataataaaatagaagatagaaaatcgatgaaaccaaaaactgcttctttgagaagagcaatacaatttacaaacttcttataattacaaggaaaagtaaaaacatattaacagtaccagaaaagagagatgtgacctctttaacagattttacaaatattaaaatgttaataagaaaaattatgaacaattgcatgcaaataaattcaacaacttggaatttcttgcaagacagaaaatatcaaacttattcaacaggaaataaattaactgaataaaactatatctattaaagtaattgaataaactgttaaaaacgtttccacataataaaatttaggtctagatagcgttaattggggaaatcataccaaacatttaaggtagaattaacaacatcttccagaaaactggagaagggagcatactttccaactcattctatgaggccagtattagacagataatcagacagtgatattacaagaaagagaaactacagaataatatctctgataaaatagatgcaaaattgttaatacaattttagaaaataaagtgcacttatatgaaataataaatcatgatcaattgggatttataccaggaattcaagaatggttctccattaaaaaaatcaatgtaagtcatcatattactaaatttaaaaagaaaaacacaattatgtcaatagatggagaacaaacatttgacagaatccaaagtttattctcataaaaatctcttggcacactaaaaatagaagagaactatcttaatctgagaaaggacaattaccaaaatctacagttaatatcacacttaattacaaaagactgaatgcttttgtctcaaggttaggaataagggaaactgctctcagcccttcttttcaacattttcaacattcatttctacttactggtgatggttgtaaccagtcagataaggaacaaaaacaaataaaagtaatcagattaaaaaggaagaactaaaattttctttaatcttaagcaacatagtcatctttataaataatcaaatggaatctacaaaaatctattataaataataatcgaatatagcagcatgcaagatacaaaaataatgcacaaaaatcatatgtatttctataaattagcagcaaacactcaaaaattgaaattaaaactaacatttatatagtataaaaatagacattcttagggacaaatctaacaaaagatgtacaagacaaggtacaatgaaaactacaaaacatcgttgagagattaaaaagacctaaatacatgtagatagattgcatatttatggatcaaatgataactgtgggtgaatatttcaatactttctaaactgatctatagattcaatgcaattctaatcaaaattcaagcatgtcagttcaagataggaattgataagctaattctaaaattcatatggaaattcaaaggacctaaaatagccaaaacaactttggaaaagaagaatgtatttgatggatttatactatctgacttcatgatgtattattaagctaaattagtgaagatgatatgatattgccatcaaggtagacaattaggttaatgggacagaacagagttcaaaaattgacccacccaatgtggataatagattttcaacaaagttacaaaagcaatctaatggaggaaaaattttcttcaacaaaaatactggaaatattagatatgtgtatgcaggagaataaactttgatccatattttacgccatatatgaaaattcagtcaaaatataggataaacataaatgtaacacctaaaagtataaactttccagtagagaacataaaaaaagtatttgtggtcttgagttacgcaaaaatttctttgatgcaacataatgaaagaaaagaaacaataaattggatttcaccaatattaaaaaggtccaccctttgaaagatgttgtgaagagaataaacagacaagacacagactgacataattgtaaattacatatataataatggacttttttccatactgtagaacaatctttcaaaattcaaatgtaagggaagaaactgcctgatttaaaaaggacagtagttttgaataacgttttattaaagaagttttataatcggtaaataagaacatgaaaagatgctcaacattattagtccttaaatacacagaaacatggataaatctcaaaataattatgctgagttaagtaagcaaggcaaaaatcaacatacactatgattcaatttctataaatctctggacaacacaaactaatatatagtgacagaaaacagattagtagcatgagggctggggataagagaggcacaggcaggaggcatggattacaataagactttaagaaacttttggggatgttataaatatctatcttgattgtggtcataatttcataattgtatacatatgtcaaaacttataaaatattacattttaaatatatgcagcaattatatctcaataaaattgttaaaatatatcaatatatttaactaaatacaaacatcaataaataaatatgatagatgtccaagactccaaaatataaataacaaaacacatttgagagaaattaacttgaatctaaataaagtggaaaggtatactaggttcataaattggaagacttaatagtgttcagatgtgaatttctcccttaggtaatctatagattcaatacgaaccataaaatgtctgtgtgtgtgtgtgtgtgtgtgtgtgtgtgtatacacacacacatagatatatatggggggtataaattgacaagctatttttaaaatgtctgtgataatgttaagatgtagaacaaccacaaacagtttgaatatgaaagttgccgtacctgatttcataatttactggaaagctgcagtaattatgacaatgtggtagtgacacaaagggagataatggacactttgaatagaaaagtctagaaacagactttcttatagggtcactggaataatgagaaaagtgtcactgtagttcaatgaggagataatttttgtctagttaacaaaatcagtcagaaataagcattttcacctctgcttcaagattcaatgatcacagacttaaatgtgaaacgcaaatcagtaagagttttagagtaaaatgtaggggaacactgataatctttgagcaggctataatttcttaagcagaacataacaataaacattaaaaaacattgatcaattggacaataatttgggtcaataacattaatgattaaaattaataatactgtttattaaaagacagcattagaagagtgataaggtcaactacatactagaaaaatatctgcaaatattcaaccttagacttatgaaaagactttatcagggaatttctacacatcagtgagaaagtagaagagcaatgggaagaaaactgaaaagatacttcacaaaaaaacaaaatatacatataaaagaatggctgttattaagtcaaaaaaaacaatagatcttggaatagatgtggtgtgtattacttcattttcaaactgctgataaaaacataccccagactggataatttacaaagaaaaagaggtttaatggactcataattacatatggctggggaggcctcacaatcatggcagaaggtgataatgaaaggggtttccctttacaaaagcaacagatctcatgagacctaacactaccatgggaagagtatggtgaaaaccagtcccatgattcaattatctcccacagggtccttcccatgacatgtggaaattatgggattcaagatgagatttgggtggagacacagccaaaccatatcattctgtctctggcccttcccaaatctcatatcctcacatttcaaaatgaattatgccttcccaacagtcccccaaagtcttaactcatttcagcattaactcaaaagtccacagttcaaagtctcatttgagacaaagcaaatgtactttccagcctctgcatattacccagttccaaagtggcttccacattttcaggtatcaataaagcagttccccactctaccagtagcaatttactgtattagtctgttctcatgctgctaataaagacatacctgagactgggtaatttacaaagcaaaagaggtttattggacttggagttccatgtggcttcagaagcctcacagtcatggtggaaggtaaaaggcatgtcttacatggcagtagaaaagacagaatgagagccacgcaaaagtgaaaaccccttataaaaatatcaaatctcatgagacttattcactaccatgggaacagtataggggataccacccccatgattaaattatcttccaccaagtccctcccacaacatgtgggaattatgggagctacaattcaagacaagatttgggtggggacacatccaagccatatcatggagaaaggtgaatacttatacactcttgttaggaatgtaaattagtcgaacttttatggaaaatagtatggagattccttaaagaactaaaagtagatctaccatttaatccagcaatctcactactgagtatctacctgatatggtttggctctgtgtccccacccaaatctcatcttgtggctcccataattcccacgtgttgtggacgggacctggtgggagataactgaatcatgggggcaggtcttttctgtgctgttctcatgatagtgaataagtctcatgagacctgatggttttaaaaatgatagtttctccacacaagttctctctttgcctgctgccattcacataagatgtgacttgctcctctttgccttccaccatgattgtgaggcctccccagccatgtcgaactgtaagtccaataaacctctttcttttgtaaattgcctagtctcaaggatgtctttattatcagcatgaaaacaggttaaaatagtacattggtactgagagtgggtgctgctgaaaagataactgaaaatgtggaagcgactttggaactgggtaacaggcagaggttggaaaagtttagagggctcagaagaagacaggaaaatgtgggaaagtgtggaactccctagatacttgttgaatggttttaaccaaaatgctgataatgatacaggcaatgaaatccaggctgaggtggtctcagatggagataagggacttgttgggaactgcagtaaagatgactcttgttatgttttatcaaaaagattggcagcggtgactcttgttatgttttagcaaaaagactggcagcattttgcccctgccctagagatctgcagaactttgaacttgagaaagatgatttagggtatctggtggaataagtttcttccttccttccttcctttcttccttccttcattcattcattccttccttcctctctctctttttccttccttccttcctttctctctctctctctttctttctttctttctttttttcttcttttttggagtctcactctgtcatccaggctggagtgtagtggtgtgatctcggctcactgaaacctccacctcctgggttcaagcaattctcctgcctcaacctcctgagtagctgggattacaggtgcctgctactatgcctggctaatttttttttttttttgtatttttagtaaagacaaggtttcaccatgttggccaggctggtttcaaactcctgacctcaagtgatctgcctgcctcagtctcccaaagtgctgggattacaggcatgggtggaaaaagtttctaagcagcaaagcattcaagatgtgacttgcgtgctgttaaaggcattcagttttataagagaagcaaactataaaaactcagaaaatttgcagcctgacaatgcaaaagaaaacttccttttctgaggagaaattcaagccagctgcagaaatttgcataagtaaaaagaagttgaatgttaatccccaagacaatggggaaaatatctccagagcctgaaaaaggtcttcatggcagcatctctcatcacagacccagaggcctaggaggaaaaagtggtttcatgggccaggcccagagtccccatgctgtgtgcagcctagggacttggtgccctgcgtcccaacttctccagccatgtctgaaaggggccaatgtagagctcaagctgtggcttcaagggtgcaagccccaagccctgccagcttccatgtggtgttgagcctgccagtgcacagaagtcaataattggagtttgggaacctccacctagatatcagaagatgtatggaaatgcctggaggtctaggcagaagtttgctgcaggggtggggccctcatggagaacctctgctaaggcagtgtggaagggaaatgtggggttgaagccaccacccagagactctactggagcaccattgagtggaattgtgagaagagggccaccgtcctccagaccccagaatggtagatccatcaactgcttgcactgtgtgcctggaaaagctgcagacactcaatgttagcccatgaaagcagccaggagggggactataccctacaaagccacagggacagagctgcccaaggctgtgggatcctacctgttgcatcaatgtgacctgggtgtgagacctggagtaagaggagattattttggagctttaagattttactgccctgctggatttcaggcttgcatgggatctgtagcccctttgttttggtcaatttatcccatttggaatgagtgtatttacccaatgcctgtgcctccattgtatctaggaagtaactaacttgcttttgattttacaggctcataggcagaagggacttgccttatctccgatgagactttggactgtagatgtttgagttaatgctgaaatgagataagactttgggggactgtggggaaggcaagattggttttgaaatgtgaagatatgagatttaagggtgtcatgggcgaaattatatgatttgactctgtgtccccacccaaatctcatcttgtagctcccataattctcacgtgttgtgggagagacccagtgggagataactgaatcataggtgcaggtctttccagtgctattcttatgataatgaatgggtctcatgatatctgatggttttaaaaacgggagtttctctgcacaagctctctctttgcctgcttccatctatgtaagatgtgacttgaacctccttgccttctaccctgattgtgaggtctctccagcaatgtggatctgtaactccaataaacctcttttgtttttttaaattgcccagtcttgggtgtgtctttataagcagcatgaaaacagactaataaactacccaagggaaaagaagtaattatatgaaaaagacacacgcacacatgtttattgcagaacaatctgcaattgcaaagatatagaaccaacctaagagcccattgaccaatgagtagctaaagaacctgtgctatataaataggaagatacatatttcatccctttttatggctgagtaaaatatatacatatatatatatcttcctatttatggctgaatactactcaccataaaactgaatgaaataacgtcttttgcagtgatttgggtggagatggaggccactattctaagtgaagtaactcatgaatggaaaaccaaataccatatgttttcacttataattgggagctaagctatgtgtacacaaaagcatacagagtgatataaaggactttggatacgcagaagagggaggttgggagggggttgtgagataaaagctgcatattggatacaatgtacactactcaggtgacgggtggactaaaatctcaaaattcaccactatataattcatccatgtaaccaaaaaccactggtacaccaaaacctattggaatatctatctatgtatctatgtatctatgcatctatctatgtatctatctatctatctatctatctatctatctatctatctatgtatctatctatctatgtatctatctatctattttctgtatctatctattttctgtatctatctatctatctatctatctatctatctatctatctatctggaaaggtgaaaagtgagacagagcttaagtcatcagacaaataagaagaggaataattttagacaaagaggatattatgaagatatattttggaagtagaattgagtatgcacagaaagaacagaggtagagaaatcactaaaaatgtttaacagcatacttgagcaagaagaaggtttaaccagtgaacttgaagtcaggtcatgcacaactttccagagaaacagaagataaaaaaaagaacgaaacataataaagaaagcttatgggacttaaggggcactaccaaccttatcaataaatgcatgatcagagacacagaaagagaagagaaagaaagaggaacaaacagttataagaaatcatggctgaaaattcaaatatgaaggaaactgacatccaaattctgaaagccaaagcttcccaaataagataaatctaaagatgacaaaaccaagatgcattataattaaattatcaaaagtcaaaaaaaaaactttattccttttttttttggagacagagtcttactctgtcacccaggctggaatgtagtggggtgatctcagatcactgcaacctctgcctcctgagctcaagcgattctcctgcctcagactcctgagtagctaggactacaggtgcacaccaccatgcctggctaatttttgtatttttggtagagacaggagtctcaccatatttcccagactggtcttgaactcctgagcctaggtaatccgtccgccttggcctccaaaagtgctgggattataggcatgaaccactgaacccagatgaaaaataattttaaaagcagtaagtagaaagtgagttgtcacatggagagaaattccatcagaatattactgtatttctcagcagaaaccttgcagaccagtaggtagttggatgatatactgacagtgttgacagaaaaacaaatacaagaaatgctaaataaagtactttaacctgaaatgaaagcacactaaacatatgaaagcccatgaaagcataaactttgctactgaagcttaatatataagtgaatacagaatattctaatactataatggtggggtataaatcacttttaattctgatgaatttaaaagactaaagtataagtataaccgtctaaaatatgttaatggatatccagtataaaaacataattttttacgggtgtggtggctcatttctggaatcccagcacttttgtaggccaaggcaggaagattgcttgagcccaggagtttgagaccaaactgggaaacatagtgaaaccttgtctgtacaaataaaaaaaattagcagggcatagtggtgaacacttgtggtcccggctactctggaagctgagatgggaggactacttgaacctgggagatagaggctgcagtgaggcgtgattgcactattgcactcagcctggggaacagagtgagatactgtctcaacataaataaaataaaatacaaaacatataatttgtgacattaataatataaagtgtgtgtagagaaggaaaagtgtagaatgtttgtatgtgattgaagttatcatcttaaaatagattgttttaagtataacatgttttatactcagcagtaatcataaagaaaacgcttatagaagattcataaaagaaaatgagaaagaattcgaaaggtatcactttaaaaaatgaaccagaagagaagacatcaagagaggaaaagagagacaagagagctacaaacagaaataaaacaagtaacacaataacaaatatccttccctatcaataattagaaagaatcagatctgagtaatattaagtgccctttgcaatgcctgccacagaattcagtaaacagcagttttccacgcttccatgcctaatttttcccactttacatgtgctaaggaaagggaatgaatctcactcattttttatttgcaagactggaaaaatgtctaatctcaaaaaaatatttcttggatgaataaaagagaagctccaatttattaaaatcactgctcttagataagaactaattttggccataattgtggaaggaaagggaattaatttagcagattcattttctgtgttaaatcagctgctgaacactttaccaatgttttgtcattgaagtcttacaacaaatatatgagataaacattaaaacatttttcttaagagcactcagaaaatttataattgctcattttcacctaaaatttgttttttatactacctgtgttaatctcatattagaatgtttgatggatatactaccagaactctagttccattttggaaaaattatttgaaataaatgccttattcacacaaaaaaatcattaatcaattggacttaaatttggattaataattttaatgttattaaaattaagcattttgtttgttaaaagacagtattaaatgagtgataagatcaactacatgctagtataatatatttacaaacatccaaccatagacttatgaacagactttataagagacttctacgaatcaatacaaaggtaatacaacaacggaaaaaaaaatacttcatgaaagaacaaaatatacatatgaaaagtacacaaattcactatcagagaaatgcaaataaaaccacaataagatacctctacacaaccaagacgttggcaaaaagaaaagatcagaacttaccaaagttggtgtgggacagggtttcttaactttagtactcttgaaatttttggttacataattattgtgcggagctgtcctgtgcattataggatgtttagtagcatctttgacctctactcactagatgcaacagcagcccctgccccctccccctgcccaagtaatgacaacaaaaaatgcttccagatattgccaaattcccctggaagcagcaagattttcctcacttcctctgactgagaaccatatgcactggtagtggaagtgtaaattggcatctacttcaatattatctaacaaacctcaatatgtgcataacctgtgatccaaaacctgggtaggtattttagcccaaagattagtacaacaagattcacagaagcactacttctaatagcaacatactggaaacaatctataagttcatgagtagaggaatgaatgaatccatatgcatataatgagtatatacagtaatgacatacacagatctcacaaacatggtgtttagcaaaagaggccaggcttataaagaatataacatttcaaaaatggtcaaaactaatgtatggtattaaaagtgaggatagtggttattcttggagggaggaaggtaatgactaggggggatgacagggagggtgcttggtttttcatctggtttaacattacaagtatttgttcacttagtaaaaattaattgagccttgcgctatgttttatgtaattgtttgcattttggttataattaaaattagtaccaaagggggaaaaatattcaagaactagaactccaggcagccctggcttgtctacttctcttttctttccaagtctaggtttaagcaggcttttttttttcttttttttacagctctattgagatataatggatataaaaatctacatatttagtctacattttgatgagtttggaaacatctctacaccatgataccatcaccacaataaagctactaaccctgtccatcacctctggaaatgtccttgtgtcctttgtgtgtatgtatgtatgtgtgtgtgtgtgtttgtatgtttgcgataagaacactcaacatcggatttatcctctccacctaaagtgcacaataccttactgctaactctaggttctatgatatatagcaggtctctagaaattatttatcttgcgtaattgaaaatttatacccgttaagttacaattccccatttcttcctctctccacccactggcaacaaccattctattccctacttctatgaatttaaccatcttaggtatttcacataagtataatcatgcagtatttttcctttgatgactgtcctatttcacttagcataatgtcctctagattcatccatattgttgcaaatggtaagatttccttcttttattgagactaataatactgcatgaatgtaaatgccacattttcttcatcaagcagagttttattgttctgtcccgcaatcacaaaaatgtttttcccaaggactataattgcatctgcatttagataccactgttctattacttgaaagtttctgtctacctgaatatttaagggcatgagccttgacacctgtcagctggtagaaagaggaagttgcagttgcatatattatctaaatgtcattcatatctgtatgtctcctactttttattgattggaatcaattgagggccaggcatggtggctcacacctgtaatcccagcactttgggaggccgaggcaggctgatcatgaggtcaggagatcaagagcatcctggccaacatggtgaaaccccatctctactaaaaatacaaaaattagccaggtgtggtggcatgcacctgtagtcccagctacttgggaggttgaggcaggagaatcgcttgaacccgggaggcagaggttgcaggttgcagggagtcaggattgtgccactgcactccagcctgggcaacagaacgaggctccatctcaaaaaaaaaaaaaatcaatcaattagaaaaaagtatttttgagaataccatacatcctgcagctggactctgggtatgtggaaagttacaggtcatatcaggccagggaatctttctttccatcattcatttcctcttcttctgggacagtactccaaaagtactttgagaagtcaacctcccttttctttctgtccatgtgatacacagctggggtatcactatgtgtgatagtctcatggccagggctagccataaaagcttgcaaataagataatttggtgggcattttgctgcttggaactagattgtgattttgttagttaagagacagtgggaataaatttggggatggaaactaatgatgtctctgaggaagtgtcttccatgtgaacaaaagaatgcttgctttaaaagacatacgtataagccagaaaataagatattggaactatacagaaaaatactgagtggctatatttgaatgaaaatataaagatgattttcctctttcctttgtatgtacattatttgaaataaatacactttctctatatatgtgtgtttgtgcatttgtgtatgtatttttccactatttggataaaaagaacattttaagaaaataagtaaaagcaaaatacaactatctattatgttgtaacttatttattcttatttatccttattcttttctgtccagcaaagataatcgccatctatcccatgcttaaaaattttgttgaactgtacaaaaaaatatcaaccagtgcacactggcaagatcataacagaaaaagagcccatttgtaaaaatgacattgacattcaaggttaggtcacagatgaatgattattttatcatttttgattagttcttttattaggaaccaaatgctgaagattaagaaaaatctcagagtaatgattacatgtaataacataagccgaaaacaatattattatttgcttgatcttatcaaaactaatctctttacagccttgtttggtgagatgggttgttcacatatgactcttcccacttgaaaatggcatagagggctgaatggctaatacaaaatcaccccagcagattcatgatgtggtcaagactcatggattctcagcctacagatgggctggaagcagagtttttattagcatgttctcttaatatatgatagtaaatcacttattgtcttctcactctattcctggtatgttctaaatgcttaaaatattggtttattaaataaccacatcgactcatggcttaaatgattatttatttatttatttatttatttatttatttatttatttatttttgagacaatgtcttgctctgttacccaggctggagtgcagtggcatgatcattgctcactgcagtcttaacctcctggacccagctaacttcaaaatttttgtagagaaggggtctccctatgtggcccaaactgattttgaactcttagactcaagatttcctcctgccttggcctcccaaagtgctgggtttacaaagtgtgagccactgtgcccagcctaaattattttatttctattttattgtgagaaagatgaagcacagagaagttgaagcattttctcaaggactcatagctgataggtggcagaattgaaatccaaacctaaacattatggctccagagccaagcctctctgaagcacacttattgacccttcagaatgatctcatcttaaactagcactccttaatatatattttgagacacaaagccaacatagtcaaaaaagtgtctcctttttgtatacacttgctcttctgacggtagaacctgacagtccttctgagcccaagtcttcgaacttaagtttaaccttgagctcagagagtcagcccaagttattcattttattggcaacttatacagttgcacaagtcatttctgcaagcagatcctcccagtaagtggataaatgtgtgctaaaatccagcttggtctccactcaccaagacaagcacttgctggatacatttctcttgagagtcatgctattttcacatggtcacaaaagctgtatgtgctgtctctatgttcttatagtcaataatcatcagcaagcaagtgcctgtgtacttctgcaagtcttcccacagtcctgaaagagctttccaaacgaggaaacaagaaacttagatactttacccaaagccacatttcaaaatgaacgagtctggatttaagtcaaaccagtgtttaaacaaacaaacaaacaacaacaacaacaacaacaacaacaaaaaactcataccaagaaaaaagaaagaaaaagcaaaagcagatatcttacttcctattgacttaagcaattctgttaaatgcagtgctatgaatctctccatcatcatccagtccacccaaaatataaacagcaacaactaatgatcctcccatgaaagcttgaaatgtactgcgggactgacaatgtggtcaataacctgtaatcttcagaaaaaataaagctaaagtcaatcccatttagtcaaactccaacctcaacagacaccttgcttccatacattagtgagttctttctctgtcgcccaggctggagtgcagtggcgcgatctcagctcactgcaagctccgcttcccgggttcatgctgcctcagcctccccagcaactgagactacaggcgcccgcgaccacgcccggctaatttttctgtatttttagtagagacggggtttcaccgtgttagccaggatggtctcaatctcctgacctcctgatccgcctgcttcggtctcccaaagtgctgggattacaggcgtgagccaccgctcccggccgcattagcgatttcttaacctgatgaccagaattgggctacaaagggtaaggggacccttttaattgaatgcaaaatatttagtttatttttaacaattatttttacattattttgagataattttagacttacagaggagtagcaaaaatagtatatatagttctcataaacccttcacccagcttccccttgtgttatcggcttacattgttatcagatatgtcacaactaagaaacttaccttggtacagtactatttactaaagtggtgtgcttactggatttcaccagcttttctactaactttctttttctgttatagattccgggatcccacattatatttagttctgtctccatagtcttttaaaatctgtgaaagtttctcagtctttgctgagtctttgcttgtccttcataatcttgatactttagaggaagattggtcaggttctttgtagaacatcccttaattaattttttcatgttttctcctgactatattggttttgtattattgaaatggaaaccacacaggtgatatgccccttttcagtatatgtgtctcacacctttaacttttctgcttatgtatttcactctttcgaatgctgttgtaaatggaatttcaaggaatatatctggccctacccaggaaagaaaggggagagaaacatttttggttttaataagtcttccaagccttgactgagatttacctctgcatgtgcgcgcaggatctgatgatattttccatcttgtaaggcttttcaggggcaactctactggtagcaggaagatgctcatggtttagatgacacatggttcttagtgcattgtatcagaggatgcaatgtaaatatatacacaatgtcaatatttataattggttatgtaattttgattatttaactaaggttgtgactgatggaattttctactacaaacttactagagtcatgtaatatatgggtagattttttaacattgtgcaaatatctcattacctttctctcacctagtttagtattctttgatggctcttgcctggagcaatttttgctgtggtgtttctaatagtgatttttttatttccctcattgtttctgcatttttaattggaactattttgtaaggaattgtgtatattttacgtctatctgaaatctgaaaaactggtcgtaatttattttctttaataaactttcgaagggaaaaaaatggccttaaaaagcttaaaaactaccatgttggcagtgagaactaatttcaaagaaaatgtctaaccttttctaggaaagagaagggacaaaaacatttttatttttaataagtctttcaagccttgagtgagatttatgtctgaccaggcaagcaaaacctaatgaaatgttccatcttgtgagagtttccttggatacctctgctgatagcagagagatacacatgggttaggcctacaagatccttataatgatctccttccttttcctaacctcctctgctgcttagaaagcaaaccttgctgagttatattaatgcatacagaatcattggcttaaattgaagacagttttaggtccccaaatcttaagagattttcttattctcccccactaccccagaattaatgacaaaagatgatgttcaagatctggtgagaacataagataaataaacaaaaattagttgtatttgtatacacagccaacaaacaatccccccaaaattataaaagcattttaatttacaaaaatgggtaaacaacttgaataggcatttctccaaagaagatgtataagtggccaacaaacatatgaaagattctcaatagtattagtaggtagagaaatgtaaatcaaaaccacaatgagagcagttgatatacattgggatgacaatgattaataataataataagcagtttcagcaagaaaatatagaatttgaaagttttttcctttgttggtgacagtgccaatatgatgcaacagctgtagaaaacgtttgggagttccgcacaaaagttaaacatataattaccatatgactaaccaattcttctagctgcatactcaaaagaactgaaaccaggtattcaaacaaaatgcttgcatagaaatgtccatagcagaactattcatgatagtcaaaagctggaaacaacccaaatgttcatcaactagtaaatggattttttaaatagggaggtatgtatataccaactgtggaatactactctgtcataaaaaggagtgagtactgatacatgcaacaatgtgggtgaacctcaagaatattatgctaagtggaataagtcaaaagtaaaaggtcacattttacattattccattgtatgaactatcaagcacaggtaaattcaaagagaaagaaaatacattggtggtttccagaggcaagacaggggggagtgggagtgactaatcaatagatacaggattttgggccaggtgtagaggctcacacctgtaatcacagcacattgggaagccaaggtgggcggatcacttgaggtcaggagttcaagaccagcctgtctaacatggtgaaaccctgcctctactaaaaatacaaaataagctgggcgtggtggtgcacacctgtaatccctgctactggggaggctgaggcaagagaattgcttgaacctgggaggcagaggttgcagcgagccgagatcgcaccattgcactccagcctgggctacaagagcaaaactctgtctcaaaaaaaataaataaataaatgtagggttttattttggggtaatcaaaatattttggaagttgatacaggagctattacacaacattgtgagtatactaaggtcacagaagtgtatacttcaaaatggttaattttatattatgcaaatttcacctcaattgtaaaacagagttggggagatgggtcaccaagtgaagttactcacttcaaggccaattaaaatgttacttttaattgatgcaaactctttaaacagaggaatgcaccagctataaatatatacctcaatgcattttcacaaactgaatacattcatgagccagcaaccaaactggaaaataaagaatacagacacatcaatcccctatgaactccattcaatcactgttctcctctctatcacctctaatgacaaagttaatgatatctctttctgaccttatagaaataaaatcatacagtacatatgctttgatgtttggcttttttaactttatgtttgagattcattctcattgttgtgtagtattccattatatgaatataccacagtgtttaatccatacaaatccatccatatggaaatgtctgtgtataaatagacattttctctcataattttatctttacaaatactcctgccatgagaatgcataaagtgttgatatttggtttgcaaatataactaggagaagagctgatggatcataaggtactcatatttagatctagtagatattgccaaattgttttttcacagttgttccagtttatattctcaccagcaatatataagaattctacttgttctacttcctccctcaaaattggtgtttccctgagggctcagctaaagtctttgttgtagtttcatccttgttcaatttctctgttagctcagtcatacttcacttctctagctcacttgaagttgttgttgctgagaatcttcccatcataaactccctgcattcaaatctttgtcacagaagagtttaccttgttctatctatttatctatctatccatccatctatctatttctattcatatacatatatatacacacatagacacacacattgtatataagagttgtgtattatgtatgtacacattatgttgtatatatttatattatatatacattatatatattatatgtgtgtgtgtgtgtgtatatatatatatatatatatatatataaaatcaagtctaacctgcctattctgtacttggctgtctgtcttttacatattactcaataaaaggaactcttatatattttttcagagttttatatctctcagtaccttttctaagagttgcatttttaaacttttactagttctcttgatgaacagaaaatttgaatataatacagtaatccacgctttgttactttataattagcacttttcatgtctttttaaagaaatgtttgcttatgtcaaggttgtaaaaatattctcctatgctttcatccgttagtttactggtttacttttcccatttagattggtaattcatctggaattgacttttgtgcacagtgcaagatcgagttcaaaattatttttctgtatggatatttaatgaatccaataccttttactgaaaatatcacatttcctcatttcactgcaataacatctttataataaatcaagtgactgtatatgtcagagggctttaatctgtcccactatctgtttctatgccaatatcagaatgtgtttattactacccctttttaataggtgttgctatctggtagtataaattctccaactaagttctgcttcttttagattactttgtttcttcttggcctttcccattttctgacacttcatgtttgtcaattttcgcagaaagagtttgttgagatttttattctgattgcattagatttgtttattattttgaaggagcattgaccatttaaaaatattgagtctccaacttatgaacaagaatctccacttctcttaataattaatgttttgttgtttttatgtggaagtcatcaacacacattttattaaatttaagtatgtggtgtttctgatgttagtgtcattaagcataatttttaaagtttaattttctatttttaaatttcagtatataggaatatgattaatttctgtaattttgtagcagctttgcaaaatcctctcattaattctaatagtttgccatttttttcttttgaattttctacatacacaatcatgtcacttacaaatgacagttttattcttttgttttcaattccattgacttcctccccagccccttccctttattttctgtctagggctgccaagaagactttgaatggaagtggtgataatggatatctttgtgtaactccaattccagtaagaaatatcttgaatatttcaccagtaatatgacaggtgctagaggtttttggtagatattatttgtcagattaatgatatttctatatcttcccacttggttaggagggtttatcatgaattagttttgtgttttgttgaattcttttcttgcattattgagatgattatacatttttctccctttgctaatgtgataagatacattaatgaactttaaatggtaaattcatttttaaattcctggaaaagccagatgtgtccgtggtgtattatgtttgtaaatatttcttgatttaatctgcaaatattttgtttaggatttctaaatctgtgaccatgagaaatgctgatttgtatgtttttttaatgtaacagaggtcaatttaactggaagtctcacattgcatagtctattctattctataatatatgcttttctagtataaaatatttaggattccatagagtaaaactgtatttttggccaatgataacacacatatactgtgggtttgcctattagttaacattttacctggcttgtaagaacctcagtgtaagagtatgagctaacacagtatttgacaaatatctaatgtgtttctgggtctcaggcaaagcaaaagtgattgcccctgacctaggccaagtcttgctggaaatcttggtatggccaattaatgaaaatagaagtcactatggtatgtgtgtggtgtctgggggtgacagtttacaggattgctaagggcttacttggaccctgatagtctctctaggcaattgggtggatacataaaaacagcactgggaattgttcctcaaacacacacacacacacacacacacacacacacacacacagagatatttaaattttattctattttattttaagttctgagatatatgtgcaggatgtgcaggacgggcaagtttgttacataggtaaaggtgtgccatagtggtttgctgcacctatcaacccatcacctaggtattaagccccacatgcattacctatttatcctgatgctctccaaccccctgcctcgtcaacaggccccagtgtgtgttgctcccctccctgtgttcacgtgttctcattgttcagctcccacttataagtgagaacatgtggtgttcttattttccatctagtctaggctaggctacgtacaaggagttataaagacatgtgaacatccacaattgatgcctttaagctataacagtatattgggaacataagatacgtgtatcaatactattgatagaataatttcttcatctggtggtatgtagagctgtatacttggaagggtttccaaattataatgagatgaaggcatgaatacattaaaatgaatattttaatgtatttatgtgcttgctaaagaaagagaaaccttcaaagacaaaaaattaaaaataaagaataaaagaacaagaaaataagagagagctgatataagattaggaagaatggaacagtatcttgtacaggacacaaaaccaggttttctctgggaatgaatgccagtagcagcattagagtctggagactaatcattggatcctctgaacagtaggagaattacacttaagactcccacattaaatcagattcctgaaagatggaaaacaaggttcaaaatttgatgtgtcctctggctcccagcagacacaaaagtaaatcttctgtggaggaaagtgtccccagtttaggtcctcagggttttcatagataattttctaccaaatatgagctcacagttccaatcactaagaaaacacacaagaacagaagctagtatcggcaaaaacaaacgaaaatgttaaatattataatgatccaatatagcatgtaaaataactctgtagaacatgtctaaaaataaagtaagaaactgggattttgaaagtaacaagctataaacaatgaccatctatctccctttccctcccccaaaaaatacagagaaaaaaaataaacaggcacattaaaaaaactaacataaaaattagaactccaagaaatgaagaacaatttcattaaaattaaaaccttggtggataaacagcagattaggcataactcaagacagagttcatctaagatagctctgatgctagaacacaacacaaagaacccaggaaatagaacatatcagaaacaggttcagggacatagaggatggaatgatacacactgttttctaactgaagaataccatggccaccaccacaatataaagagcatctttaaggcagccaataaagaaaagccctgtgtctacaaaggaagagaaaatggactaagagtagacttctcaacaataaaaatcaaaatcaacatgaacgaaatgacatgaatgaaataatttcaaggtagtgagaaaaaagccaacatgaatctagaattgtgtacccacaaattatcttttttttttttttttttttttgagacagagtctcggtctgtcacctaggctagggtgcagtggcgtgatctcagctcactgcaaccaccacctttctgggttcaagcaattctcctgcctcagtctcccaagtagctggtactacaggggtgtggcaccatgcctggctaattttttgtatttttagtagagacagagtttcaccgtgttagccaggatggtctcgatctcctgacgtcatgagccgttcaccttagccccgcaaagtgctgggattacaggtgtgagccacagtgcccggcccacaaattatcttttaagaaagagaataaaacgactagtcagataaatgcaaacaaattattaataccagcaggtgtcactagagcagtgtttaaaggattaactccaggaagaataaaaatgatttccaaaggaaggtctgaaatacaaaaagaaaacaagcattatctatgtaaaacaataattttagtaatgattaatttatgggttacaacaaagtacccaaacatacaacaataaaatcacataatccagggattgagggccaactctgtcataatttttgaatttttgaatttcaattcagaatgccagttatgatactaattgacttttgacaagtacgcatagcaaagttttaaggttaaccattcagagactggaaataaagcaactaacttccagactagagagatttaaaaaaaatgtagaataagaaaaatatcaattaatcaagataaaagaatagagaaacagacgattagaaaagcagtggaaaaagcataacataaattgacaggaatatgtgcaaatataccagaaatcacaatagatatgaataaactaaagtcaccagcttcaaggtaaatattgtcaaattggatttttttaaagctatatgttctatacaaatggcacacctaaaacataggaataaaggaatgttgaaaataaaaggattggggaaaaaagatatactagaaaaaatactaacccaaacaaactgaaagcaattttattaatatctgataaaagcaatctttttttttttttttttgaggcagagtgttgctctgtcacccaggctggagtgcagtggcacagtctctcttcactgcaacctctgcctcctgggctcaagcgattcacgtgcctcagcctcctgagtagctgggattacaagcacctgctgccacgccaggctaattttagtagagacggggtttcaccatattggccaggctggtcttaaactcctggcctcaagcaatccacccgccttggcctcccaaagtgctggcattacaggcctgagccaccatgcacagcctgataaaagcaatcttaaaataataagcacccttagagggaaaaggttattgcataatgataccttaccaggaagatattccagtgtaaacttttacacatctaacaaaatagcaccagataatatttgacagaaacacaggaaaatgtgacaaaaacaaaaattgctatcactttgaagaatttttaggtttctcactgtacatataaattaaactgacaaaagtaaacatatagaagattttatcaacaagattatgaagatttacttaatgaacatataataatggataatgtttccaaagtgccaggtactgaagtgctttgcatgtattaactaatttattcccatcgacaacagtatgggatagatcctactataatccccaatttacagatgcttaaactgaagcacagaaaatttactaatcttccaggtttcatagcttctagtgacacagctagtaggcagttgggatttgaaaacaggcattctggttctaaagtcagcactttgaactgctgtaccattttgcctgacaaccatgcatacaacaattacggcatattccctttttcaattatatgtacatcatatacatactagtttataaagcagtactcaacacattgcaaggaataggcctcgcacagcacgtgttctttgactatgatgaacaattaagttagtaataaataataaaagtttaactaaagtgtcacatgcattggggaattttaaacattcttaaattataggacaagtaaataatgaaacttcttttaaaattaaaactataatgataataaaaacactaatctatcaacatttagaatatgaggaaaactgttttcaagggttaagttagccgcctataatcatattaagaaataaaaatggctgtaaattattaatgcaagcatctaacttaactggttagaaaataacaagactaaagcaaatataattaatgagttcaaaagagtgatataaacaaaaagtaatgaaatttaaacaaaattaaaaacaaaagtcaacaaagccaagaaatggtttgttgaaaatgctaatgaaatttgtaaacctctaggaaggtttactaacatgaaaaaagagacagtaagtaatattagacatgaaaacagagacatatccacagatacagcagatgataatacatgagaatagcatgaccaattttatattaaaattgataactaaaatgaacatatttctagataaatataattcacttaaattgactcaataagaaacaggaagtttgaatcactctgtaccattcaggaaaaattaaataaataattgaaagtcttccaaaaaataccttcaggacactgagggaaccaaagctgaaagagaataccaaaatcactaatataaagatttttttaaagtgtataaattggactgtacataaaccctaaaacttctcctgtggagctctatattctcctttattccttatcttctctctgttggcggtctcctaggttctatagtaggagtcagcaaacttttttagtaacaagaggtgataacagatattttaggttttgtaagccacatagtctttgctgcagctactcagctctgctgttgtagtgcaaaagcagccatagacaatacataaataaatggatttatgttccaataaaatttgtttcaataacttgtgtgtgctaataaaactttatttataaaagcagacagtgggctgaattttgcctttgggctatagtttgctgattcctgttctagggcaatagttcttcatctgctgtaatttggaaaatctgaggatctttaaaaaacactgacgatgtttggctcctactcccagattctctgatttaattagtatggcataggagctgggcatcagagttttgtattgtcttgctttgtttttttaagttaccaactttaccctaacatgcagcaaaatctaatgtgatagcagagacacgaggtggaatgaaccagggaatttattaactgctgagaatagagtccctgttgccaaatttcattcagctatggtggcagcaagaaatatacttttattgtgaaaagtctttgggacactgaggtggtttgatacagaattactccgactaatacattaattggtaaatggcagtattgccacagaaaataaatatgtgtctttggctttgtggttggtcagctagaaaaatgatatcagaggctgtgtagataacagaccatattatgtggtacaagagcatttggtaaaagagttgcatgccataaggtgtaaagcagaccattcacttggagaaatatagctttaaggtacacagttggaaaaaaaaaaaaaacaacagagtgggtatagcttgcttttttttttttttttttttttttttttttaagatggcttctcactctgttgccatgcagtggtgtgatctgtgatcttggctcactgcaacctccgcttctcaggttcaagtgattcttgtgcctcagcctcctgagtaactgggattactggcatgcaccaccatgcctggctaattttttgtatttttagtagagacagggtctcaccatatcagccagcctggtcttgaactcttgatttcaggtgatccgctcacctcagcctcccaaagtgttgggactacaggaatgggccacggtgcccagcctatcttgccttcttttggctgacattgacaagggataaaggaaagagatgagctccataaagaatttcccagtttggaacctcaaatgcaagataattaaaaagattccagaaatttgtggcattaaatgtttagaaaaacctactgcttctaggtctcaaacagtgaaagatgagaaggtaaataaataaataaataaataatttttaaaaagctatttacatagcaagaattcaataagtagtctgaataacaaaaggaaaagtaatttggcccttcagtaaagataattctgaaaagagctacagttatctctcaagcttactattccagataacttcaaggttgctgtcaacacataaagatgggacatgaggaagcctatgaggaggatgcaaaaaaaaaaaaaaaaatttaaaaactctatctgggacagaatgttgggtgtattcactagtacatgaaactgattggaatcaaataaatcataagcccacaatatttttgaggaaacaatattgccatgaaagcatcatcccagttcaaaaccctgcaagggcttggcaaagcttagaacaacttttggattggatataggctgcaaagtataagtagcccccaaggaaggcattcccaaaggtccacttcaattgtggcataggagtgtaatggataggagagaacgtctgagtttgcagccaagagccactgaaaacaatgagtgcccaaagaagtattgttcagagaacaaaatcagggcttatccatgaactttctctcttctccatagaggaccttcacaatgtctccccagcgagatttcaaacttgcattagtccagtaactgctgtgtgtctcctatttacctcttttctgaatagttacccagaacctgagaactcatgttgtgaactgatggagaaaactatgcatcagtgaagtatcttggaccttgagctagatgaggtgacttagtgggactttggcttatttctcctgggaacaagctgagtgtattctatgtatgggaagaatagtaaaatggatattcagtaaccagagctgaggactgaagtagaaacaatgtgacgtgttgcctaaaacatgctacatggttcctttttcttctggagacagctagactatgtttctcaactctcattgcaatgaacagaccaaagaaatatgagtggaagttataaatgctacttccaagtctggcttctaaaatctcctgtgtgatacttcacatgctctttttctcatcctctgcagctgaatgaaatgaatatagaggagaactgaaaggccatggaggatctgagccactacatggaaagagcaagggtccatgaatgacagcttgaaacagggtccctctctgctgccaacctgcatggatggagacatgaataagaaataagcactactgagtcaagacagagagatctgaaggttgattgttatagcagttggacttccctattatctaatatactgtgctatcttccaatgcttagctagtaaggggggctctagggataccagttaaagaactctggaatgcatcccttgcaagtctgagatatgaaaggccacaattaggtcatgttaagaaatctaaagctgactgtagactgaagtctggcttcagtaaatatgaaagagaaaagaagagctgactaactgctttgaattagagccaggagagactgttgcattgctactgacctgcagttagaaagttcatcagggcaaggagccagtgattgtttcccagggaacatgtgtgggccaatgatacagagctcactggagtcttggttggttttgtccagtaggtctgcctggagggagaaggaaaacttacaaaaggagactgggggtatacttgtgtgtgaaggcccagataatgaggacagatccccagagacctcctagaatagctagaaaagcctggggtcaaagaagctgcaggggaggagtgtccaacatgaaacctctgaggagttcagggaaacaccccaagagaaaggaagtcagctttaatcttcggcagggcctagagagtgagaagtcaatcaggaataataaatgacccatctccttgtcccctgtaccctttgaaccagaggggagcaaaacagaagctagctaatgaaagatgtgttatagaattcagggtaactgaggttatgctgcagaagcaaataacaaaaagatctcgaggacttcttgtttaagttctttttttcttcacatacatttattttctgttcacactacagtatgttatcagttagcatgggtctctgttcagcatagttcaggcaggcacacaggccaatagaggttctgtcttgatacatatttccaaaagacattgtcattgcataagcacagcattggaacactgtgtgactgtcctatggacctcaactgtcccatttttaaccactgtgtgactgtcctgtggacctcaactgtcccatttttaaaatgggaattcatgaaatgaggcagaaaaaaggaacaacacatatcgacatttctca

SEQ ID NO: 403 - DNA, 4661 bp, Homo sapiens
gagacagggtctcaccttgttgcccaggctggagtacactggccaaccttcaggtttcctcagggaagcttccctggctgggtaaagcagccccctcccctcccccacctccagttatcctccttcttgtcccactgtttgtttccttcacagcactttaacacaatctataattatctcatttatttgtttattgtctgtcttttcctctagaatgcaagttcccagagagagagagtaggcatcatgcctgtcttattcagcaccataatgctagcacctgagacagtgcctgccacttagtaggtgttagacgtgtgataaataaaaaagtggacaaattatctcattgaagccccacaataacctttggtgatggtaagcactattatccccaccttacagaggaagaaactgaggctcagccacctacccaaggtcatgccactagaaataagtacagccaaatttctaacgtaggtctctctgactccaagtttgatggaaagtggggaccattcttttgtttgttttccgagatggagtcttgctctgctgtccaggctagagtgcagtggcacaatctcggctcactgcaacctctgcctcccgggttcaaatgattctcctgcctcagcctcccaagtagctgggattacaggtgcgcaccaccgtgcccagctaattttgatatttttagtagagatggggtttccccatgttggccaggctggtttcgaactcctgacctcgtgatcagcccacctcggcctcccaaagtgctgggattacaggtgtgagccaccgcgaccagccagggaccattcttaaccagcctaaactgcacctggttcctcttcctgtctgcctgtgtatctccactcccaacccaggcatccccagagaaacctggggcagggaagggaggaacacagaatctggaagaatgtaaatctgaccttttcttttacaggcttaaaatctgtaaatggctcctctccaacccctcaatccaagcactttaagttgaccagcaggtccttagttctggcccctgccttcttctccaacttctcctgccctcctgagccacctcacctcctcctccacctccagaccctggcacatactcctcctcagcctgcaaggctgaccccttcctcagtagcctatccctcatttgccctttgaaactcagctctggcaccaccccttccagaaagcctctagactttggagaggacagcgcctttaggtctcctgccagaatttccggctcaaggcagggccgaacacaagatgtggtcattgtttacctgtctgcctttcccacagagactgtgtgtcattcttggggtccagtaccctgtgccggtctggcacatgggaggggctcaggaaatgtttgtagaatgagttaatcaaccagtgacaggattctggtacccagtcggccaccacatctcctccaacttccttaactccagacatcttttcctgggctaggccttaacagaaggaactcctcacccttcactgtggggtcaagtcaggggtggagacaatgcgggcccctcccccgctgattcagcgcctctcctaatgaggtgaggcctcaggtttaggaagggttgccacacccactggtagggggagggtctgtgattctgtaactggaggataggtagggggcttcggttgtagactgagtagggagctgacctaagccggtagattcaagtactgcccgagagatctctgcctttccgccccacaccccagtcaccccgcgccaggctctcggcgcgtcagatcccggccctgcgttcttcatctcctgccccgccacgcccccaactgcagatccaactcgggtctctccgaaagcagcaaggagcctcggggtgggctctatgccccgtgatgctccgcgtctgggaacggatgaaggggtgccagcaacccccgccgtccccgctgtcgatccgggtttacacgaggctcatccgggattagtccctgcggtcggctaatcccagcggctggaccgaccccggggtccggagcgaggcccacacagtaccggcctagggagctagggcgcgggtcgagcaaaagcgcgcgacgctgggcgggtgtgggggtggggaggggcggaggagggagcaacgccccgggaggcggggccaggaaccggctgatccggtctctgttttccgacctctccggagcgggtgtttacccgggagccggacggaggaggccggggccggtcgagcccggaaggggggaggggagcgcagtcggagaccgaggctgagaccttttcggttcctttcccctaaatcgacttccaaccctcgttcctgagcgtgggagaacgcggcagacagacagatgtctcccgccccttatcctatccagttccgcaattcacactcgttgccaaagagtggggagcgggaatggatacacccgggaacgactgcacgtcctgcgggcgcccggggaagaaggcagcgcagcacaaaacctctcctgcggtcacctcccaccccatcctgcacctgagttcttgcggggagggggtgcccacagcaggtcgggcccagaggatccggcaggggtcactttgaggtgtacggactaggagtctatcctcagaacgcgtcagctcgaccccatccccgattaataccagtgcgggtctcagtctcttgtccctcgcgtcccccagccctctccaaggcctccagatttagctcccactctccacgggacgcaggcccgaggacccggaagaagctgagtggggtccggttttcacacttttattgtaaagctcgggaataattacacgggtctttcattgacagctcagcaaacaaaccggaaacgaaccgaaccggagggggtaggggcggtgcctgcgcatgctcgcggcggggtgggggggggtgggggtgggggtgggggggtcagagaaagagaaagacagaaagagacagaaatcattacaaatcaacgggattgtgctcgcagcgccagggatggggtggggtggggcggggcgggggcccttcccgggaggagcgaggcagtgggaagtggcacgaaccaagagaaacacgaccccaatgtgggcacccgacgcgcccaaaaccccccaccccgacccccacccccctacacacgagagagacacggcccccctccccactagataacccgaggagacacagtctcccctccccatgggcagacacacccgcccgaaaccccatgggcgggacacagtcccccctcccagagaagtccccagtggagacgccccttaagagactttctcatggccaacacaagccctcccaacacccggagacagccccgacccagggaagaaatggctccagaggccctaccctcgggagagagaggtatcccagggctcctaggagaaaagacaactcagagatgcccagcctcatcctaaagtgctgcagggcagagaaacccccataggagagatgggggtagggccagaaacatcccttcccagacgtgtttcagagatagcccccttccctgggaagagagatggcccgaaactgacttgccttaagtactcccaggaaccctgggaggaaaacaggctccccagagagcctgggtaattgggggagacatgctcccgtggtcctcagcgggaacacatgtcccccggagactcccaaggggagagatagggcctagagagaccccagaggtgagggatgcccagagaacttccccccaccccggaatgtgaaacatgcttcaaggaccctaggagagaaatatgtccccatataccctccccctacggagagacatgccctgaagtagggggatggggaccgactaggtcccctctgggaagacacagactgggtcaggctgggtttgaggggggctctcctctggccaaatgtcgcctattggtacataaaactgtacgcgacacaggcattggggaggggcttcacagacctaggacccacagggatagtccccagtgctgtcgccaacccctgcccacctttggtttcatctctccagtgcccagttggtgacagactcagtgccctggccccaaccagggggctgggggctctgtctttgcctgtgggaagggcttctcagctctcccagccatctgggccaccctctttcttctggcttctccattgtgcaaaatgctcctctgctcttctgctcagtgctcaggggtctctaagaccagggcaaggtacccaggccactaggggcttccagtgggagtccactgaccccaggaatgccgcctgtctggaccaccttctccaccaagcaaatgggcctcatacaatcttcttgcccgaatcctgacctccaggacccaggacaatccttgaggccactgttccaccagctgggcacccaatactaccaactccaagactattgcacctgccccatttgtgcaggggaaaggggctgtctctttaacaagccccaagcccatctcctgggcctccccaagggaaaggagcctttggccaacccctagacctggctgctgccaccccatcccattctaccccttcccctctgtagaagggcttcgtatgccagggctacca

SEQ ID NO: 404 - DNA, 63309 bp, Homo sapiens
aaaataaagcaggcagaggaacgtggaaggactagactgcctgagtcttctgaccttcatctttcccctgtgttggatgcctcctgccctcaaacatcagactccaggttcttcagcttttggactcttggacctaccccccgagtggtttgccaggggctctcaggccttcggctacagactgagggctgcattatcagctttcctacttttgaggttttgggactttactggctttcttgctcctcaacttgcagatggcctgttgtgggacctcaccttgtgatcatgtgagtcaatactccttaataaactccctttcatatatgcatctatcctattagtcctgtccttctagagaatgctaatacaatatttttaatttttatatcccacaataaaactcagaagtagttaagtcaggcttaaatgcaagagaacggtttatattaattattggccataaccaacaaaaaatttcagaaaagtcagtatcatcatgctgcctttatccagcactgactttgttaagccttccagaatctgtcatgtatgagattcaacctgaaatacatacacgcaacaggtgcatcttagggctttgaggccaactgcaactcatagttgccaagaaccaccagccctgagaaacacctgaagaagaagattggtttagtgtttgggtccttctatgaccttgaagaaagcactggggaagacatgattgtgccttcactgagtagccccaccagccatcaccacttcatttcttacccacctttgtagtatactcattcctaattaagaaggctgaggcagagccaagggttaagttaacgcaaggctggtacctttcctaggcttgccagtcatttgcacacagagaagaccataggaaactgaaagaagaacagagagagagaatctaggtttcctgacaatgtaaattacatcttagtatgagaagttaaacaatatccattgttttgaactattttttcccttaaatccacagtggtaagtcctttctctttcaaggactgttgatcatcacaggaaaccgggaccatccggtcaagtcagggcatctctgctaatctttaagtttataaactggtacaagaaataaataaagaacctgagttggaattgccggttggtttaggcttatcttatttggagaaagtaataaattgattatgctttaagtgaacagtgggaagcgattgatgattcaataactttaaattaaaagaagatttactggaaaattggcagtgctgcagcagatttgagtcgtctgttaagtaacagttagtgccacatgccatgacaaatccagaagccagtttgtggggaaaaaaaaaaaaaaaaaaaaaaaaaaagggatcctcttccctggatatattttacttttgagcccatgaagaagatttgaagccaatgaagaagattcgaaggcacctttcagaaagggaagtgagtgggggcaaaagaaaccgccaccatctgctgcctcccagatacgatgataaaaaatatggcatattgtttagaagtaaggacattgccctttttcttttcttttctttaattttgatgtgcatcattatgatttcaaataatgaaatataagtggacttttaagttctgtttctggtctgttgaggttgacacggctcactgaaagttcatatctctggcaggtacatgagggaaatacacacccctcccagggatgatggaaggttaaggtcctaacacctcctgcacatctgagcagctgcacattgaaccagatagtcctggaatgtgggaaaacagaggcagactcaagagtctggaacattattttaggatcacacaaaaaagatacataattttcataggtaagtgttgtttttttgttgttgttggaaaaaagtttctcactaataactatctaaaagggaagtaattagggtttcaggcgttctaaaaataactgtaaagagggttttgttttggttttggttcgttctggtgtgccttacagctttccctaaggcaacacacttactgacctattgctagggcaaataggtggaaaaaaacaagctttcctctctctggagaaaggaagggtcaggtgtaacactgaagtgactcaaaagtaggggagcttgtatcagctctggtctgcacaatgattcccctgctctttacatagaaaaagaagaaaggaggagaaatctcacagcaatgtccttgatttaaccgtacaaaagggcagaaatgattgatcgttattttgccgtttgggctattgttcatttaaatttcatgtgccaattctgactgattagcagtggctgcttggagcattgtgtgaggaagaactctcaggcacatggtgagcactcagttagcacttgctgtatgttgaatgaatgcctgtcttggacacagggaaaggagtggtacaacatgtgttgcagagttgcctggagttgacaccaagaaagatattctaaagaggagaaggttagggatgagagacaaagatgcatgctaaggttgatgagctgttctcctaacataaagcctgatctggccttcgatttcagtacacatgagtaaactgttaaaggatgctacattaattggccgtgtatatctgaactcttgaaacaatgcatgctctttgaccctacctccgccccacaagtctagttctagcaatttaacctaaggaaataatgaggatgtgaacaaagccttagctacggtggtgtttgacagaagcatttcttatttataaaaaagagaaacccgtgcaaagtaactcaggttcaaaaagaggttaacataaggcagtatttctcaaatttggcctgttgacatttgggaacagataattctttgttgtaggggctgtcctgcacattgtaggatacttagcaacgtccctggattttatccactagatgccagtagcagcccctcactagctgtgacaaccctataccttcagatattgccaaatgtctcctgggaggagtgggaaacccaaaccactcccaagtaaggatcactggtataagggtatagagctctggcaattcaaaaaaagctgaaaaaccaggattcaaaatctgaagagctgcagcatcttgagtgcaatcatctctcttactcccatttccccttctgctgaccttgtttgatttataggacatagatctgctccattctaactctgagtctctgctcttcataattgcaatgtgtacttagggtaataatgacaccgcacacataactttatatgacctttcagctcaattatccgccaccgactgctaacttctttctgcttcttagtttaaattaagaaaagaggtagctgattggttctactcattgtgaaaagtcaggtgagaggccttaggtaactggctgcccaaggatgatctctaacctgctctggggcaggtgtccacctcctgctaggtcagctgtgagtggacaaattgaaagattccctcaaaatgtcactgataatgtcgttcattgcaatatgtttttcctgcttcttcacctgcctggcaattttcgattagatgagagacattgcaactttgcctggtttagaacactggatatttttatattcctctgaatattcttgagctttcttctgggacgcagctaagttacttggaaacagtttgatcttttaggctagattaacacccctctagttccacctgataagcctagtctagggctaattgttccctactaccagggcaagatcctcctaaacactctacccagtgtcctgtgaattaggaaattttccaacctggctggaggaaatggatactattcccaggctcatgtgagctccagctacagttccactaatcttttcatgtggttctttcttccagagaaagaaagactcaggtagtttcctcacatgcatgctctgatcagtgctctgccaaacacttgaggaggatggcctgcagacatccataatcttcttttatgcagctctctccttcccagtgctctctgctgtgaactctcaccactctgatctccccagacatcatccttaacaagtcagggagtctgccagtttctgtcagagttttcccttcttcactgtggtcttgaatccctttaagactacaagctggggcttagctttgtttgttctcatctctttcctttgatgactgatgtccgatgtccaatatccaatgtctcaaaaaccattgattcatattttgtctcattttttagttgggggggtggtaaacctggcttctgttatttcatctcatctagaagcaaaatttcacaataggttttttataattaaaaactgaaagcaacctaataattctaccaagagaattgtgtgtatatacagcattgttagaatgaaaattccattcacattattgacaatcctgtaggtgaatgtttattgatatgtaaatatgtttataacctatcataagtgaaaaaaataagtgtatgatcagtttattttgtgtatatatccataaatatatacatatacatatacataaatatcatattataaatacctacacatatacaaacatatacccatatatattagtatttatctttctatatctgtttctataaataatatatacataaaagtatacacatatctattatgtgccataattcctacagaaatcctcttgagttggtaagtatttttctctctgctaatctttattttgtaattttctacaataaataggtaatatttcatgataataaaatatataaacattattttgaatttactgttagttgatattcagtaaaactacattaccatatataataaaaatcaagaataaaattctaattttagttttatgcttacttaaattttttatttttttgagatggtgtcttgctctgttgcccaggctggagtgcagtggccccatctcggctcactgcaacctctgcctcccgggtttatgcctcagcctaccgagtagctgggattacaggcatgcaccaccatgcccagctaatttttgtctttttgtagagatggggttttaccaggttggccaggttagtctcgaactcctggcctcaagtgatccgcccgccttggcatcctacaatgctgggattacaggcatgagccgcgtgcccagccttacttaacatttgaatacatttataaaaaccctttctgatttgaaacacttaaattaagcactctaataaagctttgataaactattactgtgtttctaacattgtgaaaataatgtttcttttctatagggctattcattaccattaactaaagactcattaaatatttgcttttaaagtacttttaggttttcttctgcacgctttcattaaaataaaatacgtgaatgaagaacaaatgtaaaagaaactatgatcttaatatataagctcaggccatctaaggcagcaattacgaaagggaagactgatagaaaaagtaggatggaagagtgggagcatggccattctgtgggctttagagaagaacacataacattctctagggattcgcccctccggttctcactactcagcagccagagctgatattctatcatcaaataactaaacaactcactcatttatttctatgatactttttttttattatactttaagttttagggtacatgtgcacaatgtgcaggttagttacatatgtatacatgtgccatgctggtgtgctgcacccattaactcctcatttagcattaggtatatctcctaatgctatccctcccccctccccccaccccacaacagtccccagagtgtgatattccccttcctgtgtccatgtgttctcattgttcaattcccacttttaatcctagcaattctgttttttcatcactcctcttagaactgaagagagatgtgtgcaggtgtgtacatgcatgtttgtgtgtacaagtacacactagacacagagacacaataacacatcacacatgcacacacacactcatatacacatatgcacacacaaatctgcaggcacacacatatctacatacacatatgcacacaaaaatacacacaccacacacacacattacacacatatgcacacaaaaatacacacaccacacatacacacatcacacacatacatatgcacacaaaaatacatgtaccacacgtgcacatatacatagaaacatcacacacacacaaaactatactacaaatatactacacacacacgcagatacacattcatttcccacacacacatatgcccgcaaaatacacacaccacatgcacacacacattacacatataaataccacacacaccacacactacacacacatatatgcccaccactgcacatcacacgaatatacagcacacacacacaagcatgtgcaaacacacatatacatcgcacacaaacaagtacacgcacacaccacacaacatctaaaggctagaaacccccatctgtgctgtgacaatgaacacaatcagagctaggtttctatttacatcccactgagagaacatcgtctgaatagggattttacagacattcctccaatagcgtgctctgggggcgcacagggaaatatttggggatagttacagtgaagccagtttcagcaggcctgtgctctgaactgggaaggaaagggcaagtaacagaaattccaaatcaatgcatttcccttcacctgagtaaggggccctggaatcactggatgggacattgcgtccgggctctgattagagcagttcatgttatctccacgcctttgtttcatctttctactactttaacagcttcccctctcaatggccaagacccactaaaaacaatcatcagaaacaaacttgtcaaatatatctagatgtacaaagttttcctttgagaaggagataagcctctttcacaagagacaataggaatattaaaagagagtccaaaagcaagccacacgatggcagtgtgcgaaacgcttgcatttgtgcgtgggcacgcgcaaaagctgttcagaaaagaagcctgggggccctagggggaggaactgaattctttatgaaagagggaagacttgagctgaccttgagatgcattttaaatctttcattttttaagaaaatataatcgcatggcagaaaactttcaaagttcagggaaaaaatcacttcattgcagcagtcattctctacattcttggcaggtttattcataatagcatgaaaggaaaacagcccaaaggtccatgcgcagcaaaaggaataaacagattaacagtacagtcacacgatggaatactaactccatagcgctaaaaaggaatgagtggatacatacagcagcagggattaatctcaaatacattaggctgagtaaaaaaagccagacccaaaaagtgcatttataggaagttcaagaacaggcaaaactaatctatggggataggaagcaaaatcataggtgctgctgatgtaggagaccccctgatagacaggggcgcagggaacttcctagaattgacgctgcattccaactggggcattgggcaggtagtgtatactgttgtcaacactcatactgtgtgcacttacgagctgagcattttacagtatgtagtgtgtaattatatcaccccaaataattgaatctattttcctaaaacctattactcagtgatactagtgtttcacttggaatctatgcatttttttcctacaattgaatgttgattattccaacctgtactgcagacttgggggagccaaagacaagcctctgcttgatcttgctttcaaggtctctgaattgagatcagaccttcacgattcattctgtgtgttcacacaagggtagggaaagagctctggatggaaagagatattcaagttcatgttactctgcagagctcctgaatcaatgacttgagactaggcaagagaaaaagagtcaataatctaataggtttacttttcttcaataaatggaggccactcttgataataatgacctcaactctatccttgttatccaggaataaagtgcatcagctatactcttgagtaaatgaaaccagtctattgaaaataatgaatagaggctagcatttatttacttattactgagccaagcaattcacatgcattaatcatttaatcctcacaatactctatgaggcagacaatatgaagactgtttttccgagcacagaaaggttaagtaacttgcctaaagttgcacagctagtgagaggagaagccagaatcaatgcattacttggaatgaggaccaggaaatgacaatggaatatagagggaagcggacaaatggaaaataaataattaaaacctctattggacaggcaattcaaagagacattgggtattatcaagcaaatactcatttgcagacaatgaaactgaggcccatgaaggttacgtgacttcccaagtcattcatctaattaggagagagctgggacaagaagccatattttaaaaatcccagctcagggcctttctactacatcaaaaaaaaaaaaaaaaaaaaattaattgatttttttttcacataatgtccaattttgaaatctatccctgaggggattgttggttagatattcatagtattataaaattcaagtcttggaaacggcctggaaagatcttatggccgttggctccaaattcaagcagcatcacacttaaaccatcccatccagatgagaatctttcccagtttttaaagtcttccagatgtatctcaactggatttttaaatctgttttccagagcaaaacagcagaatttggaaaataacctaatatgcataaaccatgaatggcatccccggagagacacaagcccaaaccctgagcgtccagagcattttaattcgggatgcagtgctttaaagccctagggattattttcagcagaattgactctatgaatatgaattattcttcatgtcagcctttttttttttttttctgagaaggaaatctgatacaagattgaataggagaacaagtagcagaatttagggcaatataaaagggccctggaaggcaggtgaacacatttttcttccttgcccagaaaaatgtcaataggcattttacagcttctccttttctttcctttgcattctgtcctcactgaaaatgcccagttcacagcctgatattctttgagcgtttttccattcaagtcccagttaagtgatcactcctgggtctccaactggtttcggtcccgaagctgtgtttgcagagatggaaggatgcttgttgaagtcgggacgtccaagggccacataagtgaggatctaattgccgtgccttgtctcaaggagtcttgagttcatgatgtcttatatttcttcattacttcccaaagcaaaactttgtacatctagacatatacgacaagtttgttttttatgattgttttagtttgtcttggcaattgacgtgggaagttgttaatgcagtagacagatgaaataaagacttggagattagatgaactgctccaatcagagcctggatgcaatgccctgttgccctctctttcagatctatccaaagttaacttgactccatcgactggcccttaatttctgcagttctctcagttctgggaataaccttatgattgttcttcaggtggagaccctagaaaacctccagagtttgctttgatcctcatactccacctcccaaggaggaataaatttggaagtgtataataaatcaaagataaatttggaagcacatatgaaaaagcttttatgggacttctgcttttgagtaagatggagatattggtgacagactaatcctgaaaatcagaacaactagatgaaacagataaaatccaaaaattatctgttttaaaggtaccaaggagctgttgaagcaatgtaggtagagaggctgaaagacagcaaaggggagaatctgcaccagccttttatcctggggcactgtgggttcactgtgagttctgggtgagaacgagaagcttggcatctaaactctacccaaaccccttctcagcgggcaggatgcagaggtttcagcagagctcagggaaggtagccaggatgtgcaacacaatagggccttcaacacaggaccagcttccccctcaagacatttgctgaattctgaagctgcaagggaaggacataggaaagctaagctgagtacatcagaagagctgggtcgagttttctgcagtgtgacgatgccttggagacccaggttagagttcagttcccaggagaggcagtgttcctgggatgcaccagcctcagtcaaagccctggaagttcatgttgccggaagaggatcagcccagaggaggcttacccaaactgcaaattaaaggcaaaatagtgaaagctttccctcaagtggtggaaagaaataagggtgcctactgtttaccacttctaacctacatggtcctggaagtccaggccagggcaataatgcaagccaacgtataaagggcagaatcattggaaaggaagaaaaaacttactagacacagatgaactgtctctatatgaagaaaaatccaaaagaatctgcaaacaacttaaatttaatgtctctttacgcagtctccgcatgtaaggtcagtataaaaaaatcacctctatatctatagacctgcaacacagagaaaataaaatcttgcaattgcaggatttgcaacagcatcgaggaatattaaatacttaaatagaaattttaaagaggtatatgagatttgtgttctaaagccacaaagcatctctgagagggaactcaaagggagatctaaataagtagatatagtaaataagtagatctaggacatttgtcaatcagaagactcacttgtaaacatgtcgactcttcctacatgtatccccagcctcatgcaatcccaggagattacatgtgtgtgtatttgtaaattgactcaagtgattacaagatttatatgaaaatgcagtgagccaaaaatagccaggaaatcttaaggaataagagcggagagcagaggaaggcttcatgggccgggtaggggggcggggagccttgagctaagccgttgggtgcatgggtggtaagtggaattttgttagggactagaaccataacaagtttgttggggtaaccctaacacctatcctaatgcctgcctgatgcctaacaaatattcaataaatattggttaaatgtacatatgaatgaatggacagatgcttgagataagagtatgtcaggttaaaaggacagtagaagcaacagtaaagaaacacgaaactatcttacagtgaggcatcaaatgtgtcctaagtgcgtatgtgagctgcagaagaaagggaggctagaatattcagacagggcagtgttgtgcagaggtctgaagtaggcttgtagcatttggaccttactctttaggcatctaacattttggaacaatgtaaaatgagtgataggttgggagatgaattgggccagtgacaggggagccacatgacacccacccagtcacttccctgaaggacaccctctttgctttctatatccagcaccagcaataaaattggaattctttgctaaggtcattgttcatatatttaatatagaaatctccccaaatgttaaaagctgacagacacttaatttaaaagcctaagtactctctgtctgagccctgactatgccaaaagcaaagctttttgtgctatcaagaatttgatgggatttcctttttgcatttccttttcaaaaaccattagaacagccagcaccatgctcctctggagacccttacattctaccttcatgaattttcttggttaggaacagagtgcatgaactctttgggtctctctgttaggatgggtttcagctaactgtactttagtacagttagtaccagtgctttaatacacacaagcttacactcacaacgaagtccagagcaaagcagtctgtgatgattatggcagtttcatgctgtcatctcctatgagacagccctgccagaagggctgctcacatcctgatggctagaactggttacatggctgtgctggttgcaacaaaagctggaaaatgaagtgtattgatactccaaaagaagcagagtttcggtaatacagaagaatattggtggacattgaataggtcaccagcagtcattgctacatgatccagtcttcctttctaaaacaagaacaatcttgtagaaagcgggaactttgagactttcttagctgagaaatttgttgttattgttgctttacaatctctcctcctctcctaagaagttgtccaaggaaactggaggttctttgtttcttaagctggttgaagatatagtttgcaaacctgaacagaacaaaataactattcaccagaagaagaagaaaaaaaaaaggcaggtggaggtgggaaggaatgtaggcaagatcaaccaaatcaataaaagaactaatacccataaagtaaaatgagcaatggtcttgaatacatatttcacagaagaatacaaatggcttcaaattatggtaaaattggataccagataactgtgcttttaaaaatcaaactgggaaatatttaaattatgataatactcagtactagtgagcttgtggcttgggagaataattagtagagcttttatgaaaaatcattaaatgtatatataaagagtcttagtaaaatgtttgttattagatcagaaatttaccatctaaagaaacttaccgaatatgtgatgttttcacagatcatgaaattgaagggtacaaaaaaagaacttctatttttctgtgactaaatgtcgatttcaagttctcatacctcctggagttaaaaaataagatccagtcaatttcagtgaaaacctgttacttctgcttttcagtgatttgggctttacactcacagatctgagagtctctcttgcccccctggtaacacatttcagagctggagaaagagagggagaggatgggggtttggacatggcccatgttcatcttcccagtattctctgacagtcagcattctccctgctgacttgggcggatatgccatgtccagttgggtcctcaccattcctggtggcctcacctgagctgaaacagcatctctcctgggccccaggtgaagggtccatcatgccttgtgctctggcctcctgctgccccatgtggagtggtcctttgcacctgccggctcagtctctctcagccaccctgtgtctccttgaggcagggggagactcaggcgcagtcataaccctctgaagtgctaggactccatgctgccatgtaaaatacacatttctctattttttgggctcccaaaatagaactaaggttgggatggggtagtatctgtactatgtttcaaacacacacacatacacacacacacacacacacacacacacacacacacacacacggaggaagtttctccctcaaagacccaaaactagcaagaggtaccagtgatgggtcttttgaaggggatgtcatctgcccgtcaccaaactgggacacttaactgttttggtgtcacgggcccctttggtggcctgatgagccctgtgagttccttttcagaaacaatgtttcagatacataaaataaaatacttaggaatataatgggaaacaaattatcttgaaattttggtctctttacaaacaccagcttaagaacccttgcttccaatcttttctttataacatgaaatctatgcctcaattccttataggtttaattctttgaatgcaaagcaaaaagaaaaatttttctgttttttaaaaaagtctgctcctgtcaaccaaaaacatagattttcaggattacgtctctgttatgagttttaaaactcaaaaagtaaaactttggcgctctctctcctctctctttcttgctctctctctctctcgttttgatctttctctgtgatgaaatcttccttttttgatgttggcaaaaaaaagggggagggacattggataatttgaaggacaagaaaatctttaaaaatattttaccccatgttataagtgcacaggaatatttatgtacaaaaatattaattgcatcattattttaaattaataagaaattagaaaaaatataacataagaggatggttaaataaatgagagcacgccatatgacagaatattatttaaggccatttaaaatgatgctgtcatgattttttctatcgcataggaaaatatttttgatccaaagttaaatgtcaaaaagtagggttcaaaatgatagatgtaatatgacccaaagagagcgaagaagagaaaagaaagcaataggaaaaatgctaaaaaaaaataataccacattacagggattttctctgaatgagaaatattgctttaagcttttctaaatttttaaatgtagtgtaattttcttccaaattaattttttttctcattatcatattcctcctatactttgaaaaaaaattttaaataaagaaaatttgccggaaagttgacattttaaaactttaaaacttccaaaggtagtttctaacaggcagctattatgttaaatacccaacaaaagttgccacaaattgctatcttgaaaaaaaaaaaagactaaaatgatgacctctgatttatttccatgctccaagtcaaaccttgcccacacgtgccgtgtggggttctggggagtgcgtctggccgtggtacaggaggccccagcacaggtgccatctgatgccagcccaattaccgcttctgagtgttgcaaactacagaaactacacttcgctgttttcctccacctcaaaatatgtacacactaaacattattatgcagctatttcctaccggaaactcagatcagaatcaaattttagcagaaactactttcaataccagatttgggtgtgtccatcccggcagttctgcacctagcacgggagtaagagtcacccacgtgggtggaggtttatccactcgtctaaaacattcccactggaatcgatcacaaatagaagagggtttttcgtagctggaatttggtgaagcaggctagggcacccacatctttccttcaattggaatgaaaaaacttgtgtgcattttcgaagatctttgaggttaaaatgagttgatttcatcttaagaagccaatgtcacccaaaagaaaatgaacagtgtttacggttaaaaccatcagaacaagatcacgtcttgtgcaggaacatggatgaagctggaggccattatcgttagcaaatgaatgcaagaacagaaagtcaagtgctgcatgttctcacttgtaagtgggagtgaaacgatgagaactcctgaacacaaagagggaaacaaccggcactaaggtctgcttgatgggggagggtgggaggagggggaggcgcagaagggtgggaggagggggaggcgcagaagggtgggaggagggggaggcgcagaagggtgggaggagggggaggcgcagaagggtgggaggagggggaggcgcagaagggtgggaggagggggaggcgcagaagggtgggaggagggggaggcgcagaagggtgggaggagggggaggcgcagaagggtgggaggagggggaggcgcagaagggtgggaggagggggaggagcagaaaagataactattgggtactgggcttaatacctgggtgatgaaataatctgtacaacaaactcctgtgacatgagtttacctatgtaacaaacctacacatgtacccctgaacctaaactaaaaggtaaaaacccaaccaaccaaccaaccaaccaaccaacctaacaaccaaacaaacaaacaaaaaaaacaccatcatccccatcacccacattctcctaagctttgttcaggagtttcacgaaagttaagagagaaagtttctagatttagtttccccaaaccttttaggagacacagtacagagctttctgccctttgctgaaatacaggcagaggaggtgtttttggcaaatggacaacccttcacaaagggtttcttgtggagccgtgaggctttatgcaagtacactgtgtggtacggagagggtggcagctcatcttgtgtcatttttccagtctgcgttaagttcgtcttttcctgtttagtggttccatggcctgagtgagaggtgggaggtggatctatattttctcttttcccttgtactctgcccgttccacaacaaggatgacatttgtcttctcctttatggatgcaaataattctttgtcgcagacaggtggatgactgttttgttcaaatcttcatgtttttaaataaaataagtgtattgatcatgcctctattttctgtatttctgatgccttgacatctgaggcctttctgaccctgaagggcctgcccttcttggggttagccaattcctaggaagagcaaataactcccctgtgtgtgtactttttatatggaaccaaccgatccagagccctttccccaaccatctccataatctctcccattcagggccacctcccctgccctaatcaccccaggtccagataacaactaggtgccacgtccatgccccagagcctgctgaaattattcacactagcagatcctaagcctgctcaccctggttcccccattccttccacggaagccacaatagaggctgtggccgtgcttactcttcactccatttgcctcctgactccccatgtgggctcccatggtgtgacatgcccctcctcctgggaactgtgagtgacaaaccatctttccaatggcagtcatcttctgacctgtgcctcaccatacctggataatggtaaaacctacatgttaaaactagcctattagagtggctggtatagttcccagtcagtaacaggtgccaagtaaatggtacttatatctttcctccaacagtgtatgtaggagtactggtgacatttcccttctctccccaagccccaccccttgcatgaattttttaaaattgcattctccaagctctgtgactctgccttctgtgcccaagttcaccatacgaagtaggaaggatgcagcctccttctcaaaacactaattttcccaactgcaaaggtaccaaaagctgttttcatcctccaaaagtcctcctcgaaggtttaaaaccctgggactggccagatagccctgagttgtcttcatcataaattaagacctaataagatttggatggcatcaaactatcactcacgtgattcagaaaaagggactcagagagaagagcacttggggagaatgagaggccaggagaggagaggattttgcaatggtggcttggaactggccaggtatccttggtttaaaagttggtttcatgcgcgtccgtgtgaagagaccaccaaacaggctttgtgtgagcaacatggctgtttatttcacctgggtgcaggtgggctgagtccgaaaagagagtcagtgaagggagatgggggtggggccgttttataggatttgggtaggtaaaggaaaattacagtcaaagggggtttgttctctggcgggcaggagtgggggttgcaaggtgctcagtgggggtgctttttgagccaggatgagctaggaaaaggactttcacaaggtaatgtcatcacttaaggcaaggaccggccatttgcacttcttttgcggtggaatgtcatcagttaaggtggggcagggcatattcacttcttttgtgattcttcagttacttcaggccatctgggcatatacgtgcaagtcacaggggatgtgatggcttggcttgggctcagaggcctgacattcctgccttcttatattaataagaaaaataaaacaaaatagtgttgaagtgttggggcagcgaaaatttttggggggtggtatggagagagaatgggcgatgtttctgagggctgcttcaagttggattaggggtggcttgggaacctagagtgggagagattaagctgaagggaggtcttgtggtaaggggtgatattgtggggatgttagaagaaacatttgtcatatagaatgattggtgatggcctggatacagttttggatgaattgagaaactaaatggaataacagaaggagaaaaacaggtataaaaggtctaagaattaggataacttaggatatctgattagagagtgcctaaggagattcacatagtcctgccagcaaagattatttatttacttcaagagttaagagtggcagtttggggatagcaccaggagatatcagctgtgatggcttggagaaacagtgtaaacaggcagtgtaaacaagagcagggcatgtatgagtagttgagaacggtgaataggagtatgacaagacagaagatagtagggatgtcaagttttttggggcacagtctaagttggtctggtgtctagaatgagactggggcctaataaaaaggagcatctatacaggagcttaaatgggctgtaccctgtagcattctgaggacaggcctgaattctgagaagggaaagtggtaaaagtattgtccagtcctttttggtggctgagcttggtgaggtgtgtttttaaaagacctttagtccattctacttttcttgaagacggaggaccataagggatataaaggtttcactgaatactaagagcctgaaaaactgcttggctgatttgactaataaaggctcatctgttatcagactgtattgaggtgggaaggctaaactgaggaattatgtctgacagaatggaagaaatgactgtggtggccttctcagaccctgtaggaaaggcctgtacctatccagtgaaagtgtctacctagactaagaggtattttagttttctgactcagggcatgtggagtaaagctaatttgccagtcctgggtggggcaattcctcgagcttgatgtgtggggaagggagggggcctgaataatccctgaggagtagtagaatagcagatggaacactgagaagttattttcttgaggatagatttccacgatggaaaggaaatgagaggttcgaagagacgggctagtggcttgtactatagcataacctgcctttgctggtgtgtggcgattaggcctggtggaactgccatcaataaatcaagcgtgatcagggtgaggaacaggaaagaaagaaatttggggaaatggggtgaatgtcaggtggatcagagagatacaatcatgggggtcaggtgtggtatctggaataatgtgggaggccggattgaagtctgggccaggaacaacagtaattgtgggaggctcaacaaagtgtgagtatagctgaaggagccaggaagcaaaaagtatatccatcaggtatgaggaagaaaatagattttggaagttatgagaactgtagagagtgaattgagcacagtttgtgattttgacggcctctaaaagtattaaagcagtggcagccgctgcacgcagacatgagggctaggctaaaacagtaaggtcaaattgtttggacagaaaggctgtagggtgtggtcctggctcttgtataagaattctgactgcgctaatcatgcctaggaaggaaaggagttgtcgttttgtagaaggtgcttgggtttgagagatcagtcggacacgattggcagggagagcacgtgtgtttttatgagaattatgcagagataggtaacagatgaggaagaaatttgggcttgattgaagtaatgggggctgtctgtgaagctttgcagcagtacagcctaggtaatttgctgagcttgatgggtgtcagggtcagtccaagtgaaagcgaagagaggctgggatgaagggtgcaacggaatagtagagaaagcatgtttgagatctagaacagaataatgggttgtagaggcaggtattgaggataggagagtatatgggtttggcgccatggggtggataggcaaaacaatttggttgataaggcgcagatcctaaactaaattgtaaggcttgtctggttttaggacaggtaaaatgggggaattgtaaggagagtttttaggttttaaaaggccatgctttagcaggcgagtgataacaggctttaatctttttaaagcgtgctgtgggatgggatattggcattgagtggggtaagggtgactaggttttaatgagatggtaaggggtgcatgatcggtcaccaaggagggagtagaggtatcttatacttgtgggttaaggtggggggatacaagaggagacgcaaaggaggctttggattgggaagaagggtggcaatgagatacagctgtagtccaggaatagtcagggaagcagatactttagttaaagtgtctcagcctaataagggaactgggcaggtggagataactaaaaggagtgcttaaaagagtattgtctaagttggcaccagagttggggagttttaagaggtttagaagcctggccgtcaatatccacaacagttatggaggcaagggaaacaggcccttgaaaagaaggtaatgtggcgtgggtggcctccgtattgattaagaaggggacgggcttaccttccctgtgagagttaccggaagctcggcgtccgtgatggtctagggggcttccgaggcgatccggcagcgtcagtcttcagccgctaagctgagaagatctgggaaggagtcagagagccttgggccagagttccaggggctctgggagtggctgccaggtgagttgaacagtccgattttcagtggggtcccacacagatgggacacaggttaggaggaatcccgggctgtgggcattccttggcccagtggacagatttccagcacgtgtagcaagctcctgtgggaggaggttctggaggaacgcctggctactgtggttcaggcgtttggaagttcttgggtgctggagatgtggctggggtttgtctcacagtggaggcaaggaattgcaacttttttctattattgtacaccttgaaggcgaggttcattaaatcctgttgtggggtttgagggccggaatttaatttttggagttttatttagtgtcgggagcagattgggtaataaaatgtattttaagaataagacggccttttgaccttttagggtctagggctgtaaagtgtctcacggttgctgccaaacaagtcatgaactgggctggatttttatatttgatgaaaaagagcctaaacgcttctgatttgggataaagaaaaaggagcattaaccttgactatgcctttagctccagccacctttttaagagtaaattgctgggcaggagggggagggctagtcactgaacaaaactgtaatccggaccaggtgtgaggaggggaggtgataaaaagattatagggtggaggaacagaggctgaggaagatttgggacctagctcggcctggcaaggagcagcctggggaggaagggagaggtcagatgggtctgtagaaaaggaagattagaaagactcagtgacgcttggggttggtactgaggggacaggcgggagggaaagaaggaagatttgggatgagttgcactgggcacagactaggaagggactgatgtataaaagaatgcctggacgtcaggcacctcagaccgtttgcctattttacaacaagaattatttagatcttgcaggatggaaaaattcaaagtgccattttctggctatttggaactactgtcgagtttgcattggggtcaagcggcattgcagaagaaaataaggcatttaggttttaggtcaggtgtgagttgaggttttatgtttttgagaacacaggccaagggagtagaaggaggaatggagggtggaatgttcccatagtgaaggaagcaagcctagagagaagagagagtagagaaatggagggaagggattcaggggttcttaccttccagaaaagtgggaaaaggggtttgggtgcagagataagaagtcagggcatggaaataagggatggggcacagaaataagaggtcagggcatggaaataagggattggggtgcagagatatgaggttggggtacttgcccatcctctagaaaagcaggacttgccactaagagtgaaggagaaggggttgaggagtacttgcccctctcccagaaaagcagagaagggatagagacaaggagagaaggggttggggtacttgccctgtccccagaaaagcagagaaggggtagagacaaggagagaaggggttggggtacgtgccctgtccccagaaaagcagagaaggggtagagacaaggagagaaggggttggggtacttgccccttccccagaaaagcggaaattgccgctaagggtgaaggaccaaggcaggcgtccctgcgtggtctgacacccttgaaacgtgggtgtataatcagagaggcgtccctgcaatgattaaacaccaagggaaggctgccttcccagtccatgaccagcaccagagttttgggtccacagataaaacatgtctcctttgtctctaccagaaaatgaaaggaattgaaattaagagaagggagagattgaagtgtggcaccaagattgaaaggagaaagaggttgagggatagtgagggaggttggagaagagagtaaaaagaggccgcttactggatttaaaattggtgagatgtttcttgggctggtcggtctgaggacctgaggtcgtaggtggatctttctcatggatcaaagagcaggaggacaggggattgatctcccaagggaggtcccccgatccgagtcacggcaccaaatttcatgcgcatccgtgtgaagagaccaccaaacaggctttgtgtgagcaacatggctgtttatttcacctgggtgcaggcaggctgagtccgaaaagagagtcagtgaagggagataggggtggggccattttataggatttgggtaggtaaaggaaaattacagtcaaagggggtttgttctctggcgggcaggagtgggggttgcaaggtgctcagtgggggagctttttgagtcaggatgagccaggaaaaggactttcacaaggtaatgtcatcacttaaggcaaggaccggccatttacacttcttttgtggtagaatgtcgtcagttaaggtggggcagggcatattcacttcttttgtgattcttcagttacttcaggccatctgggcatatacgtgcaagtcacagggtatgcgatggcttggcttgggctcagaggcatgacagttgggctcagtcacccagaatccattctttcaacaagtgtttgtgtcctgcacaacccaaggaaattgggatacagcaatgaacgaaagacacagagctctttcccttaaggtgtcaaatactatggaaaaaataaatagtgcagcccagtaaggtggatcagaagtgtgggtgtgcgtttgtgtgtgttggaaggtgactggggctggagggcagagactgcaatatttgcagaaggagtcagggtgggcccttagagaagttgaggtctgcattgaaggagtagaagttggcaagcctggagaatgaaaccaccaacatgaagcctttgggttgccagtcatgtgccatgccttctctctctaccctactccctcctgcttatttaatcattatttactctttgtccacaaagcaaatgttattttaaaaagactattccataagacttccagtatacaatagtttagactctacaaatttcagagatgggtgaagaacatctagtctaagggtttgcaaacatactttttaaagcttagaatcatttgtttaaatgaaaaagaaactctaaagggaaatgtaaacaaggcaaatgggaccaccctgggtgaagctcagtccccccacataccaccactcccagggcaaaccgtaaaggtgctcctgggagggcatgtgaaaagctggatttattctaaactcatctatctataagaaaattgacacccaaacagggcagatgacttgtccaaggtctcagaaaacataaccccaggcttcttgtctacttttttctccttccaccaagaaatgccatcccttgcatttaaaatttatatgaattttgcagatagaagcaatagtcctcatagcaagccacttacttatttcaaaatactgaaattttgcactgcagtttttttattagagttttatgattctaatcattcttagcttttaatcatttatatgataaatatttctatctttccgtgtgagaattaattctttccaatttagcctcatggaacttccttctgatattggtaaatgattgaaaaaaagttcttgatggttttaaactccctagtttttaaaaatatattcagcatttaaatgattgatcagtaatgtgcagaatagaattagagatgtgcagaaaactttttttttggtggtgttgttcttttttaatttttttaattatactttaagttttagggtacatatgcacaatgtgcaggttagttacatacgtatacatgtgccatgctggtgtgctgcacccattaactcgtcatttagcattaggtatatctcctaatgctatccctcctccctcccctaccccacaacagtccccaaagtgtgatgttccccttcctgtgtccatgtgttcttattgttcaattcctacctatgagtgagaacatgcggtgtttggtttttagtccttgtgatagtttactgagaatgatgatttccaatttcatccatgtccctacaaaggacatgaactcatcattttttatggctgcatagtattccatggtgtatatgtgtcaccttttcttaatccagtctatcattgttggacatttgggttggttccaagtctttgctattgtgaatagtgccgcaataaacacacgtgtgcatgtgtctttgtagcagcatgatttacagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcaccggttgtttcctgactttttaatgatcgccattctaactggtatgagatggtatctcattatggttttgaattgcatttctctgatggccagtgatgatgagcattttttcatgtgtcttttggctgcataaatgtcttcttttgagaagtgtctgttcatgtcctttgcccactttttgatggggttttttttttcttgtaaatttattggagttcattgtagattctggatattagccgtttgtcaaatgagtaggttgcgaaaattttctcccattttgtaggttgcctattcactctgatggtagtttcttttgctgtgcagaagctctttagttgaattagatcccatttgtcaattttggcttttgttgacattgcttttggtgttttagacatgaagtccttccctatgcctatgtcctgaatggtaatgcctaggttttcttctaggatttttatggttttgggtctaatgttgaagtctttaatccatcttgaattaatttttgtataaggtgtaaggaagggatccagtttcagctttctacatatggctagccagttttcccagcaccatttattaaatagagaatcctttccccattgcttttctcaggtttgtcaaagatcagatagttgtagatacgtggcgttatttctgagggctctgttctgttccattgatctgtatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagacattggtagcttgatggggatggcactgaatctataaattaccttgggcactatggccattttcacgatattgattcttcctacccatgagcatggaatgttcttccatttgtttgtatcctcttttattttgttgagcagtggtttgtagttctccttgaagaggtccttcatgtcgcttgtaagttggattcctaagtattttattctctttgaagcaattgtgaatgggagttcactcaagatttggctctctgtttgtctgttattggtgtctaagaatgcttgtgatttttgtacattgatttcatatcctgagactttgctgaagttgcttatcagcttaatgagattttgggctgaggcaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtgtttgcccattcagtatgatattggcggtgggtttgtcatagatagctcttatgattttgagatacgtcccatcaacacctaatttattaagagtttttagcatgaagggttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcctggctttggtatcaggatgatgctggcctcatcaaatgagttagggaggattccttccttttctattgattggaatagtttcagaaggaatggtaccagttcctccttgtacctctggtagaattcagctgtgaatccatctggtcctggactctttttggttggtaagctattgattattgccacaatttcagatccttttattggtctattcagagattcaacttctttctgatttaatcttgggagagtgtatgtgtcgaggaatttatccatttcttctagattttctagtttatttgcgtagaggtgtttgtagtattctctgatggtagtttgtatttctgtgggatcagtggtgatatgccctttatcattttttattgcatctatttgattcttctctctttttttctttattagtcttgctagcggtctatcaactttgttgatcctttcaaaacaccagctcctggattcattaatttttgaaaggttttttttgtctctatttcctgcaattctgctctgattttagttatttcttgccttctgctagcttttgaatgtgtttgctcttgcttttctagttcttttaattgtgatgtgagggtgtcaattttggatctttcctgctttctcttgtgggcatttagtgctataaatttccctctacacactgctttgaatgtgtcccagagattctggtatgttgtgtctttgttctcagtggtttcaaagaaccttctttatttctgccttcattttgttatgtacccagtagtcattcaggagcaggttgttcagtttccatgtagttgagtggttttgagtgagtttcttaatcctgagttctagtttgattgcactgtggtctgagagatagtttgttataatttctgttcttttacttttgctgaggagaactttacttccaactatgtggtcaattttggaataggtgtggtgtggtgctgaaaaaaatgtatattctgttgatttggggtggagagttctgtagacgtctattaggtccacttggtgcagagctgagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctccagtattggatgcacatatatattaaggacagttagctcttcttgttgaattgatccatttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcaggtgagatgggtttcctgaatacagcacactgatgggtcttgactctttatccaatttgccagtctgtgtcttttaattggagcatttagtccatttacatttaaagttaatattgttatgtgtgaatttgatccagtcattatgatgttagctggttattttgctcgttagttgatgcagtttcttcctagtcttgatggtctttacattttggcaggattttgcagcggctggtaccggttgttcctttccatgtttagtgcttccttcaggagctcttttagggcaggcctggtcgtgacaaaatctctcagcatttgcttgtctgtaaagtattttatttctccttcacttatgaagcttagtttggcaggatatgaaattctgggttgaaaattcttttctttaagaatgttgaatattgggccccactctcttctggcttgtagagtttctgccgagagatcgctgttagtctgatgggcttccctttgtgggtaacccgacctttctctctggctgcccttaacattttttccttcatttcaactttggtgaatctgacaattatgtgtcttggagttgctcttctcgaggagtatctctgtggcgttctctgtatttcctgaatctgaatgttggcctgccttgctagattggggaagttctcctggataatatcctgcagagtgttttccaacttggttccattctcccagtcacgttcaggtacaccaatcagacgcagatttggtcttttcacatagtcccatatttctcagaggctttgttcatttctttttattcttttttctctaaacttcccttctcacttcatttcattcatttcatcttccatcattgatactctttcttccagttgatcacagcagctcctgaggcttctgcattcttcacatagttcttgagccttggctttcagctccatcagctcctttaagcacttctctgtattggttattctagttatacattcgtctaaatttttttcaaagttttcaacttcttcaccttttggtttgaatttcctcctgtagctcggagtagtttgatcatctgaagccttcttctctcaactcgtcaaagtcattctccatccagctttgttctgttgctggtgaggaactgcgttcttttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttcctcctaacagagaggacccttagctgcaggtctgttggagtttgctagaagtccactccagaccctgtttgcctgggtatcagcagtggtgtctgcagaaccacagattttcgtgatctgcgaatgctgctgtctgatcgttcctctggaagttttgtctcagaggagtacccggctgtgtgaggtgtcagtctgcctctactggggggttcctcccagttaggctgctcggggatcagggatcagggacccacttgaggaggcagtctgcccattctcagatctccagctgcatgctgggagaaccactgctctcctcaaaactgtcagacagggacatttaagtttgcagaggttactgctgtctttttgtttgtctgtgccctgcccccagaggtggagcctacagaggcaggcaggcctccttgagctatggtgggctccacccagttcgagcttcccagctgctttgtttacctaagcaagcctgggcaatggcgggcgcccctcccccagcctcgctgccacattgcagtttgatctcagactgctgtgctagcaatcagtgaggctctgtgggcgtaggaccctctgagccaggtgcaggctataatctcctggtgcgctgtttcctaagcccgtcagaaaagcgcagtattcgggtgggagtggcccgattttccaggtgccatctgtcacccctttccttgaccaggaaagggaactccctgatcccttgcacttcccgagtgaggcaatgccttgccctgctctggctggcacacggtgcactgcccctactgtcctgcgcccactgtctggcacttcctagtgagatgaacctggtacctcagatggaaatgcagaaatcacccatcttctgcgtcgctcatgctgggagctgtagaccggagctgtacctatttggccatcttggctcctcccccagaaaactcttcataaaataaacctctgataactcagcttcactttacatgctattagaacatcatatcaggttaagttctttggacaattcctttaagatttataatgattgtatcccatacacagtggtgtagttggatacttaatcattgtcactataccaattgagtaatttagggacaaagcagatgagactagaagtgtggtagagagggcttaattatgtggtctggtggactaagctgattaaatcaactaaatcatagtctcttctccctttacatctgaatacgaagaaaccaggcaaagttctttccactctgagagctgtatctgctctcgatgtgactgtgggaaccaggatgaagtgatgaatactgttgcttcatctgccatcgtaggaactgctttattaattcaggaaattaatcgctcctctggcttcgactacagatttaatggtatgtcttctaagtctttatactcagctctgctccttccctaaaactccaacacttccagctttctgttgaatttctctacctaggtgtccatctgccattacctccaactcaatctgtccaaaaccgaaatcccactctctgcttgattttatgtaatggaactaacgttctttcaatcattcaagctgtaaaacctggtgtcatctttgactattcaccattctgatttccacattcaatgaatgactatgttctataagccaggaacacattcatcttttcaacaaccactgccaacacatcagtttgggctgttacctcttacctggacaaagagtgcagcaggcggtgtgagtgacatggacttaaggctcagttagggttctcctgcctcagggtaaaaataaaaatggtgtggagaaatgtgccacgaccatgttttatgtctttgccccaccacccacacattttagttcagttttgctaaatcatgtctaccacctgagctattcccagcacctcccacttcttctgagttcagtttcttcataatccatgtccacactgctgccagattcatctttgtgaagagctctgatgactcaaacctctactcaggatagactcaccctagccagcaaggctattcagaagacagtctctaccgtggtacaaatatgagccaccatggtcattatcacaagggtgggcttccatgaaatccaaggaaaatttagccctgttctccacatctttccttcctggtaattcccgctaccatttccaccttagatactcagggacatgttgtttccctatagacaaaggctttctgatactctttctgttttctgtatcaccagcctctcagcgcacttacacattatttccagatttttttctttttcaaacagctctgaatatgactgtcctacttgaaaacaaaggttccatatgacctaattaaggacagatttcctttccaatctttccctcattccttcgatgtactctgcacttcacccaaagttcccgcatgtcctcctctcgtcctgtcgcatgccaccaggattctcccactcaccacctgtcacagaaacatggaactctgtcttcttaaggggttctttttcctcacaacagcactgggagttaaactctatggcccttttcatgtttatttgtccagttgttaaatccctgagggcctcagttcctgcccatgagtttattcccagggagagaagaaacattaaaaagtacttttacacccaacatttctaaatggtctactggtctacatggtcttattgtcctcatatgtcattgaggaaacagacaaagaaataagtgatttggtggaattcaaacccaggcatctaatttaataatcaactttttttcttttcttttcttttctttctttcttccttcttcttcttttttttttgtttttgttttttgttgttgttgttgagacaaggtcttgctctgtctcccaggttatgtagcacagtggtgtgatgttggctcactgcagcctcaacattctggaatcaagcgatcctccctcttccgcctcccgagtagctggaactacaggtgcatacgaccatgcctggcattttttgtatttttggtaaagatggggtttcaccatattgccaaggctgttctcaaacttctggactcaagcaatcctcccacctgggcctcccaaagtgctgggattacaggcataagctactgcacccggccaataatcaattactttcttcaattatcttactgtgagttgttttttaaattcccttatgcctttttctaactttcctttctaggtctaaattctttgaggtcaagggtaatatattaaatatcagagcacctgctacagtgtgttggcacagagtatttgaaaagtgaatgcttgttaaattgaatcatatagatttgatttgaattttggtgacttttgattatatgtcttctaaactagtcttgatctcttctgatcttctgttcactgcatacttgcccgaaatgtttcttctaaatattcttaaccctgatgtgaattagctgaatatctttctatagttggtagtttgcctagcatctctgactaaacttactcttcgcaatttttcctctaagtgggctgctttttgtttgcttaattactttgtgcactttgctgtccatcaatatcatattctatgaaagcatcgactaagtaaatcctaatatgatatatggtgtaaataatagcacaaaagctactatcactcatttcagattctaagaaacttccagggctctggattagagctaagattgtctgtagaatcaagctgtctcagcacaaatttttaatagaaactacacaagagactaatttgggttcaaatgaaatacacattttagatatacatctagtagaataagtatttgttaactcatctcccgatttctaattggttgacccagcctcaggtggacttggatttatgatctccataaaatgcatactaagtgaaatctacctagtttcaaaaatattgtcagagatcacgtcatttttaaattctcttgaattggccttactttaagaacgataattcataatgtgagtgaggggtcactggactgggaggttatgtcattgactaaatagagccagaatctgggtattggagccagaatttggctaaatagagccagaaaggccttgtgggaaagatgcctgaattccagctttgtgtcccattctgcaccagctttttttcaagtttgtttttaaaatgtgattggtgttaacaaatcatcagcaaacacaattacaaacaaacattcttcctaagggcaaggaatattgcagtattgtaagtgtaggccaagtagtcaacatttgtgatgagcaaactctgacacttcggtgaccaagtaggaggaaagagacagtgtcagcagtagaaggccagagagagaagcaacttaaaagggagaatcattgctctatgcctcaacattataatcccaaacagaaagtatttctatggaaatgaatgggaaatgtgatcaattacagagtgtagaatttagcctttgatttatttttcctttgatatataatcatcattgcccacagcaggtatgaattttattaacttaatttgccattagttcaagaaatcatacatttccccaaaataaactcattttaaaaactgaaaaaacgtttcaagccttaaagatgcaaatatgtcatagtttggctgcattcagcaaattcctagaatcaatcagccgagaacagggtaattctgttactgaaaagggaactcaaagcatgcaaattgaaaccaggataaagaataaaatataaaagaaggcttacaacatctaaggaaacaccctacttgtatttttatattttaataaggtaaatatataaacataaataacacttctatgtaatataatcctatttctccttgatatgacatacgacatctaaactactccagagataaactcactttattaagaaatgcatattctaaatcaagttaagtcataataataataatttacatgcaataacattttccattttacaaaatgctttacacaccttacctcatttggtgcatgcacacacacacgcccctaaaatgttagaggcatagatataattattttcatttcctagataaggaaatgcaaatatcaaattaaagaggcaggaagagtctcctggagaactcagagatgctcttagcataatgtttccccaccaccctgcgggaagccataaagctcagcactgttagacaggaaaacaacttctgcagactctctggctttgtgggctcagtcaggccccacagctcttgcgaggcatggtctttctcaacaaaaacttgggccatctaaattttgcaggaggcattcaacgctttaacctatcagagaagctgaagactttactaagttggagggaggcacgtggaaggagagccgtgggcttaggctccataaaatgaaaatgggctggcgacctgagaatgtgcttccttgtttgagcatagtggctaataatttggaccctggagttagaaaagcatgagttgcaatatctgctctgcttccttcgctggttgaacttgaatgaattacataccttctctgagcctgttttcacgtatgaaacagggcttattggacaaatggaatggtataaggcatctaaacatgtcacgatgttgaacatccaatgaggcatcagacttcagtgacttctcacatcacttccgcaggttgaattctagcattcctttaccacattgacacaatgctggagaagttcctccagcctcccccacatctgccaccatggataagatcatgggtaacacgttgtataccaaatctccctcaatttataagtggtgtagtcgtacaggagtatatatgatagtcttatcattaccatctaaaagcccttttatgcaaacaaacaggattgcaattaagggggggattaaaacagattggggtatgtggtgcttgtctgaatgtaatctaactactacactattcatgtagtgaggagtctaattactagcttcataattatactactcaagaaaattgttttagtgatggttttcttaaactaacttgagaagatttttgcgccaacatgagcagaacaaatggaatttaatttcaaaacaggggcaaaggaaggttacccaggggaagaaaacctcatgagctggacggcagattttgaaattcatgcagaacagagctcagctaggaaaggaacaggctggcatcacaacacgagagatgtagggagccattcaacaacacttccagatttggtttataaggaaagaacttaacaagggaagcttctggtctccaaacctctgacttaagaggatctgcaatgattcttacttgtgtgttgtacatgaaaccacactccagctgtggtccccaacccacagcatcaacataaatctagaatctcagaatttgcctcaaacttaatcagagtctgaattttaaataagttcccaggtgagcatgcgcatattacagtttgagtagaactggtgtaaatgaccagcttgtggttccaaattgaaattttatgttttttctgttcttaaatgtaatatatgcttaataaagcaaaaaagaacatatgcataggagtgtaagggggaaaagtatacctgtaattgcaccaccctgagaggacacctgctccactgttgggtgtcttctcttccaggctgttgttacacatattgttttacattttaagctcaggctataaatacagctttgggtttttcatatcatgttataaatattttctatattccaaccaagttttgttgacatttgtctgcattctaccatatgtatttgttccttgttaaaagtttacagtaccttattgttgcttttataattataaataatcctctgatgaaggcatttatattttaacttttttctattaattcataaggttaaatttctaggatatgaaaatagttaaatctcttgatagagatgatctcttctaattataatattctttgaaataaggtaaagttttaaaaaagcatttggactctttatttctcagggtcttttgggtggatgttaatgtgtttaattattggggttcctgagaaagtctctttctccaaggatggtcagtggcttgaactctgaatcagtctgttttctttttctttttcttttctttctttctttctttctttctttccttttttttttttttttttttttttttttttttttttttttttttttttttttttttttgagacagagtcttgctttgttgcccaggctggagtgcagtggtgtaatcttggctcactgcaacctctgtcacccgcattcaagcaattctcctgcctcaacctcctgagtagctgctgttacaggtgcccaccactatgcctggctaatttttgtgtttttagtagagacggggtttcacgatgttggccaggctggtctcaaactcctgacctcaggtgatccacccgtcttggcttcccaaagtgcaggggttacaggcatgagccaccatgcccggtcaagaatcagtttattttctagcacttttatactagcagaacagaggatacgtacacgctactgttaagtgaagagctaccaccaactttactttgtaaataatcactcatttcctctcagggtgagtctgttacagcaatgggatgcccaggttaagtttatggaaagacattgaccttggagccagactgcaccagagtaagttctgtctctgtccctgaggctgtgtgacattgcctgagctattacttaccttagttctgccataatcatcttatttataatagtgtgttaataatgcctcttccccagaattgatgattacatgatgtaagagatattaaagcctctaacatgaggcataaggtctgtccctaaaatgtttccatacatggtaggtgttgtttgtttcttctttcaatgctgggtgagtagatcctgtatctgccattcttacatggggagaagtggcagattgctttagatggcaaccaggattatctctgaagagtgtgtctttattttagtttatttttcatgatggagtcttgttctgttgcccaggctggagtgcagtagtgcaatctcagcccactgtaacctccaccacccaggttcaagcagttctccttcctcagctttccgagtagctgggactacaggcactctccaccatgcctggctaacttttgtattttcagtagagactgggtttcaccatattggccaggcttgtcttgaactcctgacctcaggtgatccacacgccttggcctcccaaagtgctgggattacaggcatgaaccactgtgcccagccgaagatcatgtctttaaatacatgtcgagcttcatttagagaaattacgtttggtttcatttttttcaattaatacaaaacacttttgttagcaagaatgtagataactgggccttgaattctgccctcagttaatgggataagcctctttcagccataccagaatggtcaatgtggaacaggcagcagggacaggacctcttctgtggactagtggccccaggcatgaacaatctgcattctcaggcatggatccttcctctaaacaatgggaatcactgctgtgaattaagttttctctaacttacagctgtgtgctctagatttagccgcatgcttaaatttcaaatgtatgtctcttatttacgattcattgagcagaatattttcatatataaatatgtatagctgatagagaagttcatgacccattcaatgaaaaatcaagtacattcatagagttaaatgtcaatggtgaatttgggcagtggtatgttaagtaatttattattgttattacttatgttttacatttttctaaaatgagtacgccttacatgtttaattaaacaaggaaaaggacttaaattaataaaaataatcccttatagttagaattgtaaagagaaactcttttcatttgttaggttattctgccaattgtttatctttagtcaaagggcagacaattgattcatttgaaaagaaatttcagctccactagtatctttttgctgtgtttacctatgccaagcccctgttcaaaggttggtgccccgtaggcttccctggtgatgttgacatgcaggggaaaggaacttaagttacaaaaatgatgaaatgatattcttgctaaattatatctcagttatgcacagaggctgaaggaagccagcatcacctgccaatgacaggtatccttctgacaaattagcacctgtgcagtgacaatgagtctggtccgggagttcctgcacttattcttcccacaacttgcaggacaccttaagacaagcagcagcatcccagcccagcaatggagcttcttcaggaaagactgagccagctcaacagattcctccttcaggcatttacagcacatttgtttcatctcatgtggcattcattagaggtggacaacaaaaaaacaaaatgaagctgacttctgtcaggagctcagctgagtgggagagagagctgagctgcctgtgctggagttcattgaatgtaaaccagaatgaaagaggaggtgagccttggatcacccactgtgatggcatgagcagagcagggtgctgacccaggaaggcgtcacctcccatcattctgttcctccctccgtgggattgggtcactcactgtcatgtcatgagcaggaggctgacccgggaaggtgtcacctcccaacattctgttgtccatcctgtgggattgggtcacccactgtgatggcacttgcaggagggtgacctgggaaggcttcacctcccaccgttctgttctccctcctgtgggattgggccacccactgtgatggcactagcaggagggtgacctgggaaggtgtcacctcccaccgttctgtttctccctccatgggattgggtcactcgctgtcatggcatgaacaggaggctgacctgggaaggcatcacctcccaactttctgttcctcctcgctgtgagattgggtcactcactgcatggcacgagcaggaggctgatccgggaaggcatagcctcctaactttctgttcctccccgctgtgagattgggtcactcactgcatggcacgagcaggaggctgatccaggaaggcgtcacctcccaccgttctgttcctctccaccgtggaatggtgtgctggtggatctgcacagaccttgggtcatctcacttttgagggagccccagaacaaaaggctctggcagtttaatggcccctggggctgaggagaggagaaggagggcaggggataagtccctctgtgggtccgctttctccttctgtgaattatggatcatattttccacttcatgtgaaaatatcaaagcagttaacacacgtgcagtgatttttacaagcgttcgcgggaaatcttccatgggctttggccatcagcagtagtcatcttagcaatgctataataatgacgtgcatttcttgcctccatatttcctttatctctttctcgttttgatgaataatgacaggttcttggcttgtttatctttttgtttttccctctgccatgtgtgttcctactcctgcctacttacaggtttcaggaagcttcctgggctctggaagtttgctgatctgatcaccagatttcattcactcatgtagcaaacagtcaaggagacccaagtatgtgccacactctcagatatgctggttccttggcgaaatcacgttaactggtttgcaaaaggagtttgtgctgatttctctgtgtttctgtgtttatatgagcccaaacacaataacctagttgtattatttcctgggtgaatacttgaattcttttgcttttctttttcaaaagaataccaatacatttttagcatatatataggagatcgtaagtctggcataagtcttgtctctaacagccccccttggatatctgagagagtaaatgttttcaaagttattttatttctgaatgctatggtttttctctctcacgtcagtttcctttttctttttgactgaagtctatttttccctcaggcggccattgccaagggattacattatgggtttacagtaaccataacagaaagtttttcttctgttcaccacccatctgcagaattgcaggaagccaactctcaactctgccccctttgttcctggggtttgaggtggtgcctgatgtgcactcacaaatgcagatttccaggccactgtgtgggacccttctcttctgtcatgtccagtggtggctctttaggcccaatgccactgccaagatgttcctggagctctcacgtgggccgttttgtgttgtgaatgcgtctggagtcaggaccacctacataattttcaggtcctggtacaaaatgaaaatgtagacatcttgtttaggaaaactcttaaggccatggccagttgcagtggctcacacctgtaatcccagaacatttggaggccgaggtgggtggatcacttgaggcaggagttcgagaccagcctgcccaacatggtgaaacactatctctactaaaaatacaaatattagccgggtgtgatggtgggtgcctgtaatcccagctactcaggaggctgaggcaggagaatcatttgaacccaggaggcagaggctgcagtggtccgagatcacccctctgcactccagtctgggagacagagcaagattctatttcaaagaaaaaaaaaaaaaagaaaactactaaggccagaagtcttggctcacccctgtaatctcagtgatttgggaggccaaggtgaaaagagagtttgagtctcagctggagaccagcctgggtaacttagtgagaacctgtttctagataaaacttaaaaaattagctgggcatggtggcagacaccagatactcaaggggcttaggtgggaggaattcaaggctgcagtgaggtatgacagcattgcactccagcctgggcaagagagtaagaccctgtctgcgggggggaaaaacctattaagaatttcaagatggcaacagcagagtgttaaaccaagtgtgagtccctcctgcacacactgcattcatcgtacaccgtgaagctggccctctccctgtcccagttcattctcattcttgagtttgggctacattgctctctggaccatgggcgggatgtcctcggtctcctcccttgacgtggatggtcactgcactgaagtacaaaggaaggcattctacccctatttgcactgaatgctaatgccaggccacaaagccgtgttgcctcgtgcctttgattccttacagtttcacatcttggaaccggccaccacctgagcttgtttcctctcattttaggttatgtctctgggaggaaagcaaaggacgttatggaagaaacaggacacagaaatattattattcatcaaatagagtctgtttggaaaatctggtattcccagcacaatgtcaggagatatcctaatcacaaaacaaagtagaagacacaatccgtgctgacctggatctcataagaatctttaggtgaagtagacacccagtaaagcaaacacaaggaggaatgcaatccattgttagtttttgtagtatggaatataagattaagaaaatttctagaagataaaaaattatgtgctggggggggcagtggggagagtcatgaagctattacaaaagagagagggtttgaagtgagtctgaaagaatgtataaacactaggttgccagtagagaaattatagctaacaataacttattgcgtattccagagtagctaggagagaagatttgtaatgatcccaacacacacacaaaatatacatgtttgaggtgattgataactcaattaccctgagtggaacatgacacattgtatataggtatcaaaagatcacctgtaccccaaaaatatgtataactattatatgtcattaaaataaataaataatttttgagagaaaacaaaattagattgtaaaaatgaaaggaaggtgtgattataatcaacctggaaagtcagttttagctcccaaggagcatggggctgtggatctagttgtaagggctgttgctgctgaatagacagaggtagagatggagttgaggtggggcaggagaggtcctggctgcctgagaagactgtgctgggagccacatcacagcaggtcttgagttccaggcgcttaaccccttcttttgtaggaacccttgtaggtggtaacagcgacatggtgatggaagggtaaatttggtcatggtttggaggaaagaaaaacctgaatcaggaaagccaatacaacggtattataggtgacccgcgagaacattgttagggtgagaatgacaagtttaggcattaaaaatgccaatgagacggggtgcggtggctcactcctgtaatcccagcactttgggaggccaaggtgggcagatcacgaggtcaggagttcaagaccagcctggccaacatagtgaaaccccatctctactaaaaatacaagtattagttggggcgggtgtctgtaatcccagttattcaggaggctgaggcaggagaatcgcttgaacccaagaggcagaggttgcagtgagccaagattgcaccattgcactccagcctgggcaacaagagcaaaactctgtctcaggaaaaaaaaaaaattgccattgaggcctggtgtggtggttcacatctgtaatcccaacactttaggaggctgaggtgagaggatggccaggagttcaagaccagccttcatttttatttaactagtgtattctcattttactagtatattaattgtttttcaggacagactatatttcttaatgtacctgttgtactttctgtacaactgtgttattctactcaacgtcagaagatgtgaatttttttcacagggaaaaatagccatgggaagtaatatctttatatctgtagaacttgtctcctgcctctgctattagcttattctattgtttgttcatgtgtctctctataccattagataatgaactccttggagacatcaagaatgagattttattcacctctgtgttctcagaagactgcacagtgcctgcccataagagcgctcaaatattgttggaataagttaacaaaagaataagcactaccaagaactgtctttaagaaaacacacaccatatttgtgtgactgcaaaagcaatcagaaaaattggtaggataatttcaaattcccctcttgaagcaaaatcacacttataagaaatgaaatcaatgtttggttcacctgttttaaacaattaaaaggtaccaaacacaaatataaaataaaaattaaatttgtaaagccaaagtatgtgtgtaaagataaatatccacatgtacatgtcaacaatttaaaattttttatgtgtttggaaggctttttaaaaatcagacctagaaagagggccaacttaaaggtatttttgagagtttacttttggtgtgactcagacagtgtagtatagatgcaagagcttgagttggagtgaggaaatcagttcttactattgttgacttgttctctgaccttatatatgtgcagcataattcaatcatattttcaaatatttattcaaaacattgcccaaagcatgtgttcgatgattcatttaatcttctagcatctcagttttctaatctttgcaaagggaataataatacctttctaactcatcccaaaaaaccattttggaatgatgaaggggtgggttgcccctccacacctgtgggtgtttctcattaggtggaatgacagacttggaaaagaaaaaagacacagagacaaagtatagagaaagaaataagggggcccaggggaccagcattcagcatacggaggatcccaccagcctctgagttcccttagtatttattgatcattcttgggtgtttctcagagagggggatgtggcagggtcataggataataatggagagaaggtcagcagataaacacgtgaacaaaggtctctgcatcatagacaaggtaaagaattaagtgctgtgctttagatatgcatacacataaacatctcaatgccttacagagcagtattgttgcccacatgtcccacctccagccctaaggcggttttcccctatctcagtagatggaacatacaatcgggttttataccgagacattccattgcccagggatgggcaggagacagatgccttcctcttgtctcaactgcaaagaggcatgccttcctcttatactaatcctcctcagcacagaccctttatgggtgttgggctgggggacggtcaggtctttcccttcccacgaggccatatttcagactatcacatggggagaaaccttggacaatacctggctttcctaggcagaggtccctgtggccttccgcagtgtttgtgtccctgggtagttgagattagggcgtggtgatgactctaaaggagcatgctgccttcaagcatctgtttaacaaagcacatcctgcacagcccttaatccatttaaccctgagttgacacagcatgtgtttcagagagcacggggttggggtaaggttacagattaacagcatctcaaagcagaagaatttttcttaatacagaacaaaatggagtctcctgtgtctacttctttctatgcagacacagtaacaatctgatctgtctttcttttccccacatttcccccttttcttttcgacaaaacagccatcgtcatcatggcccgttctcaatggtcactgtctcttcagagctgttgggtacacctgcagactaacaacagacaaaacaggcacacaaggattaatatgaaatttataatcatagtacttccgatggtcttaacccaagtgacagggttaagatttgcgaggccatcagcaactcctgcgattgcctcagttcctggcaccaaatttaaatgggcttttgatgtttcaaaaatttgttcttttaatttggaaatgtctaaagtgagattatcttctcttccctgtagatggcgtctaaccatgtcccagtgatgctcagactcattataaacttggggtgtaatacaaaaatctgacgtattccagtcacactgtaactggaaacgatgttctaagctcatgagcctgtctcccatccaaatgacagcttgtctaagaacattaatttgatttgccattttttgatcaataccagattgcgaattccacaatctcgtagaattcttttgccaatcattaacaaagtttactgactgaacagaagagtgcaacgcaactcctgctatagcagccatagctgtgactgcaattaatcccataatcactgtaattaaagtaaaaatgaatcttttggatctatttaaaatgccttttaatacttcagtcaaaacatggacggatggcgaggcctcccacggttggtccatggacacagggatccgcatgccttctcttgctctcaccagcagaatacggtgctgccaaataaaagttgaatcaatgcaagtaaacaatctgcaattttcacaggttatagtttgggagtctggtttaataactatatttcctacaactagcatataaggggtctttacgcaactttgtaaaggaaccgttagactggaatttaggtcgatagtataaaatggcttacaatcccttgtttctaaagtttgatttccagaccaaattctaatgtggtatgaggctaagtaagcctccataattctcaatgttcaggaccagaaacaggacttcttatttttggtcttggggtagagattcctttttctccccattcccaaggatagaaagactataattttttatgcttatgtttgtctaaactttctgttaagtcgctatcaacagctggactcacttgtgcactgggacacgactgagtttgccctgtgcaatcatggtagaattgacccaaggtgcccaatctataatagttccaaattcattgttttgtaatatcaccgcactattggccacacattcttcccaaactaaaacttctgtattttttgatcctttgggaatttccttggggcaaggtttccctttaggtctaaactttaatgatctttgataagaaaagtcttgtaaataatttacccgtggcctgagtgacatcccacttaccatgtaagaaatgattctactgatgggactgacagtaggtccttctaccaaccaattttggactgcaggcattaagcatcctggtgctctccctaggcaaataggaggataacgatacccagtggaaatatttatcatcatcacttcttcctcaggtttggcagggcagcgatcatctgtggggccaggtacgcatacactctcattaacatatacttctataggattatccatccatgtgactgcccaaattaagggcgggaaaggcacatatgcccagtaggtataattagctgcagctgctcctgcaggcatagggagacttaccaccgttgatacaatcatcaatgctgcaagcagcatactctctggagtttgtgtcatctttgtgttctctagacattttgtagctaactgcgtcagcttgtttagttgtgcccaagtcagcggctctgccttattggtggatggcaacttcatctgttcttctgacatcatcattttgttcatcttgtgactcgacggtgctcgattgcggtgtctccgtctccgcggaggtgcttttctttgcatctccgatgggttcattgtagaacttcaaatgtctagtgggtatccaaacaggaagctgattttctcctggtgaaacacaagcaaaacctcttccccacgttatcaccttccctatttcccatgtcttatttttattatctttccaccaaatcaattttccttcatgtgggctgttctttttaccagtaagatgttgttctgcagaagtagtagtctgatttctataaatgtttaaaaaatttaaagtatagagtgctagattaagttgcatctgaggagtggtacactctttactgtctcccccttctttttgtttaactaattgagttttgagtgttctattagttctttcaactatggcctgtccttgggaattatagggaattcctgttgtatgtgaaattttccaccgatttaagaatctttggaaagctttactacaatatcctggcccattgtcagttttgattttttctggaactcccattacagcaaaacaagataataaatgttttttaacatgggaagtactttctcctgtttcgcaagctgcccatatgaaatgtgaataagtatcaactgttacatgaacatatgacaatcttccaaatgaaggtacatgcgtgacatccatttgccataatgcattaggacgcagacctctgggattaactcctgcctcttgagtgggcaggtgtaagacttgacactgggtgcaatgttgtacaatatcttttgcctgtttccatgtgacatcaaatttgttttttaatcctgctgcatttacatgagtcaaagcatgaagttctcatgcttttatgaatgcagatgataccagtaagtcagcttgttcatttgctttagtcaaaggccctggtaaattagtgtgtgctcgaatatgagtaatataaaatgggaaatttctttttcttacagtttgttgtaataaattgaatagctggtttaactgatcatccatgctatatttgattagagctgtctcaacatcccttgtagcctgtactacatatgcagaatctgatacaatattgataggttgatcaaaatcttgtaacactgtaatgactgcaaccaactctgctctttgagccgattgatatggagttttgattactcattctttcggccctgtgtaagccacttttccattgctggaaccatcagtaaatactgttagaacattttctaaaagttcccatctggtaattttaggtagaatccaagtagtcagttttaaaaactggaagatttttgttttcgggtaatgattatcaataattcccacaaaattagcaagaccaatctgccatgcaccagaattgataaaggcttgtctaatttgttccttggttaaagggacaactattttgtctgggtcatttccacataattttattattcataatcttgtctgaccaattaatgtggctatttgatccaagtacaatgtaaaagtcttaactgtactgtgaggaaggaatgaccactccacaagatcagtattttgaataatgatgcctgttggagaatgtgcagtagcaaaaatcaaaagttggagtggggctaagggatctgttctatttatttgcgctgactgaattttttcttccactaatttaatttcttttgttgcctctggggttaacattctcttactatttaagtctgagtctcctcttaagatagagaacaaatttgacatggcataagtaggaatgcctagagttggccgaatccaattaatatctcccagcaatttttgaaaatcatttagtgtttttaatgtgtcttttcttatttctattttttgtggcttaatttttctattctctatctgcatccctaaataatgaaaaggagtagaggtttgagtcttatcagatgctattgccagtcctgcgttggcaacctctgcttgcagaaatgtataagtcaattaatttatctcttgtttctgcagcacacaaaatatcatcaatataatgaataacagtctgaaaacttgtctctaactggttaaagagcacgacctacaaaagtctgacaaatagttggactattaagcattccctgaggtaacactttccactgaaacctggtggctggttctttattatttatggctggtatagtaaaggcaaatttttcgcaatcctgctccgccagagggatggtaaaaaagcagtcctttagatcaattataattaaaggccagtctttgggatcatggccagagagggcaatccgggttggagaggccccatgggttgatttacggcatttacggcccttaagtcagttaacatacaccatttgctggatttcttctgaattacaaacacaggagaattccaaggcgagaatgaaggctcaatatgtccctttttgaactgttcatttgctaatgaatgtaaagcctccagtttttgttttggtagcggccactgatttacccatactggtttttctgttttccaagttaatggtatgggtttaggaggctctacagtggccgcccctaacaaggataccctaattccttctctttcttgatttattttagcctcaactggaactttaatgccatcttcattttttcctagtccctttcctggtatatatcccatcttggtcatgattttttgactcgtggggctatataatggagcgggcatggtgatttccacaccccattgttgtaataaatcttgaccccacagattaagaggagttgaagtaatcattggctgaacagtactttcttgattatctggccctaaacaatgtaaaatctcagtactttgatacacttctgaggctgtgcctacgccgacaagtcccgtaacagccttttgtttaggccaattttttggccactgatttaaagcaatgatagagacatctgccccagtgtctaccaacccttcaaactgttttccttgaataatggccttacacacaggtctgttctctgagatctgacttgcccagtatgcagcctttcctgttggaacagtgcttccaaaccctcctgttctttttatctcactatttccaaccttaatataaggcaggagtaaaaatggaaaaatcctgtctcctggagtggcactccaaggaattgaagagctaataaccaattgaattttgcctttatagtctgaatcaaccacacaagtatgaatttgaactccctttagatttatacttgatcttcccaagattagtcctacagtaccctcaggcagcaggccatataaccctgtggggattttttgtgggggctcccctggaagcagagagactgcttgtatagtacataaatctactgctgcactgccacttgtggcgggggacaattgttgtattgtggtaactggcttattccctgaggtacttgggacagtgggggttgttgtccctgaaaaccctgaggaacaaagggctgaattgggaatgccccagtttgttgtggggcctgaggctggcccctttgctcgtttcctgacaatggttgcccatttctatcaaatttagaatgacattaactagcccaatgttttccttttttacatcttggacataagtctggtggctctctacctgttgttgtagtcgcttgaatagttatattctgtttatttgagactgggcaattcttttttaaatgaccaatttgaccacaattataacatttccctccaaatgttctaacttgtccttctaaaacaactcccactattgcttgagccataagcttagctttatgcatagctcctccaattccatcacaggcttttacatactctgagattacatctgatcctgtggaaacctttccttttaatggcttaatggctgattgacactcaggattggcgttttcgtatgccatcaactccactatgaccttacgggctttttcatcagcaattgacttttgagcaacatcttggaaccttgccacaaaatcagggtagggctctttcaaaccttgtcttactgtatgaaatgaggggcaggcggttcctgggtcttggattttttcccaggctctaaggcagatagctctaacttgctcaatggcctcattttgcattaatgcttgttgactaatagtgctccaattttgacctgttcctaacagttgatctgcatctttgttaactggaggattggcagccctatttcttcagacctgttcttgtgccccatcaatccaccaagtcttaaattgtaaaaattgagagggtgagagagacgattttgccagaatctcccaatcataaggaatgagtctatgatgtccatgagcaatggaatctaataatgtcctcatataaggggagttgggtccatagtgttttactccctctttcatatcttttagcatttttatcgaaaaagacttgtatctggcctcaactgtgagaggctctccctcttgggctccttctccaggtggtatcggttctaacgttactgggaattgccacgcctcagtgtctccttcctttcttgacttatcaataatttcatgtaattcactaccctgtctactaggtggtgccgtatgattaagtctgctagtgggtggctgagggtatggcgccctgccctgtggtgctgggagcgttcctggatatccatactgactttctgggggtggccgatactgaagtttggccggtggccagtattgataagctactggtagttgggtcttattttctctaacctgcgtttgaggttgtaatgttacgggcatctgacctactggaagaggacttggtcctcgtggtttagactttgatggccccactaattctggaccttttccttctaattttaatgtttcaggatatatcaccccctgtaattgattgattatagtcaacattttgcgttgactgagccattactggctctgctacatattcgcaatgtaaactttccgtttctttctgggattttttccctgtcttgtctttacaatctattacacagcttccaggggcatcagaaactgaaacactatcttcttctctttgaaatcgttctaaagctgctttaataatggcccaatcattccatactgtaagtggaatgatattacccttcctacctgctttagttccttgccaattcttttccagtcttcttttagatctaaagttccttgttctggaaaccatgggcaaaattgttctattgtttgaaatagcttgattagattttttgtagatactctaactcccactctttttaaaagaattttaataaagctgagataaaaggcatatttatttttagttttcctttaatttgccccattgtcaccctagcttcgtccgagcgcactgtaaggctgactgtagacgtactcgggatctctcgtcgacttgtcctcaatgaccatgctcgagcgtaccttcaccctagagaaaagcccccacattgggcaccagatgaaggggtgggttgcccctccacacctgtgggtgtttcttgttaggtagaacaagagacttggaaaagaaaaagacacagagacaaagtatagagaaaggaataagggggcccagaggaccagcattcagcatacggaggatcccgccagcctctgagttcccttagtatttattgatcatttttgggtgtttctcagagagggggatgtggcagggtcataggataatagtggagagaaggtcagcagataaacaggtgaacaaaggtctctgcatcatagacaaggtaaagaattaagtgctgtgctttagatatgcatacacataaacatctcaatgccttacagagcagtattgttgcccacatgtcccacctccagccctaaggcggttttcccctatctcagtagatggaacatacaattgggttttataccgagacattccattgcccagggacaggcaggagacagatgccttcctcttgtctcaactgcaaagaggcatgccttcctcttatactaatcctcctcagcacagaccctttacgggtgtcgagctgcgggacggtcaggtctttcccttcccacgaggccatatttcagactatcacatggggagaaaccttggacaatacctggctttcctaggcagaggtccctgtggccttctgcagtgtttgtatccctgggtagttgagattagggcgtggtgatgactcttaaggagcatgctgccttcaagcatctgtttaacaaagcacatcctgcacagcccttaatccatttaaccctgagttgacacagcatgtgtttcagagagcctggggttgggggtaaggttatagattaacagcatctcaaggcagaagaatttttcttaatacagaacaaaatggagtctcctatgtctgcttctttctatacagacacagtaacaatctgatctctctttcttttccccacagaatgatactgaaagcatctcaaaaataaaatcacgagtatctgcaggtaatgcatcagcatttttattaagccctcttatttgaaagtcactgctttgaactggattggatgacccagtggcttgtgtgggagttgggctggagaaggttgatagtaggcaagctggttttctcctgctgtgattttgttacctctgtggagtgcttttgatttttcttatcaactgcagtgactcagatgggttgacaatctctccaaacaaaatgtgtactttttctacccgtgagtttggcctggtcccagaaattcactctagacatgtagaactatatgataagagagttggaaaagagctcatctatctagtccaaaactgtaatgaattcgtgggtcatgaaatctatttaatgggtcgtggccaacatttagaaaatatagattagaccagaaaaatatcagagttttgcaatctttcatttcagctacatgtgtgtatcacagtgtgaaatgtttcttgctaccaaacatttttgcaaaatactaatagttctattcccatatctgacaaatgaaagtaaggagcccagaaaagtactgttaagtattctatttagagacacccaggacataaattcaaatgtccagacttctggtttagttctttttccattttggagatctggaatgatacaatagaaggaatagtgaaggacataagttcaagtctggtgcttaaaaactgtataaagtgcaagttgcttactccatacccttcattattctcatttctaaaataaggtaaatgaaactgtccatttccttactagattattggaagaactaccaaatacagataaagcaaaaaaatgtccaatgaaaaaatctgcaaacctgctgtgtgtgtgtgtgtgtgtggtcttaatattactcttctatattctttcccgtagacaaaattttttatttttttgattcttaatttctccttttcttctacgctttaatgtgtttctttatctttgagcatcatctggcaataaacattttttggtatttgccagaatgccataatttccaaagcattttctcacttgaaaatatttaaaaatgcacaacaggttgaggaaaatccaatataccataaatatatccaatataccataaatatatgtgtatttgggatattggatacataccaaatatacatatatttatatttgatatattggattttaaatatagtaaatatatgttatataaatataacatatacctatataacatatctgttaggtaaatatacctataggtatataggtaaatatacctataggtatataggtaaatatacctataggtatataggtaaatatacctataggtatataggtaaatatacctataggtatataggtaaatatacctataggtatataggtaaatatacctataggtatataggtaaatatacctataggtatataggtaaatatacctataggtatataggtaaatatacctataggtatataggtaaatatacctataggtatataggtaaatatacctataggtatataggtaaatatacctataggtatataggtaaatatacctataggtatataggtaaatatacctataggtatataggtaaatatacctataggtatataggtaaatatacctataggtatataggtaaatatacctataggtatataggtaaatatacctataggtatataggtaaatatacctataggtatataggtaaatatacctataggtatataggtaaatatacctataggtatataggtaaatatacctataggtatataggtaaatatacctataggtatataggtaaatatacctataggtatataggtaaatatacctataggtatataggtaaatatacctataggtatataggtaaataaatatacctataggtatatttaggtatataggtatataggtatatatacctataggtatataggtatatatacctataggtatataggtatatttacctaacagatgtgtcatataggtatatgttatataggtatatattatatttatataacgcatgttatatttatataatatatgttatatacgtatatttacatatacatgttatataggtatatttatacaacataatataatacatatatttatataaatatacatgttatatatgtatatttacatacacatatatgttatataggtatatttacatatacatatatattatacagctacatttaatatataaatatacctatataacatatatgtaatgtaggtatatttatacatatatgttatataggtatataacatgttatataggtagatttacataacatgttatatagttatatttatatatacatataattttatatggatatatttatacataggttatatgggtatatttacatatatgtatatataacataggttatatggtatatgtaaatatatgggtatatttacatgtacaaatatgtacatgttatatatagatatgtattatatatacacgttatatatgtatatataacgtgtatatatgtcaatgtatatatgtatacgtatagatgtatacatatatgtatacattatctgggtagatttacaaaacatatatactatataggtatatttacatatatgtaaataatacccatatacccataacatgttatacgtatatatactatacatatatatttatatacatgtacatatgtatgtatacatacatatgtatatatgcatatgtaaatatacatatatttacgctatacatatatacatctatacaggcatatacatgtatatatgtggatatacatatgtatatacatatatgtacatatagatgtatgtatatgcatatatatacatgtatgtatatgtacatatataatataggtatatgcatgtatatatgtctacatatatgtatgtatacatacatatatgtatacatatgcatgtatgtatatgcatatgtatacatgcatacacatgtacacatatgtatacatacatgcatatacctatattatatatgtacatatacatacatgtatatatgcatatgtatatacatatgtatacatatatatgcatatgtatatacatatgtatagacatatatgtatatgcatacatttatgcatgtacatgtatacacatatatgcatatatatgtatatacatatatatgcatttatggatgtatatatgtatagatatgtctatgcatgtaaatatatgtatatatgtatgcgtatatatgtatgcatatatatgtatgcatatatacacatgtatattatatacatgtatataatatacatatgtatgcatatgtacatatagcatatatacatatatgtataacacatgttatgggcatatttacagacatgggtatatataacatatgttatgggtatatggatatttacatatacatatatgtatatgtaaatatccatatatgcatatttaacatgtatgtatatgtaaatatacctatatagcatatgttatgtaaatccacccagataacatgttaatatacccatataacatgttttgtaagtatacccatataacatatatgtatatttatataaatatgtaaatatgtgtatatatattaaatatgttatattaaatatgttatataaatatacctacataacatatacgtatatgtaaatatacctatataacatacaggtatatttatatagatatataaatatacgtacattggtataaatatatataaatatataaatatacgtacattgatataaatatataaatgtataagtatacgtacatttatataaacataaatgtagaaatatataaatgtacatatatttatataaaaatgtatacatatataaatgtgtacatatatttatatatataaatgtatatataaatatatcaatatatgtataaatatatgtatatttatataaatatacatataaatatatatatttttatataaatatatgtatataaatatatttatataaatatggagatggaatttttttatctagttctacaatttcttagtttgttttctaagtaattaatattgatcaaattgcttttggcaagattatttctaatcaaatacatcattatagtcaacttgtcatatagcaatgtcatgtactctaaaatcagtgattttcaaagtctacacctgctcatttggtaaatcaccacacctcctgattccagttatcttcttcttcagatcactatgagactggactggaacattaccttcaggtgtgttgcttcgcctttggagaatgccatctgccagatatgggatcaacctcttaagtctaacatagcaaagaatatcccccataccattttactgaagaaaaacaacaaacagcagttccttccgccacactgggtcttagcacatgcagagctgtggagtcctgtctgtgcacagagacaggcattgacaggtggagtcagcttctccaccactgacatctttccaagtcagtgctgtgctatgtctgcaaatgagaaaggggcagcctggatgatgctataattggcagtaccaactccatggaaatattcagaggcttcagctgtcattttaaaactgtccttcaggtggtgccatgtcaaagggaagggacctgcacgactgcccaaggttccagataccttaagagttaagcagggattggatgctggggttcccgtgttcatttgcccctttattcaactagtgcttactaagtgcttaatgcatcccaaattatggaaggacctgggaacatatgtaagacactattcatgctttcaagttgcttgtagtttagtcaaggagccagcttagcatctaaaaccatgcaaccccaatttctaaccaccagtcaactctccagtaagccttcttcatggtaatggcctttgggatggtggggccataacgtagggttacttggggaaagccagcaccttgcacacatctatcctgccctgtccctgaaatcccccagatccatccacacatcacaaatctgctgctccataaagaagagcctgacatgggcttgtggaggaagcaattgatcagaaagatgctcttgatctaattttatctgtttttctgccattgcctctttccaaattcttgcccatgtggttttctcttggtaatccatgtggccctggtccggggcctccatatctcttgtgacttaagtttagctcactctcccaattttcagagtttcctgtctttttcagcttgtgttgagataacagcaacttgagtatctccagacgttaatacttcccaatgggtacctgtctttgggctttatctctactgtctctactctacataattttaattgggtctaatttagaaatattttcctctatatttttactttttattttttatggcctcttgctttttaaaatttatggttatggcctgtttaagaacttctctactttttacatattttctcacattttcacctcttttacaattttgcctctatttcaactggtatttattttggcgaatgataggaatcagggtggtagagtgcctataactttttttcttctgcacagattggcaattaactcaggatcatttctggaatgagctatcctttcttcaatgatctaaaatgccgtctttttcattttcttatttcttttatacatacgggtcttccagttccgtttcatagattacggccctgtggctacggcaaagcatagtaactttatcatacattttcacatctgttaaggctattttcccctctttgtgttttagttagcacatttattttagttagtcaagttttcccccagaagtatgttgggattttgaataggattgcactgaatttatagattggttgtaggcagggttaatacctttgtaatattgggtttttctttctgtaaatgatttagatattttaatatgactacatcacccccagccatattaattccttttacggccttatgtccttcctagctctagtcagtcctttacattgtgttatgaatttgttcacttgtttattgtctgtgtctccacctagagtgaacacaaaatttccagattctagatcaatgtgtagaacatagtaggtgctcgggaattatcgttttattgattgaatgaaataaccttgacttcctaaggcctatagccctcagtttgagaaattcctttttttttttttttaactttcttatttgctgtttggttcttattccattgactgctcaccccactgcctcattacccttagcaagctgagaaaactgggttatcaattcacatgtgtgcttgcagccttgtttcacttggctataacccctgttggcattcgtcatccatcatttccctcctgccttgggtgtcccaaagccgcacctgctggtttcctccacctcgccgcggtgtcttttcagcctccctgaaggctgttctgcttctatcccgacctcaagcgatgcatcctggggagaggttcctccttggctctgtccttggtatctctccctcagaattgcatcatttcaatttccaccagatactgatgactcacattttcttttttgggctaaatctcatgtttgtttgtttgttttttccagacacattgatatgactacatgctggacattttcttgcggaaatccaaaagaaatccccattttcttgcagaaatctaaaataatctcccctatgtgcaagtcagactgagcaccactcccaagaccatgacctcccctgcagccctgctccttcccactcacctctcctcttgagaaagccacctcccaccacccagtctgcagtgccagaaaactggaaaccagcccctaagctgctttcaccttcggcccatttctcactagccagcctctcccacggcctccccagtttcttcaaatacaccccctccactattcaccatactgccaccgtgatttatttacaactttttgtccggattacctcagtagccttctaattgtcccctttgcatctaaagtagcccctctcatcccccaaatcttacgtcactcttctacataattctggctttccatgacccataaaccacatttctcaagtgtgctctatgctggcttgaatatgttaataatcttaattctacttttagtgcaattttcttagagctggcatcactttcatcatgacgtgagaacttactagagataggcaatgatgactcacagtcaagccacatgtcatatgctgcagacatctggactgctgcttatttgcaaatccttttcttcatatttttctcatttgtagcactggatcaattccaattaagagtttaataatgaattaactaatgatttaaacaggtggataagactaacactgaaccaatgattttaagtaaatctaaatacataaatccccccaaattattaatctatgttgtttactaagaagtgtattaaaatgatattgaaaaagtttgctttgggaaagagctagaagttagaaggtctaggttcaaatcccgcctctactccatccttgactaagatgttggacccatcacctcaactttccttgggtctttttgcccagacatgacccgatgacacagagcttacctggacctccacaatagtaaatagaacagggccagcaaaccaaaatttgttgagtcctttagaattaagtagcttagataaattttcatcaaaatctttatatagtagggaatagaaaaaagtcaattctgttttatttgaggatgtatgaatatgttaccatttttcagactctgatttaccttccaattattgtttattggggtcattgtaaattagttatcattttttgaatacacattcactgctgacaaagtggtgaagccagaagttatgtttgaccagggaagattatgaccctcaaaggagaaaaattcacagggggtagttgattattggtggaatggagtgagagtgaattccttaaaagtttaaacgaaagcagaactatattcatatcatggagggaacttagtttctaatatgatgaactattgccccaagtcatgacaataccttgctctctggaagagaatgagtgagtttttcatccgccaagatacacactctatatttccaaccatcacatctgccttgcaggctgactgaacccagagcaaatcaatcacaaaagttaatccaaaagacttcccttcagctgctggaaatcagtcatcacatctgtgaaaagagtgctagttataacaaatgagatcacaaatttgaccattttattagacaccctctattagtgttaacagacaaagatgaaggttaagttgaaatcaaattgaaatcttcttccctctgtacagattgcaatatctgataataccctcaactttcttggtgcaaattaattgcctggtactcacagtccagtgttaacaggcaataatggtgtgattccagaggagagtactaggtggcaggaaaataaatgagattagcagtatttgacttggagccataggcatcaattctgctccagctgtcgaccaggttctaaaaacaagactcggagcagcttttgctcttgctagtgatgcagggccaggagagcccccacactctgcatttgcaggtgtccatgaggggaagccactcctgcatttatcctgtgagtggagaagctcagaggaatgaggacattccaacagggtatcagaattctcttttgtttatgctaattgacagcaggaacatcaccatcttggacaaacaccaccattttaagttctcttttatttaaaaactgcctaaatccagccccaaaacatcagcctaatggctattgtcagcataatcagaaacattccaaccctaagataaacacccctctggccagaaatatgccgaccccgagacagcctcccctccgaccagagacattccaaacccgcagtaaactttccttcacatggaaacattccaaacctacaaaaagcttccctcttcctaaacccttaaatatccttagtctgcaagagagaatgctcctgactgaaatcagccagaagcccctctcaggtttattctccaaaataaacctgtctttgactgttgagcca

SEQ ID NO: 405 - DNA, 174634 bp, Homo sapiens
gtctttgcctgctgccatccacgtgatatgtgacttgctgctccttgccttctgccataattgtgaggcctcctcagccacacggaaatgtgagtccattaaaacctctttatcttctcagtcttgggtatgtctttattagcagtgataaaacggactaatacaataaattggtattggtagagtggggcactgttgtagatacccgaaaatgtggaagcaactttggaactgggtagcaggcaggggttggaacagtttggaggcctcagaagaagacaggaaaatgtgggaaattttggaacttcctagagacttgtttggctttgactaaaatgctggtaatgatatggacaatgaaatccaggctgaggtggtctcagatggagataaggaacttgttgggaactagagtaaaggtgatgcttgctatgttttagagactggtagcattttgcccctgccctagagatttgtggaactttgaacttgagggagataatttagggtatttggcagcagaaattcctgagcagcaaagcattcaagaggtgacttgggtgctgtttagagcatttagttttaaaagggaaacagtataaaagtttggaaaacttgcagcctgacgatgtggtagaaaagaaaaatcccattttccgaggagaaattcaagctggctgcagaaatttgcataagtaatgaggggccaaatgttaatcaacaagacaatggggaaaatgtctctagggcatgccagagacctttaaggcagccccctcccatcacaggtccagaggcctaggaggaaacatgggtttgtaggctgggctcagggcccccctgctgtgtgcagcctagggacttggtgccctgtgtcccagctgctccagccatggctaaaaggggccaaggtacagcttgggctgtggcttcagggggtgcaagccccaagccatggcagcttcactgtggtgttgagcctgccagtgcacagaagtgaagaattgaggtttgggaacctctgccttgatttcagaggacgtatggaaatgcctggatgttctggaagaagtttgctacaggggcagtatcctcatggaaaacctctattagggcagtatggaagggaaatgtggggtaggagccccaacacaggtccccaccggggtgctgcctagtggagttgtgagaagagggccaccatccatcctccagaccccagaatggtagatccaccaacagcttgccctgtctgcctggaaaagctgcagacaatgaacaccaatttgtaaaagcagccaggagggaggctgaactctgcaaagccacaggggcagagctgcccaaagccatgggaatccacctcttgcatcagtgtgacctggatgtgaaacagggagtcaaaggagatcattttggagctttaagatttgactgccctgctggattttggacttgcatggagcctgtaacccctttgttttggccaatgtttcccatttggaatggctgtatttacccaatgtctgtacccccattgtatctaggaagtaactaacttgcttttgattttacaggcttataggcataagagacttgccttgtctcagatgaaactttggactgtggacttttgagttaatgctgatattaggtaagagtgtggggagtgttgggaaggcatgcttggttttgaaatatgaggacatgagatttgtgaggggccaggggtggaatgatatggtttggctgtgtccccacccaaatctcatcttgaattgtagttcccacaatttctatgtgttgtggaggagacccagtgggaggtaatcaaatcatggggataggtctttcccatgctgttctcatgacagtgaataagcctcacgagatctgatggttttgtaaagaggagttccactgcacaagttctctctctttgcctgccaccatccacataagatgtgacttgctcctccttgccttccgccatgattgtgaggcctccccaaccacatggaactgtgagtctattaaaagctctttatcttcccagtcttaggaaagtctttatcagcagtgtgaaaacggactaatacaatcagccagtaaaattttgataggtgctgaaaaattaggagccaattttttgttgttgttgtttgtttcagacagggagttttgctcttgtcacccaggctggaatgcaatggcaccatctcagctcactgcaacttctacctcccaggttcaagtgattcccctgcctcagcctcctgagtagctgggattacaggtgcctaccaccacacctggctaagttttgtatttttagtagaaacagggtttcaccatgttggccaggctggtctcagactcctgacctcgcgtaatctgcccgccgtggtctcccaaattgctgggaggatcccatgtttttaatccccatattctggatgagaatactgtggttttgtggactcaactgacttgctctggctcccatggttaataagaggaagagcgagttggcaacgctttctcactctagggcagtactctcaaccccgcactgtctcctcttggttctttctgctatagatttatctttgatgaaacacaaaatgatcagtgagtttaataatcagatatttcagtctttggagacagccatttattttttttcaaggctttgagccggatgtttatggaaacagccctgcactttgtgggtatttaatgacctgtgatggcaaagacatctaaattatttgtgcacacatctgaccaatcagattcagggttgattggtttgggtttggttcaatagaagctatttctactgagttgggaaaggaaaggaaggcctggggacttcttggttctctggtatagtgtgattacctgtaagttgtactaaattggactgttcagatttggtggtctgttctaattttgtagactttgaatgaatcctcctcagctcttcctattctcttcttcaccagtgaggaacaataaccagtgcagacctgaataatcacatgaaacccagcaaattttgccatcacatacctgatattttgaatggaaatacgtaacagtttatttaaaaagtcatataacgattctaattgacagacagcactatccaagtctccttgaacagtgcttgcctgatatttttgggaatataaatccctgggtctcttataaaaaggtaggtttaaatttaactggtcagggatggggctgagaggctgcatttccaccccaggtgatgctgatgctgttggctcccagacaccactttgggtaacaagctcctacatcagaggtcaacgaactacggtcagtgagccaaaacctgctttctgccaattttatacatgaaaagttttattggaacaatagccatgtctatttgcttatgtattgcctgtgactgctttccactgcaatggcagagccaaatagttgtaacaaataccttatggcatgcaaagcctaaaatatgtactatctagtcctttacagaaaatgtttgctgcagctgccctagatgactcctttgattttgaatacttgctactcaagatagactttcaacattcatccaacattgaaaaaacatttatctggctggatgcagtggctcactcctgtaatcccagcacttgaggaggccaaggtgggtagctcatttgaagtcaggagttagagaccagcctgaccaacatggtgaaacctcatctctactaaaaatacaaacaaaaaattagcctggtatggtggcacatacctgtaatctcagctactcctggaggctgaggcaggagaattgctttaacccaggaggcagaggttgcagtgagccaagattgtgccactgcactccagactgggtgacagagtgagactgtcacaaaaaataagaaagaaaaacatttatctaacacttactttgcactgcacattgtactaagagaatacagttgtgaacaagatataatttctactctcatggagcttatatttgtttgctccctcagtatctgggcaactgcattttgtaagtctccgtttactcatccataaaatggggcttaaaaatacctaactcttagtgtatgttaaaagaaaaacttaagacaaatttaacagagtttaattcagcaaagaatgattcttgaatcagaataggttcaaagcaactctggagcagctgagcatggttagagaagatttgtggacagaaaacagaagtgaggtacagaaacagccatatgggttacagctcagtggtttgccttatttgaacttgctttgaatagttggctgcctatgagtgcttgaagtacggccactgtgattggctgagactggactacttgttccaagactgggttgctgtctgtttacacatccagttaggttgcagttcactatatacagagaaacctttgggctgttcttaaatgtaaggaggcagctttgggctaaatttagcagattcttgtgagcagagtgctaggcacccagaaaatattcaagaaaagttagatgttagtacattattcttgttattttcttactctaaagatttctggacaacgaacaattttttttttgacacttgttagctttctacgtgttgtgtatgtgtatatttcctccctggctattcagaaagaactagagctgaaagtgacttttccttcaacgttaaagctttaataatttaatcaaagcttctgacattgaaacgtctctttgattctgaaaccaaagcggaacagtgttcttggttcccaaaatgagtctttctgtgtttctctagttgtttaatctgcagtcagggaggtgctaatggtgatctggcccctggtggggaagggtgtagaggatgggaggggtggctattctttcagcaagaggacagcctttgataggattaacgaacaactctctatggtaaccacagacagccattatgctaaacaactgaggtaaaattttaattgattatttactcaatttcaaagaaagacaaagaaatagaacattctgtttggatcactgaaacttgcatgtatttttatgtcattttgtgtctatatcgatctttaatagtttatacagtcgtcatagtccggaatgacatatgccttaattttgatccctaagaagcagatctggaagcaaaggttcaggtgtacctagtttgtttgagaggtgaagtaactagcagggcagtggaaaaaacaactgaggtaaaattttaattcattatttactcaaagacagaaatagaacattctgtttggatcacagaagcttgcatgtatttttgtcattttgtgtctatattgatctttaatagtttatacagtcttcacagtcaggaatgacatatgcgttaattttgatcactaagaagcagatcttgaagcaaaggttcaagtgtacatagtttgagaggtgcagtaacgagcagggcagtggaaaaaacaagatagggaaggtaaggtagtgaaattcacgtgtattatccttagataggtaacatctagttacccctagagtattcttggttgttcctgccgtgggactggggaatggtgtggacaacaaacctcagaattatcccgctgagggtgtgggagtttttatataccaactcctatccctcattggatggttaaagattcatggtagggtgtgtgttggtttgctggcgtttctgactgaagggaagcagctattatccattagaggaagccagaggacactgaattggtaaggcaagaggtatacatacacagggccctgagaatgtctggattgtttagctgtttctacttccagtgcctgacatttgtacaacaaggtgcttattaagtgttgtcatattctggatgaatctaaacatgcaaatcaattacagggagggagggctgcatgtgtgacagggttgcagtttaagtaaatttaatcatcagtggagaaatgaatgacagaatgtttcattatatagagattttgaagagaaagaataaattactctgatgctctaggtagaagaggaagaagctgacaccctaatgaaacaaataaattgaagttctaattcctcacagttccccaagtcaactatgtattttttcctaagtaaaatgtcatacttgatgttatatttgacattagagatgacagccaacagataatataggaggacgtggtgcaaaagtgatcagggcttgtgtatcaaagacaggaattttgaatatctgtgtgtcaagtgttgagttctctgggaagtatttgctgagatagagtttatcattcgaggattatctaaggagtgcccttgggatcaacacttgtggaaggaaggaaaatgtagcaggattgaacagatagagaaactgagctgcaatataggcctgacaacagttctggccaactctacaaggagctcagaaactagaaaggcagtacttagctgccccaagtggggctaaggggctaagatggccaggcatttttattttattttatcttatttttatttttttagacatggcttcattctgtcacccaggctagagtgcagtggtgtgatcatggctcactgcagcttcgacctgctgggctcgggtggtgaccctcccatctcagcttcctgagtagctgggaccatagacatgcaccaccatgcccagctagttttttgtatttttgcagagacagtgtttcaccatgttgcccaggctagtctcaaacttctgcagtcaagccattcacccgcctcagccttccgcagtgctggggctacaggcttgagccactgtgcctctggtttaagacggccaggtatttagtacacctggccattggatataggtttccccaggaaggtcaggtgatattcctatagctgaggctatcttgaaggagctaacagctgaaggccaccttctgacagcactcctagcagctgaggctggtgtgccctagcagctcaggcaatgagtccttcactgaagagggatcctggcagtgcattagtgttcacgatactgtatcttctcagctttcccactctcgcaatactttgcctctaccataggcttctaagattctctgccctggaccaccaggcatgcatgatttaaatttggaagtgattctcatacttcagtcatttagtttcatgacttttcacttttcatttcttttggaatctgctctactctcaccaatatttggtgctgtaggattctattatggatctgttggaggcttgatttattatgcatcacagtagatcacctgtgatgaacatggggcagatagaaacctaaaatctgctactcttgccatccaaatcctgatattcagatttctacagtcttagttacatcctcttggaccatgatgagttggctgagtgggtggtctgtgtttagaaaccacatcttctgtaatacagatcataaaatctcaccaccgttttcattttcctggagattgaactagcttgaaggctgtgtgaatgagtagcttgaattctatgaaatcgagtatacagcatacaggaatggctatcatgtatatgtgtgtgtgtgtgtgtgtgtgtgtgtgtgtgttgggggtaggacacttagcctaggagaagaagtacaagggtcccaagaagagctggagctaaaacttgagcagtaccaagtggaacagaggctgagatacatcaacatggaccaaacttgaagaagggaaatgtttacagagtcttgctccaccacatggaaccacggagagttttatattcaataaggctttatctagcccaaggtcacaaagatttactcttatatcttctctaaaagtcttacggttttagctcctatatttaagtctatgaccactctgagttaagtattgtgtatggcatgagaagctgatccaacttcactcttttgtgtgtgtatgtccagttctcccagcaccatttgttgaaaagataactcttctctgtcaatgaactgtatcagcatttttgtcaaaaattaatgaactgtaaatgtaaggatttatttctagactttcaattctattccatctatatgtttctcctatgtcagtactatactattttattactgtggccttgtactaaattttgaaattgagaatcacgagtcttcaactttgttcttcttttttaagaatgtcttttctattagggttccttaaatttttatgaattttaaagtcagcttgttaattccacagaaaaagacagctgagatttttatagggattatgtggaattatagatcattttggagaatattgccatcttaaccatgttgtttcctgattcatgaccatgaatttatgttgttttctttaatttctttcaacaatgttttatagtttcagagcatatgtttttccctgcttgttaaatttattgctaagtattttattcatttggatgctattttaaaataagttgattttttaatttcatttttgattgttcattgctagttctcttagtttagtataacaaactaagaccaggtggtttaaataagtcacttatttctcacagttctggaggctgggaagtcagatcagggtgccaacatggtagggttctagtgaggacccattttctggcttgcagacagctgccttcttgctgtagcctcacatgacagagaaagaaagtgagcacatgctctctggtctctttttataagggcactaatcctatcatgaggatcccaccctcatggcctcatctaaaaataactacctctcaaaattctcacctccaaacacattggaggttagtgtgttcacatatgaattttgagaggacacaaacacttagtccataacactagtgtataggaatacaattggtttttgtatattcatcttgtacactgcaaccttgatgagttgttcttttttgtctaatcattttttagtggaatacttaggattgtctatacacaaaatcatgctaatctggaaatagaaatagttttacttactcctttacaacctggacgtctttttatttcatccttttgcctaattagcctggctagaacctccaatacaatgttgaatagaagtagtgaaaatggatttctttgtcttgttcctgatcttgagggacacattcaacttccatcattaagtacaatgttagccgtgagtttttcatagatatactttgtcgggttgaggaagtgtcctttcattcctagattgttgcgtatttttattatgaaaggggattggagtcatgctttttgtgtatttatggagataattatgttttttgtttttttactgtattgctatattacattgatttttgaatgctaactcagtttttgcacatttgggataaatcccacttgatcatggtcaatcattatttaaagcaattttggctagattcagttagctaattgtttgttaaggatttttgtctctataggcataagaatgttggcctataattttcttttcctttgggtattattctcagtacctgcgtgactgcatcaatcataccccaaacttcagcatcacataacataccccaggtaacaaacctgaacctggacccctggaatctaaagtaaagattgaaattatttttacaaaagaattttcttttcttgtgtagtctctgtctggatttagtatcagggtagaatttgcctcatagaatgagttgcacactgctccattctttttattctttggaattttatggagaattgttattaattcttctttaactatttaggaacattcaccagtgaagccatcttggcttgggcttcttttcatgtgaaggtttaaaattagtaactcaatctctttgttataggtctatttaaaattttcatttctttttgagtgagtcagttccaccagtttgtgactttccaggaatttgtccatttcatctgtcatgcaatttattggaggaaaattttttatagctcttctttgcaatccttcttatttctgtaagatgcatagagatactcctctttcattcctgactttcataatttgtcttctctgtttctctttttttttttggtcagttcccaggatttaggttagaaaaagtatgatctttggcactaagctgatctaggtcaaagttatatctcttctactgtgtaattgccttctcaaaccttagtttttaatttggaaaatgaagataattcaattggcccattacttaaaaaaattctgaagacattttattctgatcattttttcattccttcttttaaaaaagcacacataattgttataaagtcatctttaaaccatacatttatttaaaagttaaaattaccttttactgcaactcagtatcaaatatcatttgtgagtatgattaaattcttagaagatagctatgttaaacacctgagtatggaacgttattttcttctatagagataaggtttgtgttacagagtcggaaattggaagccagagttttagttctaggccttcattcaagatgctcgctgaaaataggggtcgataagtaattatgttcagaaattgctatgccctatactgttggccctccatatccctgggttctgcattggcagggtcaaccaaccacatattgaaaatattcaaaaattaaaaaatactaaataatataaataaatgctgtatagttatactgataactactcacatagcatttacattgtgttaggtattataagtaatctagagatgatttaaagtatatgggaggatgtgcatatgttatatgcaaatactgccccattttatatacaggacctgagcttctgtggattttggtatccttaggtgggggagagggtcctgaaacccatgcatcagggacgactgtattccattttttggaaacggatagcatacattagcatagtaagagctctcaggttaaggaagctaaaaaatacaattcccatattcctttgccactatgatatccttttcccccaacatattcatttttcagacaaatatgtgtagagcacctgcaatgtgccaggaactgttcatggctgtggaatgcagcagtgaaagaaacaaaatctcttcccttgaatagctcacattccacctttttgtgaagtttaaatatcatataataaagttatcggcatgtagtaaatgccccatgaatggcaactactcagtttctttgtttctcctgtgctgtttgatgccaatgcaggcactcctgagaaaggcttggatggcctgtgatacttcttgcagccttgtctttctcgcatctcatcataataaattctgctcaaatatgaacattgcagcagcaatatccctttatgtctaacttctaattatctataaacacatgcctttatgaaatggaggtcatcgtttgatatatgatatcagacgtttagctagtcaaagccttacttgactaccagcttactgcatttgaaactcaggtagcccagagctgtggtggaatcacttacagacatgttaatttgcatgtttttttccccaagtatttttcttttcctttccctcactcaagcaggcagcaaggattgctctcttgcctcagggcagattagcagcaaactagaaagcagaggggacagttcccttttgggttttggatttagtagacgatgttggacttccggcagagacaggagagaaggggatggggggacaaaagaacaagagtagaaagcaggaaaaaaaaatattttgaaggataaagggacttttggagcttgaagagagacaggggtgtgtgtgtgtgccctaagcagcagagattccctctgtcctccacggaagagccctggagagatgtccagacctccaaggggaaggaatgtgtggattccctggagacagtagaggttccagcatttcaagggtcgcaggtcctaagcatggccctgaagcagcattgccaccagaaatgggggtctatgtagactggaggcactgtgggctcttggtggtaaccagggcaagattaaagtcaatgaccagagaggcttctctgaggatgtaatgctcacagcctccagcgtgttggttatctcaaagaatcccaaataaccaatgctactaccagtcagccagaaggtgtggactctgagatggaaccaatttggctttaaagaagataaagaaatataggtttttattttatttattttttgtacatctaagttcatgaactgagagtcatatttgctgccttagccacaggacaggaactagttaaaactctggatatctggctctgtccacttagcctacattcttcttgtgagagtccacagcttagaagtgtgggaaattttctgcctatttgattctgtgttccagcactttactgaatcacttggctttgataaatgcagattgatccaaaatgagagagggacagagaaactcagcacagaccatgattcacatattaccctaaacaaagccgtggctaagtgattttcctggaactcataggagagtggcaaggcaatgagggtcactgtaacccatggccaggggacagtcagaactcaagagcatttcaaatctaccctgtgatttataaatctatctcccccacaggctggggctttttgagaccaggcactatcttttattgggtccctccctgccttgttgcttgtacagtgactgacatagagcaggcacttaacacagtctccaacttacaatagtgcgactgaacaattttgcgtttatgatgatgtaaaagctatatgaattcagtagaaactgtacttcgagtatccatacaaccattctgtttttttactttcaatacagtatttaataaattacatgagctattcagcatcttattataaaataggttttgtgctagatgattttgcccaactgtaggctaattgtaagtgttctgagtgtgtctaaggtgggctaggctaacctgtcatgtttggtaggttaggtgtattaaatgcgtttttgacttatggtgtttccaatttacaatggatttattgggatgtagccccatcataagttgagaaccatctgtatatgttaattagttaattaataaaacaactctttattgaaagtctatgtttctgaaattgtccctggtactaaaaaaaatattttttcatttgatcctctaaacaaccctgtgagatgagatgttcaaggtctcaaggttaataagtggcaagattccagtccttggtctgacttgaaacccactatttctttactctaactgagtctctttggtaaaatggtggtggttgtcataagttagtcattttggttttaattagcagtattagggaatcaataaagaagcaattccattttctccttactcatcctttcagttattcatccattcagtgaaaaaagatatattgagttatatatgccatgcatttattcctctaaattactttgcaaatcagtaggaaatttatagaactcaataaagtaagagaaagactatttaggtttctaaaatgtctgtctcatgggctgcttacaagggtgcttgggctggtgaaaaggcttttggttttgttttttgttttgttttgtttttgagacagtgtcttgctctgttgtccaggctccgtcatagctcgatgcagtctcatcctcctgggctcaaatgatcctcccgcctcagcctccccaagtgctagggttacagacatgagccactgcaccacgcctttgaaaagattttaagaattggaattatgagacctgcgtttaaatattggattaatcacatcctagtttaatagctagttttgcttcaggcaagttacttatcctctctgagcctcagttttctcatcggtccaatgggaatagtatctacctgtgagaaacctgtgaggtaatgtatgatattggaaacaaaacttaaacatatgtaccctttactatgatcattgtggttgtgtataagaggtttacagaaatgttcccactactatgggagaaaattgacttttgggggataggttgctttaggatttgacatgtttggtaaaccttagaaatgtctttgttacattagacactttctgtgcctaggggctagggcagaaaggccgtgtacttctgggctgcacagaatcacctgggctagacagcaggagacatgggctgaatgaaatacaggttatgcttgttgaggagggcctatggcagcacaaagaaagaagtgccttttttctttaacttttccaccagagaggattcctctttgcattcacacatctctgaggatctttgggtaatttgctcaaaggtacctctgaaagcaaatcctgagacaaggacttgggtgcaggaaggagttaccagaaagcaaagtgaaaaataagacagagtgagacagagggggaaaaagccaataaagtttacattaagtggattcccactgtgagcagctagagctcagtcttgctggggcccctctgaggaaagtttggataaattgtcaatcaaagaacgggggattggggcacttagtcactgacttctgtcctccattggctggggtttgcccctggaacattagttactccacattttagggctgagttgtcttctgaggcagaaaagtgggtaaacttccccaggtttgctcttgaggtggaacattggcaatgtacatagaagtgtccatctctgcagttctgaaattaggtgggctcagggcacagatgtgggttgagagttctgccaagaatgctccagcagaattgagattggggaaggggcatgctatggaggccctctgaatctatgcaggcctggccaaggactggtctcttactcagccctcattttcattccacttcctctccccctggtcttcttgtgcccatgaatcacagaacctgaagtcaacttcttctgttcccttaaatagctgtctgggtagccatgcatgtgactggatccagcggacatttaaaatgataagttggctcttcacagatgaatgcagacctgctgactcatcaaattgcttaggtgccagcaaaacaaagccatcagtgatcatggcttgcaagagctctaaagtatctttgtctctccatttctctccatccctactttatttcattaatacacttaatgggagtgagattacgatctaaataatcataatcatttctaattaattgaggcattctttcattcaaaaatttcaaatgtttattgagagcctgcctatgtcaaactctaggctaggtactgaaaacgtaggagtgaaccaagttcaaggtttctgccctcatggaatttacgttctagtggggaataaatacagaatgagaagagtatcatgtagaaaataaacagggtgatgggataaagtgtttctgtgagtgcctactttagataaggtgggcagaggaggccatttaagaagtgctaattggcctgagacacgaatgatatgaagaacctttttaggcatagggacattcaagttaaaaggctccgagtgggaaagggcctgttgtgttagaggatctgaaaggagacatgtgatcttaggggttataatacattagctaattttgtgtgctctagaggcagaatctatcacttaatagttttataatcttgggtgcatcatttaacccttcagagcctcagtttcttaacctgtaaaatgggatagtataattactacctcacatggatgtggtaaaaattaaagaaaatcttgtgtgttatcaccatacttgcacatgatagaagccctacatatgttattgggtttgtaatgactctttttctccaaaaaacccaactcagaccataaagaaaatgtgctgtttcatgtgtcagaacattctagggtgagttaaacttttcggggtggcttgatccaggcatttatggctctggctctcattcccttcttctctcagttatatcctctaggtgaatctgtatttcattggactggctccacacataaggacaaagatggcttcagctgccacaggccttagtctgtgtgcccctgcaggtgttccaggcctcacgcccacactccattctatccagagaaagaaagcatatataagagcagttcttgttgtattagtctgttctgacactgctataaagaactacctgagactggataatttataaaggaaagaggcttaattggctaacagttctgcagaaggaagagagcaaagggggaggtgctacacacttttaatcaacaagatctcatgagaactcactcagtatcatgagaacagcaaggggaaatctgtccccatgatccagccacctcttatccagcccctcatccaacattggggattacacttcaacatgagatttgggtggggtggggacacaaatctaaaccatatcacttgtagaggttttgagggtcagtcacattgtattagcttaggacacatacctaccctgcaccaatcacttcaaccagaaggtagaatgcaaatattgacataactcaggccatgtgcccctggagttgaacatggtgtcaacatttttaagattctgtggatctccaatgaaaactaggagctgatgggatagctgaggggaaatgatgctagagatggaagcaatatgtccagggatgttatccttgattattctcattctaattaaataatagaacactgggtaagggtaaatcagaagacccatgctataattttgatctgctcatagctttaagacttgcatactcacttgacccttagaacatcagttttctcaccctaaatttatttgttcaacaaatttcttaaactcttacatgggagagacatggatacaatggaaataagcagaaccacccctgtcctcattgagctaatgttctagcctagagggatttaaatatgaattatacaggctcatcaagcagatgttcttaacatcaaggtgaaataagatgtggtgtaatctgttaattttacccttacagacataagcaagtgaaagaatgaaggcagggagaagaaagaaggcagagtaacctacaagaagttttactttgcataagcgcagagactaaaatatcaggtcaaaactgtgaaaagttgtatttttaaactttaattttaaatttctcaatccagtgaaatttagatcctactagaaactgttcttagattatttctttttaatctgttttattaactaccagtttataaaagcgtttgctatgaaaaatattaggaactaaaagtaaaagcagtaccacaaggaaatacaatttatttgtggagaaagataaaaaggcacagtaaagatttatggtattgcttggtggaaatgttttatttaataaggactcataggactcattctaattagcaaaaatcaataatagaaaataaaagatgtaattcatagcctgaaattcaaattttaattcctgtgtttttttttttttttttcagagctaacttccctaattggaaatgtttgctggttttgttttacagaaataaccttatttttgtcctgttgaaatttattgctacttataagagcagagaatggcagttcattttgctataagttcccaacacagagatttttactgtcagtatagaaaagggccaaccaattacggggatggaaaatggtggaatgtctcctttgaccatggctacaattttgaggaaagattaatgaatttcttcttctgactagtatctatgataaattgcatccagcataattctccctttgttttctaccacttatgcctttcctctgccctttgtttagccattgactcatcaaccccagtatcatgtggaacacttactacttctgaaaattctccttttaagtcacattaaaacttaaaagctttggcatctggtatctggaggcaaagatacacgcctagcctggtattgtccgggagtatagagtaactttagatttctttaagagaaaaatgtctcattaggccaggattctcagttttctttgagacttctctccaatttcagttgagtgcttcatagtgaagttgactttacccccagctctaggtgttgatcttataattcaggcctaagtcagttaatagatttcatttctctggcctataaattcgaaaatggatgtattaccaaatcaagcagaggttaaaataaggcctgccttatacgcttccagagaagcaagctctctcttttccgctggacataaacaaagaatcatgtattctcaaaactgctgatacttaccttgggagtatgtagagaaagcctgcagacaacagatccagtagtgaggaatggaaagaaaaactgaattctgataacactttttgagcacctatgtcaaaacttacttgtagcacgctggacttttgattacatgagccaacacatattcgttaatgtctgcagttgaatttggttttctttttttcccaaaaattaattcttaatatactataaagcaccaataacattatgtcagtctcctgttcaaatgtcccctaataactttacatttttctcaggataaattcaaagtatttgcttaagtaagcacaagatatgatctttatttcttattttcagcttctgccacatattcatatatactttccttctggggatgctcagtttctttggattcctccaatgcattgtgctgtgcttttttcttacctatgcgctttgtaagaagaaaagcactacatattctttgtacacatctgtatagcatatcttcagatctagagaaatacagctgcagttttatctgtaaatcgggattaataagagcaagttccccatagggttattataacgatgctcatgaaatagtaagtgtaaagtatataacacatagtagcttctcagtaaatgtttattgaataagaaaaaaagagtacttgaataaatgaattacagaaggaattatctaaagttttggacaattcgtgtgatgaattaaatgctctatgggtaacatctgtgtttccatttgcccccatccctacttcatgttggcatttttacatgaaatttctatctaaacattctcttgactcaaaggtgaaaagtgacccatcattttccttaactctagagaaaatcgtggcctctcttttgtctagtaagttctgttatctgcttcagaagtcccagatattagtatctttgtaaaacaattcatttcaatagcacatcttctttgtttctactgaggttctatccttaactgacttcactgagttctcagtttaaaccctttccaaatgagtcccctgagtttcatgggaatatcccaaggctcagttagggagaacctaggatgcatgaagtggccctgggtgaaccatatcatagaatctagttcttattttcctagattctatagacttgactttgcagcacagtgcttatgttagtgtaatatcgaaagaggcaaagtggctaggacctgggctcaagagctatgctctctgatgggctagctacaagtcacatgcaattactgaaaacttgaaatgtggctgctgaaactgagaaactgaattttaaatttcatttaatattaattaaaattaaaattaaaaaatgaatactgagttcagcaattggaaagcttttaggtatgcttagaataactgaaatcttttccagctataaattttatcaaatctaataagtattcctgttgaatatttagcattcaaatggatatgtgctgcaagtgtgaaaggtacacttaatatgataaaagaaatgttaaatactttattaatctttaccttgattatatattaaaatgataatattttagatattgggttaaataacaaatattggtaaaattaatttcatctatttgtttttactttttaaatgtggctactaaaaaattaaaaactgcatgtgtggctccaaacacatttctattggacagaactgctctagaataggaccattgagttcaaatcttacgtcttataagctgtgtagcctttggcaaatcatttaaatgctctgggctgtgtgagacctatttataatagcaatgttcattctttgctctctattttttaagagctaatgtgagataatatataccgtgtgcttcacacaatgcctaatagaacataacatgcattaaatattagctctgaatgtatttagtttgtataaaatttattgcattgcatatttttaaaaatctatgccacagctttcatttgaggaaatacaaagatactgttaccatatttttaattccattgtggggccacattcctgtggttttcttcaaaaatgaagaccaatacaatattaattcaagcaattaggaaatagaatggtgtgtttgaaagaatactgttcttggagtcaagtcaaggcatgtgcctcttgttttttcttttttttttttttttgtcgggggagacggtgtcgctctgtcgcccaggctgtagtgcagtgtcgccatctcagctcactgcaacctctgcctcctgggcctcctgagtagctgggattacaagcacgcaccaccacgcccagctaatttttgtatttttagtggagatggggttttaccacattggtcaggctggtctcgaactcctgaccttgtgatccacccacctcggcctcctaaagtgctgggattacaggcggaagccattgcgcctggccaggcatgtgcctcttaaggaagagtatccctagatactttccatgcatccctcctctgctttagtctcacagtgcgaccttgtttcactcaccttttgtctctgcacctcagtttctttatatatgtcactgatgttgtgctgaataattattaaatttcttttcagatattaagtcctgaaatttctttgaaattgaggagcatggagctatatatagttagagagaaacccagttggtaaagtgggaagaggaaaatcagagctcagtgtttaatagtgcaagtttcttcaaacaggctctcaatctaggactttttctgatgagtcctgctgaggttcatgaacctaccccaaggctcagttaactcaactaagaaggactccagatgcatgaaggggctttgtgggaaccacgtcataacattttgttctcattgtcctggattctatagagacggcctcatggcactaagatgttcttaaaggagacatggtagaatagtagtagttattgaatccctaaataataatgatagttaatgcataaatctcttgccatgaactaaacgctgttccttttggtttacaaacattacttatttgacactcataaccctcagataagttttgtcacagtgtctactttctgatgagacgtgtaggcagagggtttagacaacctggccaaggtctcaccactagcactgcattcaaacacagacagtccaactccggtggacttaacactgtactatggtggcctactgaggacaagcaccatgtccagtgctggggttactgggtaaaatgtgacatagggtccctgctttcatagcatgaagaccgttttgtagagacagacttaaaacaagagaaaatgattatacaccttacatgcattaagagctaatgtgtattgcatacttatgtgcaaggcattgtgtgaagctcatggtttacatcatcttaatggtgtctttaccaaaaggggaaacatctacaaatgcaatgaagaagatatgaggaatgatataatagcatataatggagagccttgacctacttttgatgcatggagaatatctagggacttcttccttaagaaaagaaatttcagctgacatctgaaggttgcataacagctatacagcaaagtacatgtgtgtgtgtatgtgtgtatatgtgtgtggtggataatagtgtaaatggtggagaatattacagacgaatggaaccctgaggtgttgcactcagttgctgtatatgtagtttgtaatgttttgaggttgtttttaatctcaccatcattcatttgttatcttgcttttagtcatggactctaccgtcacttccttggggagaccctctctgactattccaagcaagttagttctcctcttgatatgctctcaataggaatgtacctacctctgctcagcccttagcattaaatttaaatttatttgcattatttgattagtgtctatctcgcaccagactataagatctattagggcagagaccgaatttggcactgctcaacattacgttcctagaactcaaaatttgttgaataaatgaatcacaaagtattttagattaatattagcctaaaattatcactgtgagttcacgtttagtccttaaaccatacacccccagttgaaataaaaatgaattttagattttggactatgtaatttactagtaaggcacaaagagttggcctcacctgcctttgcaacaatgcctttacaaataatctatattcatgttgttttctgagaaatatgcattatgcaaaagcacactgacaggtgtgtgaatgagttggtaaaataggcaatctaaaagtttctctattctttgaagagaaatgggtaactgtctttaaaaaaataaattatagaacattttacattttttttgactttcctatgtagtgaatcaaatacattatttataattagtgccttttggcttcttttccgcatggtttttcttttaatgcttttaaaaaacataaacaatgtaagtaaggtattttgtattacatcaaataaagtagccagatgaaagattatatattctagcattttatttatgtaaagttgaaaagcaggcaaaattaacctattaacttagatgtcaagtgagtagttagctttgtggagggcaaagagtgtaagagactgagagaggcttctggggggctggtgatgttctgtttcttgatctaagtgcttgttacaggggtgtgctcagtttgtaaaaattcattctgctgcacaattatgatttgtgcattcctctatatatatatattgcacttcaatgaagttttacaaattaagacaaattaatgaagcaaggaattaccatttatttggacatcgtcacaggcaaatggaaggttatattaaagtaactaagtgaaatatatttcagaaaaaaatgcccaccttagattaggctaattgaagaggtagcattgtgttctgatcaatatctcgggagacatactgactgaagaggtagcattatatctgagaagaacttctgtgtgctattcatcctgggtggccgagtcttgtgtctggggaacacctagagactctatagatttggaaacaggattcagatcccagcaggtttgtgaggctgattcaagaccactacattctatcatgggtaatatctactggttctcaaacctggctgcccattggaagaacctgggagctttaaagaaacaatgttggggtcccatctccagagatgttcagatgaaattctaatggggcccggacactggaattttttaaagctcccctggtgattctgatatgtatcaaagtttgagaatcactgttctctactataccattaaactatactatcatactatactatgcaatgctgtgctataataaagtgtacaactatttcaatgttacatattgcttgagaatacatatgtttgtaatgtaaagcaatacatggaaatcataagcaccaaattcaggatagtgagtacttctgggagagagggagggtactgaatacaggaaggatacgtgggtgacttcaggacacacacatacataattttgtataatcttttatttattttagatgtgttttttatatttttgttaagctggatggtgaacacagaaaaggttgaactcattcattcattacagttatcgattaagcccctgcccagtctcagactgttctctaggttctggggctgtaacaaggaaaaaaacagaattcctgacttcatgtaactaatatttagttagggtgaccagataataaataaacacacaacaaattatgctctataaagttgtggttagttctatggagaaaaacaaagacagttaaggggagatgaaatgctgagaccagagtgggaggcagataactatttcactcagggttgccaggaaaaaggcctttctgatacgacatttcagagagacccaaagaaactgggggaaggagtcaaacagataattaggagcagagtactgaagacaaagggagcgtcgagcaccaatgctgtggggctgacacagggacacaggtgtgccaggaggagagtggttagggggtagggacagcatttcatgtaagattgcaaggccagtgtcaggaatttggattttattctctatgagataggaagtcttttgaggatattgtagaaacgtctttacctttgtgtcaattgtatataccttcaacatctcatagtaagttaaaaaatagaaaagtgatatcagacactaatattgtaatgtgagttgatttattacatttatcttctataataagagaggctcatggaaccttgagggccctatgaaggtaagtttgttaagtatgggtctaaacagcccaagaaggaagaatgtgtgtgtgtgtgtgtgtgtgtgtgtgtgtgtgtgtgtgtgtgtgtgtgtgtagggtagggaacggtcactgaagataagttgtgccttctcaatttgatgtcagataacattatccaaatgatgtacaaatgtgcagggagacctgatcgccatgtagtagtttggtacaattcttaggagactagaaagcatgatcaatggaggcagagagaaataacaactcaggtcagcacacaaacaggagggcaaatttctgattccacctttaagaccttccattgtaaatgcctcctatttcttctccttcagttcaggtatggttgtagaaggatagaaatgttgcattagaatttaaaataactcgatggttcttagaagagactccagtaaattaacttttttacagcctgacaccatcttcagtccatttgctctggggccagcatgctgctctgaaaaatttccacattttgaactttctatttgaagctcataaagaatgcattgcttttcctatgctcccagctttctacccaagggagatggagaattgtcaaggccaaatgctcaactacttatttctcttagaggttttcagacaacacacacaagtgtttgatgcagggagagaaaaagtcacgaggaaagcattgttgtcccccacccaacatactctgttgaagtccagctggacttcaaccacagtttgtctggcaagacactataatatataatgtaatcagagtgcaattcaataaggttatgagtattattacctctttataactaagaaactaagtctcggagaggttaggtggattaccataggtctcaggtaggaaatgtcagacttaattctatctgactccagaacctgaaagctcgataactatcttttaactgcctcccatcaaaatggaatcacttttgatggctttatcctctaattaatgaatacattttaataggcaataatatgtctaagtattttagtgaagtcagtctcccttcattttaataggtttctgcagcctgtacaaagctcggtttattaaggggagcttgttttcttcacttagaccagcttgtaatcgcaaaccacactgacatttcccagactcctcctggcatactaactgttttaaatgctggtctggtttcatgggagacactaaggagaacgtcaatctcagctcagaaatgtgccctgcataaaaatgcaggctgggtaagggtttcacttaactgttcccaactgcacattgtaaacattcatatctggtattaaagtaatttatctacattcagttcaattttgggaatgtttattgagcacctactagcttctaagtgctgtgacccaggctacagtggaggcagagatgaataaacctaagccaagttttcctaggaagtgacagtagtagtatcctcagctcttcatgtatctgagtttttggtattaattaacattagtgctaagagtaatatccagccatggacatgtttacaattagggcaatgtctgctcattagacacatttgattttaaaggatcctgagactacattggtatagtgctgttgatatgatttctttcccctgtcccaaataaattatttgccttgcatggaaatacttactcactgctgtctcctgttggctcatattaatgcctagtttaaatttttaaaaaatcacataaatgttgtgggaagggacattgaagatagaacaacaggtgttatctatgaacatcaaaattcacccaatcagctaatgtgtattaaatacctacaacatgccatatatttcaaaactgggactaagctttggaaagtacaatgaatgtatatggcatataagccactaaagctatattcatacaatgaaattctgcttagaaataataaggaatgcactattaatacatgcaacaacatagatgcatctcaagaacatgctgagaacaaagtcagacactaaagattatacattgggtatgttcattgttatgtaattaataactgaataaaccagacaactatcaaatagtctcataattttgaagctggtttgtgagaaattatccttggccatacaatctaaaggagactctattttttctttttctttttttttttttttactgataaatatatgaaaggatctttattcccattgattaaagcaatacaaattaaaacaatgcaatagcttttgtaactatcacattgtcaatgattaaaatattgataataccagtgtgccaaaatgtggagagacaattactcttttacgcattattacttagtggcagcttatattggtgcaatactttaaagtgacaatttagcaatatttattaaaatataacacatctacatccaggaattcctttaaaaggaatatccctacatgtatgcaaagatatgtaaatatagaacattattcattgcaatattgtttataatagcaaaaaacttgcaggctttttgctattacaaacaatattggaatgaatattgtaatatttttatgttacaatgggggactagttaaattcaaaataagctgaagaattaatagtaatgatttccacaggaggagttggaggatcatgggagaattccagtttttttttttctttttatgtgccttatttcaatctttcccatactaaagtagcacttttacaataagaaaaataattaagatataaaacattacttttagaaaagcctcacaattttttaaacagaataataacaccaaataaatgttcacaagtggatactcagcattatattgaaaggattaaatgataatataataaactataatatgataaaggataatttcaggaatccaagaatgttttagtattaaagaatatatttacaatatgtgaaaaagtctaaggaaaagtagatttgaccatcttagtagatgttctaaagactagatggatgtcactgttgattttaaaatatataaatatattagtagatgtagaagaatatctcactaactcttgtgagtaagatgatctctctgaacccagtagccaatgtcatacttaacagaaacctgtagaataatttctttgaaatttgtaaaatataagaatatcccaaggatctcaaaggatatccactattcttacttgacaagattccggatatttcaataataagaaatataaacataaatggggaagaaaaaatatttttaaaaatgatgtattttttcataacacttactataatttgtaattatcgattaatttattgatttatatgctgatcaactgtctctctactcgattataagtcccaaagggcaggacttacgtgttcatcgtttgccactatatacccaatggtttatatggtgtccagcattaataaaatgctcaatagatatttcttgcaataataatcgcaagctccttgaggagaacggtggcttatttttctttatatctccgataactcacaataaggacacaaagaggggctctcaaaaatactatttgaaagaaaataggaaatcactagaaaaaaatctatggctcatcatctagaaacaagttaagtgatgtagagtccttcattaaaatttggatggatggctaagaaaggaacttcagtttattgagtaaatgatgcaaatgagttttcatttaagctactttcaactaattaatggaatagatagtgtgaaaggtgaattaacctttaagttaacctttattttagacattttggagagatagcagggtctagacgagtgttctcagccctgacgggaatgctttacaaattacaggtgactgggcctgcctccatccctagaggttatgattcagttgttctgaatggattgtgggtactgatagcttaaaaagctttccatgtggttctaatgttctgtcaggactgagaaccattgtcaatggaagaaatgatatataagatgggcttttgttcagaaagcaggattcaaaacctatctcagtcactttctagctgtgtaacctggtgaagattacttaatctcccagagcctttgggttcacatttatgaaataggataataatgttcttttaaggtggtgaacattaaaaattacatgaagtgccaatacatagtaggttaatcataattgatcaccacctatttttatatttaaggctatataggtaaaattttttggtttgttttattcagttttatctcaagcaacttgagtacatttatattgagagtatagtaatagcatcttatccgggctgtggaaatagaacctgcatctttaagagatcaaattggcaaataaggtgacagcttcattaccaaggctatcctttgaatggtagaccctctttaactcacatttttccaagtgagatttaaagacatggataaattggaaataaaaattaataatatctaacctttcttaagtatttaccatgagccaggcactgttttatatgctctgtatgtaccatttcattcagtctttagagcatccctctggttcttcagatttcttatttttatctccgttttaccattaaggaaaacaaggcacaaagatacaaaataatttgcctgagtcccatagttgttaaatgacaaagcaaagatctggactcaggcagtctgatttttgttgcctcattctttgtcttgtcctgccttcccctcccctccccgtctctccccgtctctcccctcttctctcttttcagggtctcttgctctgtcacccagcctggaatacagtggtgcgatcacagctcactgcaggctctacctccccaggttcaggtgatcctcccaccccagcctcccaaggagctgggactacgggcaggtgccaccacacctagctaatttttgtgttttctttagagttgcggtttctccatgttgcccaggctggtctcgaactcctgggctcaagtgatccacccactcagcccccaaaaatgttgggattactggcctcagtcactttacacaattttctcttgttattttagtaagtattttcagctgcagctctcctcgttatcccttaactggattatgtctaagaaaaaggctgggaagctgttattagtgggcaggaatctctttaagttcaagtgttttgtccaggacaaccttaaaattaccttgaactccttttgtccacttgttgcctgatgtacatgttaggatgggtgaaatgtgaatgacaatttggaatgactcttccttttaagtgaatgcatggatatttttggaagccaaattgtcttgggaacttttgatatatctagaaattggtagcattgtgttgtttacttcaaatttgaaaactgtctatgggaacatgactttgagtcaaactcattcattcccttatccagtaacatcaattgatcaataacctaaggcctgactgtagtcagtgttgggtatacaataggaagaaacatagtgtcttccctaagaaactcatcatcttggaatgggctgaaaggtacttatgttcttttcccgtgactctgtcagccaacattctgtatgaggataactaaagggagtttgaagaactgagtcttcattctggccccacctgcattgtggtccagccttgtgcctggagggcagggtctgcagtccagtagaacttggttttaatccctgctccgcttctcagcggtgtcatcctggacagtttacctagtctctctgggtttcccatatcaaaaatgatgccaataaaaggccttttctcagagttgtgagaattcaagagttatcatatgaagcttttatcatagcggctcacacatgctgaatgcttggtaagtgctcaggatgatgataatgatgatttatctttagaatgttttgttttatgttgatctcctctacaaaggaaactctaagatttcttccatttatagcatccttggattctaaaacatagaacaagcggaagcaaactaggaaagaactttttagctcctacaggggtcatgtgcatgaaaaccttgaatattgtctagctggaaacagtactgaccccctaccaggaaataaggataattattttaacattttaagaaaataagcaaatgtctctgctaataggttaatagtaaagaagcacctccctgctcatcagggctttatttatttgagacattttccagtttttcctcccacacagtataatgtgttaaacaggttggtgaagctttattttgcccaattgaaaacagactttcctgaggttttggacaacagccgaacttggtgtttttatttatggcattctctgccgcatttctgctgccaaacacacacatactggaggcccgattaattttgtgcttttcttgcagagtgatttagaataactgaggctgttcagattctcaggagtcgtttcctttgaaaacaagtacagtttgggtttgggcagagtagagcaatttgaagttaatggagtgccttaagtttttaaagagggctacattttgcaaacctttgaagtttgggaactggtgagcatcaataactgccaaggatctgggccaccgtaataataagattgccatgcttagtagctggcatcttgagaatggtagcccctgtgctcccaccctcatttttcaatgttttcggttgggcacataacagtttgctaaggaataaagtgcagtgatgtagtatataaatctgctgctaaaaattctactcatcagctcatttttttctctccctgatattactccaaatggtgcttaaaaggcccatgcttgcaaactatagtgctttgtcctttgcctggctctcagatgatctggtttctgaagaggagagagaaggctctgtccccttgccttcaaattggcaatccccagggatgatttatcctgacagcacaactctgcagctctgctctagtcttggaatttgctgactaggtacagttactgatggaaaagataccaaagcaggaaaaattcaaaaccatggaaacatgatcaagtttctaaacataagctcaacatacccttccacacaccttttattcatgcagagaatcgtgttcctctatcaaagacccacaacctgaccttctttaagtaaacttctgctcattcttcaagattcagcgcaaatgtcaccggtacctaaagacttctttgagagctgagtggagaactttaatatgttcaaagcagttattcatgtactgtatctccccctcactagcaggtagtccttttcagagcaaggacacattttgttcaactttctatctctaaaccatttactgaagagagaacagaatctgacactcagcaggtccctgcttgctgctgccatgcctggaggttcaggatcttgattcctctctcagggcaggaagattgggcagctcaggggctgagcatgaaggatttttaacccatctcttgcttttgttattttccttgtcactgataggtatcctttggattcacttttcttcatatcagagtggtcagctctgactcatgtgtgggaaggggatctggacaaatggacacctctcatctcttgtttaattccaagtatttaggtgttttaaaatctaactgggatttgttttaatcaagcatggagatacatgcagatgtggaaatggcaggaagactgtacgtattcagatacctagaaacaggaagcccagcattccacatagggccacatgaggaagccgtagggtcaggaggaggcagagtaaggaaggaacatggcaaggcaagcacccttattgtggtttctgcaggaagaaatgtgacaggtggggtaaacagggttagaactggctagttggggtactttcagtgggctctgggcctgggagctgttcctagttgtctggtaccttgccctggggtgattatagaaggtgaatattagcccagaacgtaagagctccataaagaagactggaaagtatgggctttggattggttggtttgcatatgaaaggtgccctccctggggccagctgtctgctgtctctaggaattagctagctctgggaggggcagtcccttctagtgtcagaaaggccccgagatgtgaagacatcagaataaaaaactttgcttaatatattaggcccaactaactcagcagatgacaccttttcttggtcctttccaactgctaagagttctgcattgaggtttgtagctagcatcataatactactttatattgaaaagtaaaatttaaagaaagatgaaagaactaaagaaaaggaaaagcaaagaaagaatattttttaaaaggataaaaggtagtggaaagaaaggaacaaagctcaggtaagttcccagaatatatttgatgaatggatgaataaataaataaacaggccaggcacagtggctcacaactaaacccagcattttgggaggccaaggcaggagaattgcttaaggctacgaggtggagaccagcccgggcaacttagcgagacccagtctccacaaaaaaaagtcaaaaaaaattagtcttagctactgggaagctgagatgggaggatctcttgagcccaggagttcgaggctgcggtgaactatgattgtaccactgcattccagactgggtgatagagggaggccctgtctctaaaaaataaatgaatgaatgaatgaatcaataaatgatcaaatctctatcttcctgtctaatcatattcacatgaatgcaaatccttgtgttagagccaacagaaatatttgcaattttacccttaattttaattatgtgataagacacttcgtacactgtcaatttcagctatcactgagcagatggatagatgtgttttccgcagccctaaaattacagcttgtaagaagactgcctagttagtcaacttggaaggtggtttctgcacaatcacttaaggaactgttcaatcagttgcttaatcactgagcaatagtttgtttatttaagggtggcattttttattacgctagctaaaagcctcagtggaaacactgttcaaactgttattctgatttccatgtccaccagtgactatgtccaggggagcctccgttttttaaaatctaactttccaacatagacaacagacttaagaaaggattggtcactgaattgccttacaaataagcactgccaataaatggaagtatttgtttacaaatcagcttgtcagagaggctgggatcagagaaatttggaagctaagggttagaggatagcagactcatagatcttgccaaggtcaatcaaaaatgataacaaaaataataagtctctggggaaataggattggtttacaaatctgcacgaaatttttacagattgcctctgcaaagcggggatctctgatattgtggtgaaggttagacagggaccctgcatccaaaaagctgaacactcaatttttcagtcattagaggggatataaataactgatggtgggcagtcagtctgtcataaatttgtagcagggagattcatctgaggacaagaggagattggggttatgggctgataccctttcctccccacgcaaacttcgacttccataaattgatgtgtgtggtagattgattgcaaaaataacctccgttctcatctgccttttccctgtagcgacacctattgcatggccaattgttgtcaatgatttgctctggccaatagaatatggtagaagggaatgtgtgtcagccccaaatctggcctcaagaggcttaggcttacctgcttctgctttttccctcaggactctgcttaccctttgtgaataagcccagtgaatctgctgagtgatgagagagagagtgggccagtcacttcattgctccaggtaacatgcagttatcttcccccaggtaggtcccagaagacctgccaactgactggacatgcgtaagtgagcccagctgggttacctgagtctggcccaggtcagcagtgctagccaatggacaaacaacatcatgagcaaaaattaatgtattatatgccactgaggttttttggctgtttgttgtggtacattattatagcattagataatgatgcaaagtgcagaacagctttatttggcaggaagagtaggggatgtgtgctcactttccatttctaatcaatcaccaggtcttactcatcctatatcctggatgaatatctctaattcattcccttctcatcactgtccctgccactcacctaacctggttatcttcaccacttgaaacttctcatgctgtcgtatacaactgtgtacttccctcccaagcatcattataatttgctccagttttgaaagattctgaagccagttttgttgagagaggagggcaacagatgaacaatattgggcatctactttattctatgcacttaattaagcttattgataaggctaatcacagacttaaccataatcataataaattggcaaacaatgtttattgagcacttcttacgtgccaggtccttagttcaaggatttacatgctttatttcactcttcatattcactttccaatcactctaagagattggtcttattaatgtgtcccccatgatacagataaggaaagaagatttgccaggttcaataagttggcctaggtcacacagcaggtacttgggagagcatacacacacacacacacacaaacagacacacacacaccctcatttaatgatctgtgtgaaagcacctggccccaaattggatcactccttctttgagttgtggtgggtactagggatccccttgaatatgtagccacatgctcatgcatacagaaacccaggattccccttaaggagaaaatgcatgcatttttgtagagagggagagggagagattaggaggaggaaatggctttttcccagacatagaggaaaatctaggctgagtgggtaagcttttatattttctgcagcttaaaaaatgtagagtaattaaagcaaaactggtagcaaaactcccaagatagatattccacgttctatcagtggctcccacttccctctcagactgaacagctttgcatgtgtctgggagcctgaaaaaagtctattgttctatttgggccaatatagcagcagaaattccctactgtcagtgctggcattctacactggtactcctgtaatcctttgctccttatttctactgttcccaggttatttctgcaaatgtgagagtcctagaagagaagttttccctctcttgatctagtaagctggttagtggggaagaaaatgaatggagtaccacagcacaatcttgttatggaggttaccaaaatcccttggcctcattatcaactctactttgttctcttatcccatatttaatttatcagaaaaccctattggccccaccttcaacatacatccagaatacagccaccatctaagccatctttgttttgcctgggtggcagcagtagcctgcaaacggatccctcttcctcaaaagcacaagtagagggatgctgttataataagagatcatgtcattcttttgttcaaaatctacccatggctcccagctcactcttagacaggccaaagcccttactgggcacattatacaaggtgtaaggcatggcctttattacttccctgctctcatgcctggctcctctcctcctagcccactctgccccagccccactgaccaccttgctgcttccacaacagattccacctgctcccacctcagggtccttttatttgcagtccttccctccaggaagctcttaccccagatatcctcacgggtctctccctcacttccttcaagtcttcatcctatgttgcttttactatgcaaccttcactgatggccatatttaaatgcggtaacacccttctatgctctccactgtctgttccaacattttttttttgcaccatagtactcatcatctttcaaattattatatacaagttacttatttgtttatttattggccttcttcctgtacagaatgtaaggtttatggggccagagatatttttcctctttggtttattgacagtgcctggcacatccaatgtgctcaaaaaatttgtgtcaaataaatgtatgaatttcatccatttatccagggcataatttagtatagtgtttaagaacctgggccatggaatcagcctgcctctctcagaatttctgctctaccactagatagttttgggacatttacttcacctccgtaagcctcagtttcctcatctgcaaaatgggtatactcaaagaacatgattcatggagaagatgcatacagaatacttagcctggtgtctggcatttactgaacattcagtaggtgttaactgttattataagtgaaaaaaattagtattcaaattcttcttttgctttctttggaggtacaatgttttcagaagaataatatgtggaagaagggtattagcattaaaggaatacctcagctcctttaatcctcacaactatcttatgagatagcgctgttttcctattcaaaaatgaggccactgagtcttagcaaggttgaatgacatgcccaaggtcacatgcgggcagagttgggattcgcatctagatttgtgtcatcctagtattggtcttagtcttgccactgtaacacccgccccctgtctccttactttagcagtcacgaccttgagcattttcattttgactgaacacgtccgctctttcatggctctcagtttgcttatgtttattctgttcgggtcctcttttcccttcatttatgctctttgaaattctacctgtcttttcaattcctgctcaaagccatctcctccctcagccctccaatttaacccctttctctgctatgctgcagacacacactgccttctacccacgcattagttattctgtaccatgtttcttccacagaagatggggatctccttgagtctgtgaactgcacaaggctcctctttgtgtctctacggtgcatggcacagcatagtgcagttacaacataggcaaacctgacttccaggatcttaactgcgccagcttgtaatgccaccatcatatttcctgctttaaacagtcagcagatgcaagtaagcctgccagtcaatgcatttgtcaaaacaggctgaggtgttctacctagtggccggaggtaaagcatattggtctagtggccatgtgaataggtggtgatgctatatcaatatcttcaaggaaagacattcgggtattaattgtgagtcatagagtaatgctgatcaagaaagagatagataaactgatacagggctctaaacacaagagtcgtacatacagtatggcacacaatggtacattaggattgttttaaaggtgattttattatatgcaatttatgtctgaccctggcacacaataggcatttgataaacgtttactaagttgtggagttgatttgaattaaaataaaccaatactgtatgacttcgaaattgaggggataccacataccagaaaaagaaaattgctttattgcccttacatagttgcctacaatttggtgtatatatagaaatgtatcttgaatgctaaagatagcacaagtaattgaaggtggactgaagggtgacaagtgacttgattagaaaggaaatttcatcttgtcacttattacctggaatccaaatttatgcaagatcagccagaaggcaattttcattttatccaggataaaccagagcttaagctcccaaagcctgtcatcttgaatgtctccaatagtcactcaaattgttggtgcactcttgtttagcatgtttattacaattgtcatgctgtcttgatttttctaaaattacaatctcattattacaggattttctgttgaatgacacttcataaaaaagactttgattgctgagttacaaagacaattgtatcttcttgtaaagcatacagtcttggtggtcctaccccatgaactggctgtcccaggacggttttacggtgaggcattagtcgtgtattgattttcttcaatcttcagttgaatatttgtagtaattgctgtttcagcaatggtgaaccacatagcattgtcagaacctgactcattctgtttcatgatggttagtctctgttggccctccaaatacgtctctaccctcactacttacctttgtgccctgggaggctgatctctgtggacttaaacatctaaggtcccttggttcttggcttctggctgggtttcactaattaaggggcactgagggaggatgaaaaacaagaggagagtgagtttggggtctttgttaccctggctcatactttgctagaacatgatccagttgtggtttcttgttaaagccacaggtacttttgagcatctctcttacaactatagaaaccctctccaagttccagaaactcctccctctttttgtgccttcatgactagatgtggtaaagggatagtcacaaactcattttggtttgaatcacgaatcatttaaatcatgaattctgctcacaactttgtagtccctcattatactctccccaataccctcacctaagtgtttcctagtaattctgtttcacaaatgctccaagatctgactatgacattaaaataacaataaaacaccttctgtttatacagcttttgccgttccttttctcctcaaaacaacccatgctcttctctggctactttatccatagtagggaccctgccatgatcttccactatttcatcctgtttattttccttataacacttattaaagtctagaggtatattgttcatttgttgtttatctgtttatagtatttttcttcctccagaatgcaagctctgtttgagtagggatcttgtttattttgttaatcactctctagtaattgatacatggtagaactcaaatgaaggaatgcatttctattttgggaagcagtgggtatggcagaactagtcatcaattcaggcctgctcgggaaacctggtacccatgagttaagcttcggtagccatgcacgtcctgggctcaaactcagctctgggcagaataagacagcaatacagtggggccctctgaattctagatttatcttcaagtatgtaccagtctattcattgttagatgttacgtgtaagtagcagttctgttaggctggaatggctgcagctgactctggcatttggagataacagtgaagctagtgacctttaaactccaggggcttagaaaagaggtttaagagatatcttattaggaacttgaaatatcatagatacatgaagtttcaaagagagaatcagttatagcatttgtgaccagcatgggagcccagggaactcactatcatgccattccttgatggttgagttaaatgactataatgaactgtatgcttcgaggatgttgaggctgagtggtatgtgatggttttacacaggaagtaaatggtgtccatattcttgcctgacatgggataatctttcagctgtgacaactgcagatttatctttcctagcaaacaaacaacaacaaagaaaacaatgtggaggtgacagaccaaaaacagaatatagaagtagggtgccagggagggctcagagagatcctgaaaactgtcaagtcatgcacattgaaagggaaaccattactagctaatgggaaaaaagcaacttgtagaatgcatgagagggaagcaagctcatttttaatttagttgatcaagacgttattgtagttcaagtgaacttacaacacaaagattcataatatcaatagaaaagcatattgtgaagctcagaataaaggaaatgaggacttgagtccccagagtttctcagaaacaagataatttaagttcttcccttagtgttcccttgagaatctgcctaatcagtctaaaggctttagaaatgcggcccattgtgtttaggctcctttacttaggactcttacagctgaaccgtgtctctcagtaaaaatgagaagcacttagcagcatctaatagggggccctttgtctcttctgcaccaccttcatcaccaccatagatgagatatttactgagccttccagagaaatgccaggtaaactctgaacctagtacattagaaacactgaaagcttagcggggccccagggaagaggtgagggtgcagagataaaactgaaagttatggatgaagatagaaattggaatgagactacaaagggtattcactttcctaataggtttttatttaagagcttttttggtggtgggggggatcataggctctgtgttattttaacttctacttcaaaatacattcttgcaagtattggcttgcattttcagcttgaaataacttagctttccaatttctcatctaactgcaatgggtggcactggttaaattatgacaaggtacagtagctttctaaaatgttaggaagaatggattctccatcattgggtctgtttcaaaaatgactcacctaccacctctttttctttaatgggggagagaatagaacatcttagaaatcttctgaaaatgaagatgaattggcattctgtccatcacaaaacatcatcttgtgctttcctaggaatggagaccatttaaattcttatttcctttggtttgtggaagtttatcaattgctttgctcagcatgcagtttcatcacttccaatctcagaaaagtgtcatacagaggtaatattcaaagactgagaattcaataaggtttccactcatcccaaaactccctcaagttaaatggtttaacttttatactatcaaccaacttggctgtgagcacatcagcagcaaggacggcattctattcatcttcagtgttgctacttagattccataagtgggttgaataaatgaaatataaacctctacttgatccaattaatctaaactatcatcttttaaacactcgggattcataccacacaatttccccattcttttccttgttattgaggctgatcttaaacagcatgaaatgagataaaatgtaacaattatctgataaattgagtaagagaagatggctaaaatagatgaatatattatactcaagagattgatatatatatatgaaatgttttctatataataaagtcaaaatcaattatgtccatacaaagattgtacaagaatattcacagaagctttactaagaatagttccaaactggaaacagtgcaaatgcccatcaaaaggagagtgaataagcacattgtgtatatccacacaatggaatagcactaactaataaaaaagagctaactgttgatacatacaactagttggataaatatcaaaaatgttatgttacacaaaggaaggcagctacaaaaggatacatactgtatggtttcatttagcagaggtacaagaacaggtaaaactagtccatggtgatagtaatcagaaccaagcttccctgttggcctgaagacacaccccaacgaagatttgagtacttcctgcttccattgggccagctgagggatggaaattgagctttttcctgtggccccattaccaccactgggtgggagaatgagaggttggcttgtttccttggagtgtaagcatagctctctggttgaccctggtaaccctggggtgggggtgaggttaggcttggggagggtgcagtggctctgttggtgtttggctagcgtaggctgtgcattaccagaaaggttttctgttgttagtttactcttttcctggtcctttggttaggaaaaatgggcttttgttggagcttctttgtctatgctagttggtggttcagagcagaggcttctgcagcaccctgtcctagatagaaaagaggtaacaaagaagcccagggacctcaccactgtgtcattcctcaatgcccaaagttcgtaggctgtattccttcttctctccatttttcagagcattcccttgctgtttattatgctatgtccaggaatttttagttgtatgagggaaaacctgaatagagtgggactactccatcttctccacaaccggaagtcttctccattctgttttcatatcaacattgaataacataacccaacggagagctggcacatagtaggtgctcagtaaatgctggttgatctggaatctaagtcttggtcagttagacccatctacacattgttgaagggttggaacttggttatcttctttgaatttgccattttccattgaagctcttctctacagtagaattcttctcacaattttgagcagaagtctctaggctaagtattgaatcctagtacccaaataggcatggcacctcagttattctagggttggccaagtttctggatttctgatcctggaatttgtttctaccttttctgactttttagagcaatcgtttattttcacttgttgctgttttttgttgttgttgttgtttgagttttcataaacttcatgctttgttgcaaccaaggaataatagaatttggattttcaaaaccctttgaggtgtctgagttagaggtcctataaaactgtaaattgtcataattattgctattatttagctgctaaccaaataaaagcaacagtctgggtcttcaaaaattgtttttgtaatttttttcttgcgtagaatgttgcactttcaataggtcctttacaatttctagaggcttctgcttttaacatcagtaatactcttctacacatgtgtgacacggataactcataaggtaaaacacattctgcctcatttttacgtgcagtgaaaagaataattaaattcttcagggaaaccccagatgagggctcttgagactaacaaacccctgttaccctatgttgaaagcagcagtatactcagggaaaaacaataaccaatttgtttatggattcattttgaactgtattttactcatttcattgtattttatttgaaaaatgcttttgtgaaattgtagaaagctatgtctattagagaatccctatctataggtattattaggcacaacagattcaattagaaagtttaaaaatgtttacataagtaaggactgcccacctggtctagcgaccctccaatggctttgatatcttcatgactgtcactgaagagagaactcctgctccatgggctccttgtttattcctacctcccaggctcaccattgtaatctgacttaggaggccaccaaagccattcctgtgatgctctacagcagaggttggcaaacaacagtccacaggccagatttggcccatgacctgtgtttgtaagtaaagtttgattgaaacatagccacatccattcatttacatattgtctaaggctgccttcatgccacaaaagcacagttcagtagtggcagcagagtccatacggtccacaaaaccaccatctttactctctttccctttataaataaagattttggaccactgctctacatctcactgtctcctttgctgattctgccccatcttcctgatttgtgaacactaccatctactagggcttagttcttagacattcgtcatctcttcattgattccttaggtcaggggttctcaaccccagctgctctgaagaatcggttgggatgcttttttaaaatatcactgccttggtgtcacccccagaagtttcgatttaattggtctggcatagggctcagtcctcagtactttctgaaagtttcccaggtgattacaatgtacagccaggattcagaactattactgtaggtgatttttgtctactctcaaggctttctataaactatatcttaacagcttccagcttatatctctagtccccatttctcccctgaatttcatatttgggtctccaaccccttatttggcatttccacttgaatttgtaattggcatctgaaacttgacgtgtttaaatcagaactcgcacactgctcctcccatgtctcagtaaacagcattccattctttcatttgctcaggacaaaattcttagtcattccggactcctccctttctctcatgttccatctctaatccattagcaaatcctgctgtgccttctaaatacattagcatctctcctgctatcacctggtcacagctagggtcatctctcacccaaattttgcaatggtctcctattgtcatagtctccttgtttcttccttggccctctgcagtctattgttaaaacagaagctagaatgactctgacaaaacaagagtcagataaagtcacacaatattaccctatcagggacatttgctctgaccacaaaatctgaagttgctgtcctaactcttatttctttcattttgctttatttttccccaaagcacttccatgagatattcttatttgtttatgatctgtcttcccttcactggaatgcatgctgcagttagagcagagctaccgtattgtacaaccctagagggtgcacataatagtttatgtgaatgtgctcctgaaaattattgtgcagtgcacagcctgagcagccatatgaggtaagcctgcaatcaagcaaagggcttggtttattcactgctgtgtttccaaagccttgatctgcgcccaacacaaaggaagctctttaaaatgattattggaatatataccacttatataataattttgcctgcatgtataatcatgaaaaagatgctttgaggtactttcaagaatactgtttaggatataacattctcattcatctgaacttttcatataactgacgaaagtttttgtcccttttttatttttgatttttgtgtgtaaatagtacccctcatttaaaaaattttcctggtatccttatttttcttttccttttttttcccttgggacaacatgatattttctgtaacttattagaagtgtagcccctatcattctttatcaccaaactctgcttttttcaaaaaaaaaaaaacaaacacgcacttttaacctagcatgatacaagtattcattttttgtatctctctcttactgggctgtgaactgcatacatatgaggattttttttgttgttcctatcttggcccatagcaggtgcttgataagtattctttgcaaggaagggaggaagggacggacggacggacagacagagggagggaggaaagaaggcaggcagagggacatagtacaactcagagggatgataaaatcagaaaaattggcagtaaatgcacagaagccttgctcatttgtcagcatgtctgatccacacagacagccagagcaggttatcagtaatatggattgatagtcttcatcaattaaaatccaaagattgtttccaaatgctcatttctggacaaaaaaaaaatctacataaaatatgtgcccatatgtactcattaaaatcataaacattttatggttttagaaataaaatcaatagggatagtagaatttaaataaaaaataattttaataaatattcacatgtgtaatctaacttgaataatacaggaaaaaagtgaataccattaaataattagaaacaataccatatacaaattattttaaaattattttcacaaaagaatggaacataggccctttacagcaaataaaactctagaatcctagttttggaaatcacatttattttatttatttatttattttttgtttatttttgttaagcattgtatttatatcaacttactatcattttcttcttccttttttttttttttttggtactatgctcctttttttttcttctgccttgaaaataaatattccttgaattaaaatacaagaatgaacagaaatgaatactgttccaaaatctgaaaacacatttttcccccattaccagtggatcttgatctgctccagaaattctttatgatgatggagggaagagcaaacaaatcgataggtagggacagaaacattgactacagttgaatagaaacagtcgtactttctaaaattctttccaatgtccttatatttcttgaattatgtatcatgtacatcttcataaaatgtcaccaatgtctcctccagtcagtctgtaactgctatatctgtgaaattatttgtcttgagccacataattgcatattgtgagcaactcatctttcagaagctagaggaaagaaactcaatctcaaaattacacctttcttatctatagatgagggggaaatgtcttatatatactgtcactttttctcagcaaaaccaccatctctttaaaaatcatggtttgaaagcagtaaatgctgcagaacaacaagctgtcagaggaaagacaggggacatttaagaccttgcataacatttgtaaaaattctcagcgtcaaagcagaaatcgtcatcttgagaaagattgcactgaattcaaatgactgacttttacatagctagaagagtatctttatcttaaagaaaaaactttcttggatagaaaataattctgctcaagttatgccttttctaggttctttgctttgacaacttgttaataaaaagcctggtaaactgatgatattttaatttcttttgatcttaactcctttaatcagctgaagcacagtaaaggctaaacaccattgggaaattgagagtggcggatgtagttttcccttggagaaagaaaaatgtatataagtaaggaggaataagctgacatgaatggttgctttttcatttgaacaatgaagaaaaatgattagaatggagagaattcaaatgagaagaaagttgtttcttctcaaacacattttcaacctttcatacgaacacataattaactattttatcttccactaagcaaaggaaaaattaaaaatgaaggaaaataatactaaatcatgctgaaatcatccagaagtaaaatactaaataaatatataaagcaaatggcttgcactttaaaagaactgcgtaactaaaacaagacaaagacattttctttttcttctttaaccaacctgagctggcagcaagataagctgagtttaaagtatttaaaaagattgaaaatgattcaatttagctgtgtgatcttttttacacaggcattaaagaaaataatatcatttctcatgaccaagctttctacccttgtggtgtgtgtttcatctgaaagtctctatacatatcgttgttatcggattggacaaaaacaaaggaagaagaatatctgcaaagctaatgttgatgagtaatttaaatgataactaagttgcgaatggcatttcaatttgttttgcccatttaatgacataagtagagattaagtccaaaaatttaattacttattaagtggcaataaaacataccagtggtttttgtccagttcttttcttattttagacacacttgtaaattctatataaaaatgtatcctcttcctctccactcccacgcactcctgcacacacacaaactcatctatgtatttatggtttagtatagggtttgcaaactcattgccttgaaggacaaagcaagtaataaaaaggaagagagaaagctctgtataagacaatagggagtagtgaggactgtggcaaacttggctaagcagctcactggaaagggtggcccctaatgatctccagccaattattgacacatgagaatataacacagtattaccttctcaaaatcttattttgtaagaggagttatgaatccatgtgtattacgagatctccctatgttggaatattgtcaactaattcaactaaatgaactaacaagcaaacagaatgatttcctcgctaaaagttcttgtctgtgggctgtatttaatcagctccctagtaggatgttgcttctggcttggcaaccactggcagaaggcttaggtttcaatttctactttgcttttactagctggggaggacttggacaagtcctcatctataagaaaaatacttgcatcagagacacaaactgatttgaagtttaatagagagaatttagagaccatcttgtcctacctacttattttagagataaagatacttgaagcctgagtagcatcaagtatttgtctaaggtcctaggagaagctgatatcagagctggcacttgaaacaaagtttagactcccagttctcatggttacccagtgccgctctaactgcttcttctactctgcctcaattgtaactttgggctaaagcaattagaataattttcagtaggtcaggtcatgacgatgaaatcaggaccatagttttcaatttactaaaaatctactttctagaattcctggagggcatagcctattccatacctgtccagaatacatcatagccctcatcataatcatattcttaagtatatttaataaataaatgactgaataaagaaatcattctattttggacaaagaggtcatcattcagaaggccacaataacatggaggaaaactatttcaggaataaataagctgaactcaggtaaactgccttatcatccactagaaaccacattaaaacaaaccaaacaaagcaaaactaaactgcttcctgctagctctctgacttagaactgaatagagatacagtctttcttggatctgatttctgattgctccttactaatgctgaaaattgaattcattggctccatcaaagtgccctgcagagaggagtagaagccctggctgaatgtaggagataaaaaataagcttgatagtaaaggtggcttacttgatagtccacagaaagatagccaagtcaagcatgcccttatttatggcttattaaagacaatttttttttccaagaaaacatacatacttcacagagctctggcctagaatttaaagcatgttgtttttatctcgcctgtgaatgtctgctgctcccaagcttgcaaagcttgtctactgacttcctctccagttgctctactgattattttttcgcttttatgaaaaattaaaatataagatgaataagacaagtattgtttaattcttataaagttaaggatttgtttgacatattttatagagtatcaagcagaatatataaaccatacacatgacagtaaataaatatgataaagtatggcatcaatattctggttttgatgtaacaggggtgtatttcccttctataaaatattccttgttgcataaaatttttaacaaccaccttttcattttttttctaatatactcataaaatgaggtctcagcagaacatgtaggggaagatagtgaattttatttatgattatttggttctagacttctaggtaactggttaaaaggtcaggtagtgagtggataaaaaatagatggagtgtgaccagagacttgctcaatgctgcggtccaacatccacgttgataatggctacatccagtttaactgtttatgtagcttctactgatttcagtagaatcagaaacagattttgggtttcaaattttctgtttgtgtaacaggacattaacagtgtcctgttaatgagaaaagattcttctgtactgagatgagaaatgaattgcattgggttattcagattatttcctgtgtatgtgtttcctatgtatgtgtatgtatttcctgtgtatgtgtttcctgtgtatttcctgtgtatgtgttttaaagccttattttctttctatgggccaattttaagccattatttcaactcaatgagtgtctattaattgacttgtcatgcccaattctgagacacaactggctactcttagaagctgtgaaaccttttttgtgaaggcaattgctaacatttattgatcacttaccacatgctagtcatcagctattaatttccatatattacctcatttaattattgccataactatatcagtctggttaattttcctcttactttaacctaaaacttaggatgaatttcttaccctatctaggtctgtttactgtagtacctttaacctccttgcaagggtttcaactcatttttagcttcatggcaacaacataacttcataatgtcagaaaaggtaggggcttagcgatggtcagaacgttatgatcatttatgtcatccataaaaaataaaccctggaaaaatacctgagtctacttcaagtccagcagagagcctcaggtatattttctcccctcagttccttcttctaatcccttttgtttttgtttctatggggagctatgctgtttgatcagccacagctcactgttaattcagattatgtttacaagccattaaaaccctcagccttcataacacatgaaactgataagttttattttcttcttgctctatggacacaggtgaagtttttggatataagtgctggaattatatcttagttaagagtatccgtctaattgttctaatttttgttcttcaatgaattatagacagtcccaagaattacaaagttttatcaggtcgcatccctaatcctaaagagcaaataagcatgaaggggttattgactattttttgaattactcagtttgaacatgattcctccttgggatgaatacttcttggctcctcagcctcttactacaaaacccaagggaggcgtggagtccctctccctgcttgctggcagctgaggtacaactgtgggcctttgactgcactggcggttcagatgatcctgctgagggctttgacctttaagggaatgatgtggaatctcaggttcagtgcgcacatattcacaggaaggtagtaccatggagaatgcagctttgaaggaccaagttatatggctggcacctgtgctgggtcaagacgtgatcttggatgattcctgctgcctatgaccttttcatccctgatcatcttcagagatttttcttcagccttcatgtatacaggcataccttggaggtatgtggatttggttccagaccactgcaatgaagctgatatcacaatagaatgagtcacaaaaattgttttgttcctgttcatataaaatttatgtttacactgtacagttgtctattgagtatgcaatagcattgtgtataaaaaacccaatatattatacataatgtaattaaaaaatactttattgctaaaaaagtgttaatgatcatctgagccttcagcaaagtcataaactttttgctgacttgaagggtcttgcctcattgttgattaggatggtggttgctgaagtttgggatgactgtggcaatttcttaaaataagaaaacaatgaattttggcacactgatggagtctttcttttacaaaagatttctctgcagcatgtcacgctgtttgatagcacttcacccacagtggaactccttccaaaactggagtcaatcctctcaagccctgccactgcaaatcctttgctgtcatttcaacaatgttcacagcatcttcgccaggagcagtttccatcttgtttgctcatccatccataaaagcagctccccttccatttaagttttatcatgaaattgtagcaactcatcacatcttcaggctccacttctaattctagttattttgctatttccacaacatctgcagttacttcttctgctgagatcttgaacttctcaaagttattcataaggtttggaatcaacttctttcaaactcatgttcatgctgatattttgaccttctttcatgaatcataaatgttcttaataacatctagaatggtgaatctttacagaatgttttcaatttactttgcacagatccatcagaggaatcactgtcaatggcatctataaccttatgaaatgcatttcttaagtaatatgacttgaaaatcaaaattactccttggcccatgggctaagaatggatgttgtattagcagacatgaaaataactttcatctcttattcatctccatctgaactcttgggtgaccaggtgcattgtaatcaagcagtaatattttgaaagaaatcttttttctgagcagtaggtctcaacagtgggcttaaaaaatccagcaaatcatgctatcaacagatgtgctatcttccaggcttttttgtgccattcacagtgcacaagcagcagagatttagcataattcgcaagggccctaggattacgggttagttaatgagcaatggcttcaacttaaagtcactaactgcattagcccctaataagacagcctgtcctttgaagcctcaaagccaaacattgacttctccgtacctatgaaagtcctggatggcatcttattccagtataaggctgtcttgtctacattgaaaatctgttgttgagtgtagccaccttcatcaatgatattagctagattttctggataacttgctacagcttctatatcagcacttgctgcttcaccttgcacttttattttatgaagatggcttctctccttgaacctcatgaaccaaattctgatagcttcaaacttttcttctgaagcttcctcatctctttcagccttcacagaacttaagacagttagggtcttgttctggattgggctttggcttaagggaatgttgtggctggtttgatcttctatccagaccaataacattttctccatattagcaataaggttgtttcactttcttagcatttatgtgttcactggagtagcacttataattttcttcaagaactttttctttgtatgtacaactgtttggtgtaagaggcctttttacccatctcagcttttaacatgtcttcttcactaaacttcgtaatttctagcttttgattttaattgagagacaggtgactctattttacttgaatacttagaggccattgcagagttattgattggcctaatttcaatattgttgtgtctcagggaatagggaggctggagaggaaaaagagagatgggagcatggctggtcagtggaaccgtcagaacacacacaacatttagctattaagttgcccttttataagagcctggtttgtggtgctcaaaaacaattacaatagtaacaccaaagatcacagatcacagattatcataacagatacaataatgatgacaaagttttaaacattgaaagaattactaagatgtgacacaggcacattaagtgaccacgttattgaaaaaaatggtgccaatagacttgctcaacacagggctgccacaaaccttcagtttaaaaaaaaaaaacaacacagtatctgagcagcacaatgaagtgaagcataatgaaattgagtatgcttgtacttacaaaaaaatcctgtttgtgctaaaaatagacagatgaagacagagttggtttctggtacttgcaactaaaaacccagcagacccaggctgcttctcttctcctctgctggtgtcaccatggagtgaattcccatcatctcatgactggaccagtgcaatagcctctgcctggctctggctccggctccatgatctcaccttgtctggctctatactctcacgtggcttcctgcagcccactgagctaccacttaaatctgcaagtcagattagcccattccagtggataaagtccttcaatggcttcccgtcacattaacactcaatcttcaacctctcacttgattgcctctattttcaagtcccgtatccccatgttcctcccgcccccaaactccagcggtgccattcctgcttctcctcaactacaccaagctttgtcctacttctgagcctttctacttttagagttgctagatttaaaaagctgtttgttacctgggatatagaaaaactgtttgttgtttctctgaaattcagattaaactgggcatcctgtatttttgttccccaaacctggagccttctgtttgttgttccttggtctgacagcaaactgaagagggaaccctaaattacaaaattttccaagtttaacctttctccttttttacttcttactttcagtttttaatttatctagaatttaaaaaatctacagagagaagtaatagtactgaacttctataaaagtcacaatgaagttacccagcagctatgattatttcattaggaaataattgactcccaggaagccccatgtactgtaatctcttctctccccaatgagggcaggataatagaccattttccaaatctaatttggtttgtattttccatctgaaaggcaggctggacacaatgaagacttggcttattgttttcctgtttctgtttgaacagtgaactgatttgtaaagaaccttcattgtacctttcacttctctgactccctcaatgttccttgtgttacctccagtatgacaatgggacccatgggccacatgagcttatcacttagagaggcatcgatttctcccttttttagaatagcttcataagagccatcaacattttaatagagtcaggtatctattgggaggtttataaacctgggaaaatgagtttgtgttccacaatgtagacacagatattttttattaatttagagagccaattcccccaggcaaatgagattctgcttgagtgttcagcttgtctttcaatagttctgaagacttatgcttggatttgttgaataggcctatggggcctacagaaagatgcagcgtttctataatttggggaagcttggagccagacataaggtgaaattgaaaatacacagcactatgacaagaattgtcgacagaaccaagagagggagagaaagagagtgagaaagtaggagagaggaagagacagagacagagagcaacaaaggatttacttatcctgtgactgataattccagaggtgggtctggctcaggtatggtttgctataggggttcaaatgatgtcatctcacttgctctgtcactaagcttcacttccctcttggttttattttcaatgaggttgcttctaaaatggtgccataatgactgccaaacattccacatttctactccacacagctaatggcctcagtagaaatgaaaacctctctttgctaattccatcaacaaatgacccagagttgattctccttggcctgaccgtgctcaagtgcccatttatgaaccaatctttgtcaccatggaataaaaagtgctccttggttagcccggggtctattcccacttctcaaacagggaagaagtgataaatcatgtcagctttacttataccatattgatggccagtggggaaggagataatttgctgaacaaatttgggatgctatttctaaataaagagggaaagattgtattactttatttggaagtttcttttcccttttctccctctttccttgtgatgtcattctgctctcacactacaaatgagttcctaataactcatgtgttgggggaacccagaggctgctatcacttcattgtaccatcaagggagacactgcaaacgtgttaacataagccagacaagacatagacttggttttcatgactgccaacaccgacaggcagagcatatatttgaaactattttccttcaggcaacaaagcagagagcagatgaaagatccacctttgaaagatcttcatatactatgtttgtccttgtgttctttctttcaattctgttatcttcagatgcttttggaaaaagctactcatcatgaggtagcaataggggatgcctacactgcagatctaagtttgaattatatatgaaataatgatggagctccatttctaaatgtatacatccttcatagtgcacaggatggtgatggtagtccatattactagatgtttcctcctattccacagccaccgagtgtataatgctgtcaatagccctgtgcggtagatactgttattatcttttttctttttttctttttctttttttttttttttttttttgagagagagtcttgctctgttgcccaggctggagtgcagtggcacaatctcggctcattgcaacctccacctcctgggttcaagcaattctcctgcctcaacctcccacatacctgggattacaggtgcatgccaccattgtttctattttttaaactgagttattcataagcaagatcatcctcattgaagctatttactcaggcatcatcagccataccttacaatgaagaaattaaggcttagagaagggaaggagggcaggtcccagattttctgagctccacatcagcctactcaggaagtcctgactcacctctaagcttcactacccatattgtgctcttccatctccctacaggtcctttaagtcaagcccagaatgggaaaaacaaacatcagaccaacctgtgtagctgtttagagctaagtcattggagccagactgcatttgttccaataccaactccagttcttacttacgggttatattaaattctctggggcttagtgcctgccccaaggagctgctacggtacagatgaaattaatcacttttaagcacttctaaaagtgctcagaacagtgcctgacacataatatgtattcaaagaccccatttgtacagcgttctttgctattacttgccagggcttcatatcatacaatacagaaaagtccctgaggaatatctggtagtgaatgccctttgtctcacatggatgtccctctttcagcacttaaatctacactgagtatattttactagtttgttcctacaccaatagacagtttacttcagatgactttggacacttcctatagagttaatcagctggcttacagtaatgagcatgagggtagtattaaaaaaaaaagaaaaataaaaagcctggatgtcgtatagtcaagtaggggtgagattgaatccaggcccagtgtgcttaagacctgtgtgactttaggcaaattacttcacttctccgaactccattttcttatctgaaaaatgagaatagaaacattttcctaactcagatgatgtgaggatgcctactgtgcatagtaaatgcatggcacacaggagaaagaggcagccttcttaatcataatttaacaaacctcggatctttgtttcatcattgtttccttgttatttgcttttgcctgtgagaacagcatctgctgaaggcctttcagaagattttgcctgctttgtgatggtccttgtgggcagactgttcacaacatgactacttactagccaactccttagtctccagacataaacatttatatatttactttttaagaacagtgcagatatatgtgatgattcaaaacagtcagaatgccaaattttgcccagtgataactgcttagccggtatagctcccttttttttttgaatcgctacatggcagatattttattcccgtgtctacactgagctgaggaaactgatgatcttaccggaaatgtaatttgctcaaggtcagagttccaagtgcattgaaccagccaaactcatgcttttgcgtcctatcagctcctttccctccctcccttcctcccttgtcctttccttcctcctttctttctctcccttacttttctccctcatactctttctccttctttcatccctgcttctttccctcaccttctcccttttctcctttttcattcaacaaggattttctaagaacctacacaatgccagtatcttctagatcttgggaatggaagaatgaaaagatgaaggaaacatttccagatgcagatgacttacagtctcaaaaagaatttgctagatgaaccctgggtgagtattaaccagacctcagatcttgagcaatccactgggtgtccatcccgattgatttcaagtaaagttctttggtttctttggaaacttcgacataaagggtcttgccagggaatttgaaattggggtatggattttttttcaatgcaagaaacaatgaaaatataaaaatatggaaacaactgaaagctagaattaggttatgaaactatcaatattattgttgcttaaaaagatagtgcagtcatatcatgtactgtgttaacttacctaaatttacctgcatatatgtttggcaaagagagacaaaagtggggtgggtgggaaagagaccacagagagagtgagcaatttaaacaatgcaggaagttcaggccatgttccatcacagtgtctgcttgagggtgatcttgacatatgatgggtatctactgttttcatgtttatttcacactgtgggcacatggccatgcataatgtaattctagtgtttaaaagtcattatttttaatttaccatgccccaaaatgccaaggatctggtactcaactgaagaaagggtcatctggaaagctgtgcaggactaatggacttcaatgtgtcagtctctaatgcagtgtcatttaaggacttgtcaaggggctaattttgactatgcatatttttcatcttatgcacttactttggaagcacagtctctcagggtaagggacacccctgcattatgtttaaatttagagtctactaagccccctacataaataatggatttgcatctgtgaattgtaataatctctagaaggagataatttgcaaggacattaacttgataggcaagccactattaattagaaatcttaacatgttggcttgttaatggctaattaagcctttactgagatccattgcaggtaagaggcaatgaagaacaatccaggaatatgaaatgctattcgcctttgaatttgattctgttcaaaaaaaagtatagaaagtctagaaataattataggtaagacaaaaacaagcctccagcaaattaaaaaggaaatcactgggaaaagtaaaagccatcaaaattaaaaatagaattcattacctgttcaaacagttgtattaccacgcaatctgaaaatactctcaggattgctttgtatttttattttactttaagtttcaggatacatgtgcagaatgtgcaggtttgtttcataggtatacatgtgccatggtggtttgatgcacctattgacctgtcatttaggttccctcccctcaccccttaccctccaacaggctcctgtgtgtgttgttctcctttgtgtccatatgttctcattgctcaacttccacttatgagtgagaatatgcagtgtttggttttctgtttctgtgttagtttgctgaggatgatgacttccagcttcatcagtgtctgtgcaaaggacatgctctcattcctttttatggctgtatactattcaatggtgtatatgtaccaaattttctttatccagtaaatgcccattgatgggcatttggattggttacatgtctttgctattgtaaatagtgctgcagtaaacatacatgtgtatatgtctttatgatagaatgacttctattccttttggtaatgggattccccagtaatggaattgctgggtcaaatggtatctctggttctagatcttttaggaattgccacactgtcttccacaatggtggaactaatttacattcccaccaacagtgtaaaagcattcttatttctccacagcctcgtcagcatctgttgtttattcactttttaataatcgccattctgactggttgagatggtacctcattgtgattttgatttgcatttctctagtgatcagtgatgttgagcttttttttcatatgtttattggccacataaatgacttcttttaaaagtgtctgttcatatccttcatgtactttttgatggggttgtttgtttttttcttgtaaatttgtttaagttccttgtagagtctggacattagacctttgtcaggtggatagattatacaaattttctcccattctctaggttgcctgttcactctgatgatggtttcttttgctgtgcagaagctctttagtttaattagatcccatttgtcaattttggcttttgttgctattgcttttggtgttttagtcatgaagtctttgcccatgcctatgtcctgaatggtattgcttaggttttcttctagggtttttatggttttgggttttacacaagtctttaatccatcttgagttaatttttctataaggtgtaaggaaggggtccagattcagttttctgcatatggttagccagttgtcccagcaccatttgttgaataggaaatccttttcccattgcttgtttttgtcaagtttgttgaagatcagatggttgtagatgtgtggtgttatttctgaggactctgtcctgttccattggtctacatgtctgttttggtaccaggattatgctgttttggttgctgtagccttgtagtacaaagtcaggtagcaggatgcctccagcttttttttttttttttttttttttttttgcttagaattgtcttagctatatgggctcttctttcattccataagaaatttaaagtagtttttttctagttctgtgaagaatgtcaatggtagtttggtgggaatagcattgaatctataaattactttgggcactataggcattttcatgatattgattcttcctatccatgaggatggaatgtttttccatttgtttgtgtcctctcttatttccttgatcagcagtttttagttctctaaggtccttcacatcccttgttagctgtattcctaggtattttattctccttgtagcatagtgaatgggagttcattcatgatttggctctctgcttgtcttttgttggtgtataggagtgctttgatttttgcacaatgattttgtttcttgatactttgctgaagttgcttatgagcttaaggagtttttgggctgagacgatggggttttgtaaatatacaatcatgccatctgcaaacagagacaatttgacctcctctcttcctatttaaataccctttatttctttctcttgcctgatttccctggccagaacttccaatactatgttgaataggagtggtgagagagggcatccttatcttgtgctggttttcaaagggaatctttccagcttttgaccattcaatatgatattggctgtgggtttgtcataagtagctcttattattttgagatatgatccatcaactacctagtttactgagagtttttaacatgaatcgatgtttaattttatcaaaggctttttctggatctattgagataattgtgtggtttttgtctttggttctgtttatgtgatggattacgtttattgatttgcccatgttgaaccagccttgcatcccagggatgaagccaacttgaacgtggtgaataagctttttgatgtgctgctggatttggtttgccagtattttattgaggatttttgtaccaatgttcctcagtaatgttcgcctgaagttttctttttttgttgtgtctctgacgggttttggcatcaggatgatgctggcctcatgaaatgaattaaggaggagtccctccttttcaattgtttggaataattttggaaggaatgataccagctcctctttgtaactgtagtaaatttcggctgtgaatctggtcctgggctttttttgggtggtaggctattactgcctcaatttcagaacttcttacggtctattcagggattcgacttcttcctggtttagtcttgggagggtgtatttgtccaggaatttatccatttcttgtagattttctagtttatttgcacagaggtgtttatagtatattctgatggtagtttgtatttctgtggggtcagtggtaatatcccctttataatttttttattgtgtttattttattcttctctcttctcttctttattagtctagctagcagtctatctgttttgttaatttttttcaaaatactagctcctggattcattgatgttttggagggtattttgtgtctctatttccttcaattcagctctgttcttagttatttcttgtcttctgctagcttttggatttgtttgctcttgcttctatagctcttttaattgtgatgttaggttgttgatttgagatctttctaggtttctgatgtgggcatttaatgttataattctccctcttaatactgctttagctgtgtcccagagattctggtacattgcctctttgttctcattggtttcaaagaacttcttcatttctgccttaattccattatttacccaggagtcattcaggagcagattgttcaatgtccatctaattgtgtgattttgagagagtttcttaatcctgagttccaatttgattgaactgtggtctcagagactgttatgttttcagttcttttgcatttgctgaggagtgttttatttccaattatgtggtcaattttagaataagtgccatgtgacactaagaagaatgtatatattgctgatttgggctggagagttctgtggatccatttgatccagagctgagttcaagtcttgaatatccttgttttctgtctcattgatctgtctaatattgacagtggggtgttaaagtctcccactgttattgtgtgggagtctaattctctttgtaggtctctctgaacttgttttatgaatctgggtgctcctgtattgcatgcatatatctttaggatagttagctcttatcattgaattgatgcctttactattatgtaatgcctttgtcttttttgatctttgttggtttaaaacctgttttgtcagagacaagaactgcaacccctgcttttttttgctttccacttgcttggtaaattttgctccatccctttattttgagcctatgtgtgtttttgcacttgagatgggtctcctgaatataggacaccaatgggtcttgactctgtatcctccgtatccaatttgccagtcttcttttaattgggcacagttagctcatttacatttaaggttaatattgttatgtgtgaatttgatcctgtcatcatgatgctatctgattattttgcacactagttgatgcagtttcttcatagtgtcgttggtctttatatttcggtttgtttttgtagtgggtggtactggtttttcctttccatatttaatgcttccttcaggagctcttgcaaggcaggcctggtggtgatgaaatccctcagcatttgcttgtctggaaaagattttatttctcctttgcttacgaagcttagtttggctggatgtaaaattctgggttgaaaatgcttttctttaataatgttgaatattggctcctgctctcttctggcttatagggtttctgctgagaggtcctctgttagtctgatgggctcccctttgtaggtgacctggcctttctctctggctgccattaactttttttctcttcattttgaccttggagaatctgatgattatgcctcggggttgaacttctcatggagtatcttagcggtgttctctgtatttcctgaaattttggggaagtccttttttataatatcctgaattgtgttttccggcttggttccattctccccatgtccttcaggtctaattaatcacagatttggtctttttacatagtcccatatttctcaggtgttttgttcatttccagctccatcaggttatttatgttcctctctaaactggttattctagttagcagctcctttaactttttatcaaggttcttagcttctttgcattggtttagaacatgctcctttagctcagcagaatttgttattacccaccttctgaagctgacttctgtcaattcatccatctcatcctccatccagttctatgcccttgctagagaggtgttgcgatcatttggagaagaggcgctctggtctttttggtttttagcatgtttctgttgattctttctcatcttcaagagtttgtctattttttatctttgaggctgctgacccttggatgggatttttgtggggcctttttgatgttgttgatgctgtttttattgttttttgtttgtttgtttctttttcaatgatcaggtccctcttctgcagggctgctttcggtttgctgggggttcacttcaggccctatttgtctggtttgttcctgtgcctggagttgtcactcaaggaggctggagaacagcaaagatgggtgcctgctcctttctctgaaatctctgaccttgagggcaccaacctgatgtgtaggattgcccctgtatagggtgtctgacaaaccctgttagagggtctcacccagtcgggtggcacagggagcaggacccatttaatgaagcagtttgactgtcccttggtggagggggtgttctttgctggggggaaaccgacttgtctgggctgcctggattcttcagaactaacaggaggaaaggctaagtctgctggtccacagagactgtggccatccctccccctgggagctcaggcccagggagatcagagttctgtccttgagcccgtggctggagttggagttcctgcagggaggccctgcccgctgaggaaggatgggtcagggtgaggcctgaagaggcactctggctgcagtccgccagcaggggacacctcttgggaccaagctgtccagcctccctggctccagcaggggaaaacagcagcctacagctaaagatggctgccacccttcccccacccatgcagcttagcgtgttaggcagctgttagtcccagtgatggctgctgcccctcccccaaggacctcaaacagcttagacaataggcagtcacagctgtggtgctggtcacccctcccccagggaaccaggcagccttaagcacattttagctgagagactgttgagaatctgcgtggctttggggttgggaccttaggccccggtggtgtgaattcaccccaatctgtgggttgcatggttccatgcgaaaagcagtttctcctgctgtgtagcacgctcactcacacctcccttggctggggggtaggagctcctctcccccatgtggctctcaggtgggcctccacaccacactgctcttccttcctctccttagatcacgccagctgcctagtcagttctgatgagagaacctggatagctcggttgccagtgcaggattcacatgctattgtgatacttttcaatgggcacctaagatcgccactgcttgtagtcagccccggattgctttttaaagacacgtgtgtaaaaatgtccttaaataccccggagacacaccaactatcttaccagaattaaatatttcttatgtaatttgacattatgtttttttcagacataacaagagtgtaaaatgacacaattttaactgtcaagaaacacagaagcatcatacttatatttcaggcctaccattttgtcacttctctctttttttgagaatttgatgggcaaaattaggaagctccgttccttagttttctttctttttttttttctaattttaagttttagggcacatgtgcacaacgtgcagattagttacatatgtatacatgtgccatgttggtgtgctgcacccattaactcgtcatttaacattaggtatgtctcctaatgctgtccctcccccctacccccaccccacaactggccctggtgtgtgatgttccccttcctgtgtccgtgtgttctcattgttcaattcccacctatgagtgagaacatgcggtgtttggtgttttgtccttgcgatagtttgctgagaatgatggtttccagcttcatccatgtccctacaaaggacttgaactcatcattttttatggctgcatagtattccatggtgtatatgtgccacattttcttaatccagtctatcattgttggacatttgacttggttccaagtctttgctattgtgaatagtgcctcaataaacatacatgtgcatgtgtctttatagcagcatgatttgtagtcctttgggtatatacccagtaatgggatggctgggtcagatggtatttctagttctagacccctgaggaatcgccacagtgacttccacaatggttgaactagtttacagtcccaccaacagtgtaaaagtgttcctatttctccacatcctctccagcacctgttgtttcctgactttttaatgatcaccattctaactggcgtgagatggtatctcattgtggttttgatttgcatttctctgatggccagtgatgatgagcattttttcatgtgtcttttggctacataaatgtcttcttttgagaagtgtctgttcatatcctttacccactttttgatggggttgtttgtttttttcttgtaaatttgtttgagttcattatagagttgtttttttcttgtaaatttgtttgagttcattgtagattctggatattagccctttgtcagatgagcagattgcaaaaaatttctcccattctgtaggttgccggttcactgtgatggtagtttcttttgctgtgcagaagctctttagtttaattagatcccatttgtcaattttggcttttggtgccattgcttttggtgttttagacatgaagtccttgcctatgcctatgtcctgaatggtattgccaagttttcttctagggtttttatgctttcaggtctaacatttaagtctttaatccatcttgaattaatttttgtagaaggtgtaaggaagagatccagtttcagctttctacatatggctagccagttttcccagcaccatttattaaatagggaatcctttccccattgcttgtttttgtcaggtttgtcaaagatcagatagttgtagatatgtggcattatttctgagggctctgttctgttccattggtctatatctctgttttggtaccagtaccatgctgttttggttactgtagccttgtggtatagtttgaagtcaggtagcgtgatgtctccagctttgttcttttggcttaggattgacttggcgatgcgggctcttttttggttccatatgaactttaaagtagttttttccaattctgtgaagaaagtcactggtagcttgatgggaatggcattgaatctataaattaccttgggcagtatggccattttcatgatattgattcttcctacccatgagcatggaatgttcttccatttgtttgtatcctcttttatttcattgagcattggtttgtagttctccttgaagaggtccttcaagtcccttgtaagttggattcctaggtattttattattctctttgaagcaattgtgaatgggagttcactcatgctttggctctctgcttgtgtgttatttgtgtataagaatgcttgtgatttttgcacattgattttgtatcctgagactttgctgaagttgcctatcagcttaaggagattttgggctgagacgatggggttttctagatatacaatcatgtcatctgcaaacaggaacaatttgacttcctcttttcctaattgaatgccctttatttccttctcctgcctgattgccctggccagaacttccaacactatgttgaataggagtggtgagagagggcatccctgtcttgtgccagttttcaaagggaatgcttccagttttttcccattcagtatgatattggctgtgggtttgtcatagatagctcttattatttttagatacgtcccatcaataccaatttattgagagtttttagcatgaagggttgttccttaattttcaacctatccagcataacctggatttaggcttttctgaataaatggctttgagcagtaagttttgatctctttaaacaataatcatttgcttcagtgtcctgaaagcaggatggactgcaagagacaggtgtaccagcaatcccaaacaaggagaatggtggttgggtgacatcctaaagttttcttgtctctttcaaagaccattctccagaataacacttgtcagtaaagacataagacccctttttctcctgactcacccaaccctaggtaaaaaaaaaaagttcccccaaaacacgatagggaagcccataaacaaaagaggatcctttattttagtcatctcattatttggcttccacagaatccagtggatctcaatgaaggcttaaatggcttccaaataatgagatgtccaaaagaaggagatgtattggagggtcatcagaggttcatgaaaattctgcaagtttgcagaactgatctgtggcttgaggaggctctaaggcaggagtgtccaatcttttggcttccctgggcaacattggaagaagaagaattgtcctgggctacacataaaaaaaactaacactaatgatagatgatgagctaaaaaaaaaaaaaatcagaaatttttatgttttaagaaagtttatgaatttgtgttgggccacattcaaagctgtcctgggccacatgtggcctgcaggccgtgggttggacaagcttgctctaaggcaattccagagagccaggactcagggtgcctcattgtaaggcagggacagtctgtcacagaacctttcctggactgagtcaccatcaatcattccttctgctttttttgtcacttactcaagctttaaactggacaggaagtccaaatgcctgagtttaagtaacataactgttcagcctagtccaactttctaattgattcttttggttataaggactctattaagttcttctttttaaaggcaagagctaaagattcgtacttttgtttcagttgccttttattttgtttcagttgccttttatttgccatcaatatgcttaaacatttattttgttggatcaataagtttgcagataatgaactggaaatgtgtgtgttcaatgataataaataatccattactaattaattctcctgaattagaattcagttattgatgttagaagtaagagtttttgccagtcactaaagataaaatcgttctccaaaagaataggaataaaaatgtcattctttatagtttttttaaccacttttttcaaatgattatggatggcaaaaaatcatgtttcactggtttcacgtaatcttctattaaaagagctgatttgaaaataccaaaaaaaaaaaaatagtgggaggattacttaaagccaggagtttgagactagtctaagcaacaaagcaagacaccatctcttaaaaaaaaaataaaaataaaaaacattagcaagacacagctacttgggaggctaaggtgggaagatcacttgagcccggaagtttgaggctgcagtaagctatgactgcacgactgcacttcagtctgcgtaacagagccaaacaaaaagaaagataaagaaagatgaaagaaagaaaaagagagaagagagagaaagaaaggagggagggaggacagaaagtgaaagaaaagggaggagagagggaaagagagagaaagaaggaaagaaaataaagaaaaaatgaaagagagaaagaagggagggagggagagagggaaagaaagagaaagaaatgaaatgggaagagagggaaagagggaaagagagaaagaaggaaagaaagaaaaaagaaagaaaaagaaaatacaacaaaaagaaagaaagaaataatatagcatgacagcttcaagcttctatctagcaccactcatgcaattgtaggcaatatgaggctggagacatgttttagcttcaagcacaacactgcttgctgtccaacaaatagtaaattgtcctaaattgaattgaattgaccctaaaatgctgaaccaagagaaaatactgtctttctgtggttcctcaaagcagttctgaaagaaacgttcgtttgggatcaaatgtaacttgccacttgctccttgtccaacaccaggctctcagagttaaagtaaaaattcaggattatcccttctgattcccctccatcagcactagacttaattatttataagtaatttgttggaatgtcagtgtttaagttttaaagctagtgatgattagtgatttgatacataataatgtttaataccaacaaaggagtaaaatgtttaagctattcgaccccctgtttttctttttctttttcttttttctttttttttttttttgagatggagtcttgctctgtttgcccaggctggagtgcagtggtgcgatctcggctcactgcagcctctgcctcccaggttcaagcgattttcttgcctcagcctcccaagtagttgggactacaggtgcatgccagcacacccggctaatttttttgtatttttagtagagacgtggtttcaccgtgttagcccggatggtcttaatctcctgacctcatgatccacccacctcagcctccaaaataaaatttcaaaaatgtcatgtattgtccatgatctcattacaattcactctcttacttttttattcttagtgttaaaatcggcatgaagctggtaggatccactattcagtgtgttttgtagagatggccaattgttatgtctgaagaacttgtcctccggatctctcccatctttccttggcctggcaagagtggagggcctggcaagagtggagagcctgccacagtagcctttagagctaactacacaatactgcaatctgataaatagaaaccccactgccttttacccatcttcctctatgactttcagtactttccaaatggtgtggactatgaaaaaaaataaataataacaaaaatgtggttacatcagacacaggtggaatgagagggagctttattaaataagagcatattaaaatgtgttaaaataaatatcttttaatttgaacattaaattttgtcagcctgtagcatgtcaattcaacatatctgttaaaaatgagatttttaggagctttcctgacatgtgtaattctaagaggttgcgaacagtattccttctcagaagcatgtcctctgtaatcatattacctggactaaagacagaggcctggtgctgagacttcacatttttattttggcattttaaaggctgcatatgtcttctccctgtcagactcttctccacttcgttttactctgcctcctggtttcctttcttctgtcacgtctccttagacaaagttccacttctcatttccatgaatccttggtctaacatcagttgaacattctctgcagtgcctggggctctttggaaaagagatgttatagaaatctaatgaataaataaaagactagctcataccctcaggtccttgtgttgcctagtgctgatgaagttagcaattttctaggatttgaataagtatattactgaaatgtagactatgaaacagagtaaacttcatttaaatgaggagaggctactgtggggtaatttcaaccacagtaaggccctaatcacatcttctgtgtttattttttcttcttggtaaggtatatgtgcccagttctaggtctaatattgttgttcttaagacattaaaatgtattttataaaccttcattcactctgtctgcattgcacagaaaacatatttttctgttggcaaaacacacacatagttaggaagcctgtgtgtttatgtaattatatttgggtttctggtgaaatcctctaaggacacttgattgatttaaaataaatggaatatcatttgtaagcttaagggaggcttggagagttagattcagtggtgtgctgagaactgactctagtattattacaaaaagaacatagtcattgcaacatttcaactttgttgatcccttaatatcagaaattctccacttaaacatatattctgatgtcaaaagattagaaagaactcgtttcccccgcgattttggcccaacacacaaggccttttaatcaccttagcacaggacagtgatctctttggaaaatgacaagttagttcattcctgcttctttccactggtgctggagcaacagggagaatggtgcaaattgcactctgtgaaataatgaagcaaataatgtctcttcaaatggaactgagcatatttacatctagaaatatgttctatatgaatgcttttattgtgcaaaaataattcactgacatggagataatgcagagtggagagtggaggaacagggaggattttatagacactcccattgagacagttttcctgaaatgagtcaggtttggtcttctaagctatatggatgatgtattttattggcttcactgtcattctaataagatgattttggtctcagatgtatctttttttttttttttttttttggtaaagccagggtctcacttgatcacccaggctgaagtgcagtgtgcatgatcatagctcagtacatcctggaactcctggcctcaagtgatcctcctgctttcgtcccttttgccaatggcataccaattttttagcaccaacagctcattaccacattggctatagacatttccaaataagcatcagaagccattggccaatatatttttaaaagacagataaatctaagccatgtatggtggctcatgcctgtaatccaagcacttttggaggccaagacaggaagattgcttgaagtcaggagttcacgactagcctgggcaaaaaaaaatgagaccctgtctcttcaacaacaacgacaacaacacaattagccaggcgtggtggtgcacacctgtagttgcagctactagggaagctaaggtgagaagatcccttgagtccaggagtttgaggctaaagtaaggtatgatcgtgccactcactccaccctgggtgacagagcaataccctatctctaaaaaaaaaaaaaaaaaaaaaaaaaagtggggtaggggtggggcaaaatttaaaacatttaataaatttttttaaaaatctcttgggagtttaaactgggagacagaaggcggcaattagttggagtcagggtgaaaggttgaatatagaagtcctaatatggttagaacatggtaagctatagctgggagggattgatttaaaaccatgctaagcatgagctataagataaagacaatatcaacaagacagagagttagcaaggtgcagttgaacaaggaatgtagttcagtcacaagtatctcatatactatgatgaattcatccctccctccctccctccctccctccctccctcccttcctctcttcttctgacacctacttattgcccacttactgtatcccagcaggcagacatacaatgacagacacagttgcagctatcattatgaaagttccagtcaaatgaactcgatagattagtaccacagcctagttctaaccttggccttgttctaacctagttctagtcatgggataaaattaagacagaatcttagggtatacaacatagacagtgacacagaacaaatctgaaataccagagagaactgagaagcttcagaacaacagcttcatccattctactctcagcaatcccaatccactcttaatgcaacatcgtaaacatataattttgcagaaagagatcattgctgtcacattttccccgtaccctgagagtccataatttgctctttaatatcataaacaggccaaggtcagcctccttgggatcttgtgccagatctaaacaactcttacatttaatataaacctgatgaattactggaagtgcactcaatatctaaaataatgtgtggcacatagtagatgatccttgttgcttcagaatatttatggaatgaatgcatgaataatgaagctcagaaagcaagcagaaaacagatcatgcatcttagaagaagactgcagtgttgcagcagagtggaaagcctcaggccattgcaataagagtatgcattctttgaggtatataagccatggaaacttaaggacaaaaatatctgcaaattgcattcctgtttctaatgtcaagatttcaagaagtaaaaatgatccttttaagtgtaataggcttcttacaccaagaaatctactgaattagccatctttccaagagtgcaggttgaacctgaaattgcccattagaaagtaaaaatatactgaatcaaccttaaatccagcttttgtctatttagatcccattaagatggcaactgaacatttatctggataatgcaatcaatgcagagagtcagttttggtacttcaggcccatgttttttttttctctctccctcttttttttagaactagggtcttgctctgtccctgtgttccccaggctggagtgtagtggtatcatcaccactcattgcagccttaaacttttggcctcaagtgatacatctgccatggcctcccaaacactggaattccaggtatgagcaacaggcctggccctaaagcccatgttttctatggtaggttttttaggttttcattttccagttaactacctccactctcccctgtagtgatttgctatggacacaaatttgttttcttgatgaacagacaattccatcattggaaatactttgctaaagagaacaatagttacaataagcataacatttattaaaaccggctgtattaatctgttttcacactcctataaagaactacctgagactgagtaatttataaagaaagtttaattgactcatagttctgcatgactggggaggcctcaggaaacttccaatcgtggcagaaggtgaaggggaagcaaggcacgtcttacagggtggcaggagagagagagagcacatagaggaagctgccacttttaaaccatcagatctcttgagaactcattatcctgacaacagcatgggagaaactgccccaatgatccaatcacctctcacaaggtccctctctttacacatggggattacaattggagatgaaatttgggtggggacacagagccaaaccatatcattctgcccctggcccctcccaaatctcatattcttttaacatttcaaaacgcagtcatgcctttccaacagtcccctaaagtcttaactcattccagcattaatccaaaagttcaagtccaaagtcccatctgagacaaggcaattcccttctacctatgagcctgtaaaataaaaagcaaattagttacttccaagtacagtgggggtacaggcactgggtagatgctcccattgcaaaagggagaaattggccaaaaaaggggctagaggccttgtgcaagtccaaaacccagcaggaaagccattaaatcttaaagcttcaaaatctcctttgattccatatttcatatccagagcacactgatgcaaggagtgggctcccacagccttgggcagctccacccctgtggctctgcagggtacaccccctttggctgctttcgtgggctggcattgagtgcctgcagcttttccaggtgcacagtgcaaactactggtggatctaccattctgagatgtggaggacagtggctctcttctcacaactccaataggcagtactccagtggggactctgtgtgggggctccaaccctagatttcccctccgtactgctgtagtagaggcttttcatgagggccatgcccctgcagcagaccctctgcctggacgttcaggctttttcatacattccctgaaatacaggtggaggttcccaaacctcaattcttgccttctgtacacttgcgagtgcaacaccacatggaacccaccaaggtttagggcttgcaccctctgaggcaatggcccaaactgtcccttggccccttctagccactggtggggctggagcagctggcacaaagggctgcaagtcccgaagctgcacagagcacaagcagggccctgggcccagcccctgaaagcatttttcctcctaggcctctgggcctgtaacgggaagggctgctgtgaatatctctgacatgacctagagacattttcccaattgtcttgatgattaacatttggctcctcattgcttatgcaaatttctgcagctggctttgaatttctctccagaaaaagggtgtttcatttctactgctggtcaggctgcaaattttccacacttttatgctctgcttcccttttaaatgtaagttccaatttcaggccatctctttcttcacacgagtgtacacttttagaaaagtcaggtgacatcttaaatgctctgctgcttagaaatttcttctgccagataccctaaatcatctctctgaagttcaaagtttcacagatctctagggcaggagtaaaatgctgtctgtctctttgctatagcatagcaagagtgcctttacaccattgttaataagttcctcatctccatctgagaccacttcagcctgggcttcatcgtccatatcactattagcattttggtcaaaatcattcagtaagtctctaggaagttccaaacttacactcatcttcctgtcttcttctaggccctccaatctcctccaatctctgcctattaccaagttccaaagtcacttccacattttcaggtatctttgtagaagtgtcctactctcctagtaccaattttctgtattaatccattttcacactactataaagaatactggccaggtgcagtggctcatgcctgtgatcctagcactttgggaggccgaggcgggtggatcacctgaggtcaggagtgtgagaccagcctggccaagatggtgaaaccctgtctctacaaaaaatacaaaaattagccaagtgtggtggcatgcatctgtagtcccagctactcgggaggctgaggcagaagaatcagttgaacctgggaggcggaagttgcagtgagccgacattgcgctactgcactctagcctgggcaacaacagtgagactcttttttggttccatatgacttttaggattgttttttttcaagttctatgaagaatgatggtggtattttgatgggaattgcattgaatttgtagattgcttttggcagtatggtaactttcacaatattgattctacccatccatgagcatgggatgtgtttctatttgtctgtatcatctgtgctttcttccagcagtgttttgtagttttccatgtagaggtctttcacctccttggttaggtattgtcgtaagtattttattattattatttttgcagctattgccaaaggggttgagttcttgatttcattatcagcactgttgggatatagcagagctactgatttgtgtacattaattttgtatcctgaaacttttctgaatttatcagttctagcagcttttaggacaagtctttagggttttctaggtatacaatcatatcaacaacagacagcggcagtttgacttcctctttactgatttggatgccctttctttctttcttttgtctgattgctctggctgtggcttccagtactatgttgaatagaagtggtgaggttgagtgtccttgtcttgttccacttctcagggggaatgtttttaacttttccctgttcagtattaggttggctgtgggtttgtcatagatgccttttattgcattaaggtatatctcttctatgccaatttgctgaggattttaatcaaaaactgttgttggattttgtgaaatgctttttctgtgtctatttagatgaccatgcgatttttgtttttaattctatttatatggtgcatcacatttattgacttgcgtatggtaagccatccctgcaaccctggtatgaaacccacttgaacaggttatatttttgctatactgttcaatttggttaactagtattttgttaaggatttttgcatctatattcatcagggatattggcctgtagttttattgttttgttatgtcttttcatgattttggtattagggtgatactggaagccacacgcttttaaaccatcagattgtgtgagaactcacaagggtgagaacagcatgaggaaaactgtccccatgatttaatcacctcccactatgtccctctcttgacatggggggattacaatttgagatgagatttgagtggggacacagacccaaaccatatcactgtctgtgtgccagtcatattccagggtgccatatatgtttttatttaatcctctggacaatgctagatgattacctttagtacattgttcaaagtcaacattgaggaagtggtggaagtggattttgagtcaaggctttttgactcaggacctgaactctttacagctcactgtagtgggttgcattgaggcccccccaaaagatacatattcaagtcctaaactccagtacttatgactgtgagcttatttggaaatagggcctttgcagatgtaattaaatacagatcttaagatgaaatcatcctggacttagggtggattctaaatccaatgactggtatttttataaaaagagagacagagaaaaaggcctgtgaagacagagccagagatcagagttatgctaccacaagccaaggaatgcctggggctatcagaagctggaagaggcgtggaaaaattcttcccctttacagcctttgaaggaagtgtgtccctgtcaacagcctgatttcggacttctggcctccagaactgtgagacaataaattcctgattttttttaacttttattttaggttcgggggttcatgtgaaagtttgttatataggtaaatttgtgtcatgggggtttgttgtacagattatttcatcacccaagtattaagcccagtacccagtggttatcttttttgctcctctccctcctcctactctccttccttaattaggctccagggtctattgtttccttctttgtgtttgtaagttcttatcatttagctctcatttataagtgagaacatgtagtatttggttttctgttcttgcattagtttgctaaggataatagcctccagctccatccacgttcctacaaaagacataatctcattcttttttatggctgcatcctgttgtttttaagccacacagtttttggcacattaaacagacaaccaataaacactgcatgactgaacaatagagtgaattgcttgaggactcagtgagtgacaatcaattctctgggtcaaaccacagaattctagaaatgtagtgttgtggtgagatattaccaggtgggtaaactgagctataaaagaattgaaaactggccaggcaaggtggcttatgcctgtaatcccagtacttggggaggctgaagcaaaataatagcttgaagccaggagtttgataccagcctggacaacatagtgagagtttgtctcaaaaataaataaataaataattagccaggaggttaaggctgctgcagtgagctctgatcatgccactggaccacagagatagagacaccgtatcacaaaagaacaagaagaggaggaagaggaaggggaggggagggggaggggagggagaggggcaggggggaaataaaaatgtcctcccaagcacacttgtattacaggtccaaggtcgcaaggtgagttaaaagcctaacctcctgatccccactacttcccacccaccaccaggtactactgtagctgtgttcttagagtataagtcagataaaagtaattaaatttgagctgtgtgagaacttcataatggaagcagagtagaaataggctaggcattgcagcagccgagctaaaaaataaaaaaggtacaattaagaatcccttaactctagtgtcagttgcaaaaactctcccacagtcttgaaggctgcagagtgggaagctgatgtgtcaacgcttttctcttctttgcttatctctgccaatttgatattttgttcgtgtaggggagcacgcctgccctgaatgtctccacctctctgcctttgcccacgctgtaccctgctttgattgccctcaccttcgtgtctgcatcctaccctttttaagacttagctcaaataccagctctcctttgactccttgagctgtactcatctgtgttccccaacacttagagatttcagcacttcctggatcttgcttactgatgctgacttcatgttgaactagccacagaagccacagattaagttccatataatttctctgagcctcactttgttcaatctttattcattcagtcatacaatcatcaatattttgtgagtaaactaatatgctccaggtcatgttcataatgctgggaaatgaagggaaaagacagctggaaattatattggagatagggagaggcagataataagtaagtaatagatgttagactatcagatagtgacaagtgttatgaagaacaaaaacagggtggctagaggggatggggccaatgtgattaagggttcaaagaagggttcatggaagaaaagatgttttaagtggaacctgggtaaaaaagcagagaccatgttgagaagacctgaatgaaaagcactcccagcagcaggggggagcagtggccccaggatggagaaattcttgggttattcaaggaagaggagggccagtataaacaaatgaaagtgtgacgggataagagctactgcagatgggcagggcacagtggttcacacctgtaatcccagcactttgggaggccaaggtgggtagatcacttgagctcaggagttcgagatcaacctgggcaacatgatgaaaccccatctttccaaaaaaatacaaaaacatacagctgggcatggtggtatgtgcctatagtcccagctacttgggaggctgcagtgagaggatcacctgagtccaggaggttgaggccacagtgagccgagccatgatcctgccattgcactccatcctgggtgacagaacaagatcctgtctcaaaaaaaaaaaaaaaaaaaagaagagttattgcagatgaatttgaagaggtagacagaacagatgctgaaggacctggtaggctgtggaaaagatattggattttattctaaaagtgatgggaagctcttggaatgttccaaacagggtagtgtcataatcagatgtactttaaaaaattgtcactctggctgctaagtggagaatgagtaagaggtcaagagtgaaagcaaggagaccatctggagactattgtaatagtctaggtaagagatgatggcttcttggagccagggcaaagcagtggagttggagaatggtatcagatttggggtacactttgtgggtagaactgacaagatggactggaggctgaagaaagggtcacttagggattactcctagggttttgtctctagccaattgagctgctatttactgaatggaaactaactccacacacctgtgctgtcatgatccaagcagtatcaaccctcagatttgtgaaatctgtttttgtgagggactagaatgtagctcttgtttcatttcgtggctctgccacttcccagctttatgtgcctttgggaaagtcaacttctccatggctcagttttttcagctaaaacctgaggagcagtacagaatggttattatgatgaggatttagtgagctaatgtatgtaaagtgcttagtgtgtttcctgggacattatgcattcaaaaatggtagtatagtatagtcatttgccacataacaatgttttcatcaaggatggaccacatatacagcaatggtcccataagattataaattcagtgtacctaagtgtgcagtgtttataaagtctacagtagtgtacagtaatgtcctaggccttcaccttcatgcacccactcactcactgactcacccagagtaacttgcatttgtgtaagctccagtcacattatgcgccccaggtaagtagaacattttttatcttttgtactgtatttttactgtaccttttcaatgttttgatatatttagataaacaaatactactcattgtgttatagttacttgtagtattcagtttgggtttgtagcctaggagcaagaggctacacaatatagcctaggtatgtagcaggctatacactctaggttagtgtaagtatatcctatggtgtttgcacaatgataaaattgcctaatgatgcattcctcagaaagtatccccatcatgaaataacacatgactgtagaactagtcatttctgtcatcattttttttctctctttttcttgaaggagtctcccagctctttaggatcccagtgcccccacattgcttcttctgatggtggctctgtactccctattacagtgcttcatctaaacccccctccctctcacaaacctctgtaaccccttatcaaagcttgtttatctcatggctagctctgtgtcatagggttgaccttatcaattctacttgtacaattttagaagaggctgtcatctcattcatcagcacacaagccggaacttcagattttgataagacaaaaaaaaaaaaaaaaaacaaattcttatgaatttggaaacctgaagtttcaagaatttaggagagtagtgttgggataaaggaatgactcatttactattttcactattttaaaaaatggactgggaatacaaccttgaattccagtgacaccaaaatggccctgtgaactagcaaggctgtgtgcatagtaatcacagaataaatacctaatgaactggtttgaaataaattttaataaagtttttagtatctttttgcactgcataattgaacaatgatcaaagaataggtaggataggtaggactacaaatattcaaacaagaagggagacttcatttgtactaagtattagggcaaactttatcctgttgctttacaattttaattttcttgaagccttgagtcaacgttatttaatatcatagacatagtgtttttggcatattccccatgatgaattacttatctgcataatttataataatttctactctcatgaagaataaatggtaattaaatgaggttctatcatttatcttgcctttgagatttggtcagtgtgagtgacagttaagtctcgtcactgtagctaaagctctgcttactgaaattccagctcagttaccacagtcgtttggtgattgtaccccatctaagataattagttcatttcttggaagtcaaatggggcttggagtaaaattggaaactctgaaaatgttgagttcaaaatgtaaatgactttttactgataactaccaaaagtgaagaatgacaagtaaatgccttacctaattaggaaattttttttactttataaagtcctccagatttaaaattagactgcttgtcagcctatgggaattggttgagtcatgtggaattctaatacaatagaatctggatttgggcttctatatttagcctcactcaaattcagtccttttttatttttacatacatacaacccaacttagcaactggtaatgaccgggtagaatgagagatatctaggatttttcttagattgcaagaagggcctacagaattatctttctcagctaataaattctgatgtggctgaaacttgaatttgacattttgaatggttagtaagatccacgtggacaaagactaagccttcgtgacccctcactacctccataaccttggcttgccatcttgaaaaccaaacaattgtcatggcagttcaagtccttttcagaaagcttaaactaatttaataatttaaatacatttttgtgatctataactactaatgaaaaaacattcaatacacatgtattggttacaataatgggtctttagctttgtctttatttaggaaagactatctactttaggtgaggttgagatggtcctgcattctatcacagagctgtggtgccagatcaaatgaatggtaaatggaatcagacatggacatgtacagtatgatctttctgagtcaagcattccctgctacattaatggcataatttagaattatttgggttgttttatgaaatgcctccttatttattagtcatttatacttcacagtaaggtagggtaggatttcaaggtgacaatatgattatgataatcaaataaatacacagggtatgatactattgctattgccagcatataatatggtcttgtgaaagctctgaatggtacaatatgcaatatttatttgatttctaatcccaatatcgtttttaaataaacaaatcttgaccacatgggaatgctgcataaaatttataaggactctttttttattttggtaacagagctctttgttttccattttattctaatctaattattttacctggtattggtgatcatttctcaccataaagagaagctcacatgtctgaaacaaaaatcttaaatttggtggcatcatgcagatggaagatggaaatacttctaaaattgaggagcatggacaggaattccacaagatgatctcagctttggattgccaaatagagaacacacaagcctcagtttgacagaccaaattttattcttgaatcaaatgaatatgctgtttgctccttgaacatattttatattacctattcatttaaaagattggactagtattatcggatacccttaaacttgggtacaaaagtagtttccctgaacattaataattaaccctttcactcgaggcatggatgaaccaggatgaatagcaagaaactttttttttttttttttgagatggagtttcactcttgttgcccaggctggagtgcagtggtgtaattgcggctcactgcaacctccgcctcccaggttcaagcaattctctgcctcagcctcctgagtagctgggattacaggcatgcgccaccattcctggttaattttgtatttttagtaaagacagggtttctccatgttggtcaggctggtctcgaactcctgacctcagatgatccacccacatcggcctcccaaaatgctgcgattacaggtgcaagccactgcacctggtcagaaatggttttaagaaataaagatatggaaaatatttattggaaataaaataaattctatactaaatcattggataatctcttcaactgaaacacaatctgttttgttttttgtttttgtttttcttggctgggccgccttatagatcttagtttctaagctttaccctgtaatactttcatctaaagatgtccagcatgtcactgacaaagatactttatgcttccactaacaccttcttctttctctgcagatgtgtatgtatgtgtcttttaaattctcagtccttaaaaactttgtcagtctactcaactagccagaaagaatatctgtttccaattatcttctttatctccaaccctaaattcctggtaccttcctgttacctttgccacctggggcttctcaataagttccaatgatttcaagcaagtcagcaaggctcccaggcatgctgccttacagatcagattaacctggcttcaaacattggcactgccacattttagtttggggactttgaacaagtcactttaatctccatgtgatatggttaggctttgtgtccccacccaaatctcatcttaaattgtaatccccaggtgtttaggaagagacctgctgggaagtggttagattataggggcagtttcccccattgctgttctcctgatagtgagtgaattctcatgagatctgatggttttataaatggtagattttcctgcactgacacatgctcattcttgcctgccttcttgtaagatctgcttctcctgtgccttccaccataactgtaagttttctgaggcctctccagcaatgcagaactgtgagtcaattaaacttttttcttttagaaattacccagtctcagctatttctttatagcagtatgagaatggactaatataccatgcttcaatgtctttgtcagtaaaaaaaaaaaaaaaaaaaaaaaaaaaaaaaaaaaaggaaataataataatccctactttattgtaaaatatctaaaacactaagaatatctgcctgataaattttagctcttcatctaaaagtgttattatttttaagcatttccctggcctaccccaaacttcacagtatagtggagcatataaaaataatgtaataataatgcctaacatttattgagcctttacaatgtattaggctgttctaagcatattaaaagtactgacttaatttttactattcttttaagtagttctattactattcatatttatagatcaggaaactgagcctcagaaaagtcaaaaactcgtccaagttcacatggttagtaagtggtgaagccaataattaaatccaggcagtcatttgctaagctgcccaagtatgcagttgtgaaataccagactagaattcagcactcttgggttcaggccccagattggtcacttgcgaattaccttcagtaattcactggatctctctgcgtttcagattcttcatctctaaaatgagataattgttctttacctatctacagaatgtggtaaagatcaaattagagaaatcacgagtacttggctagcatttgcaagtaattactattattattaacttcaaataatgtttatgaatgtgtttcataaattctggaagacctatttaaatgtagagatgccactgctgctgatcatgatggttcccaaagggttttgttcactacaaaagattgagaaatgaattcatgctaaagtattcttaggtcttgggagcttaggataccatacctgtttttttatttgtataaatttaaggggtgcaagtgcagttttgttacatggatatattacatagttgtaagtctggccttttcgaatatccatcacctaaataatgtacattgtacccattaattaatttttcatctctcacttacctcccgccctaccaccctttggagtctccaatgtctatcattccacactccatgtccatgtgtgcacattatttagctcccactttaagggagaacatgaggcacttcactttttgtttctgagttgtttcacttaagataatggccctccagttccatccatgttgctgcaaaagacataatttcattcttttttatggctaaagagcattccattgtgtttatatattttctttatccagtcatctgttgatggacatttaggttgattccatgtttttgctattgtgaatagggctgcaataaacatatgagggcagatatctttttaacataatgattttcctttgggtagatacacaataaggtgattgcttgatcaaatgttagttttgttttcagttctttgagaaatattaattctattttcccatagatgttgtactaatttacattgccaccaacagtgtacaaatgtttccttttctccacatcctcaccaacttctgttgttttttgactttttaataatagtcactctgactggtgtaagatggtatctcattgtggttttaatttgcatttctttgataattagtaatgttgagcatttttttcatatgcttgatgtccatttatacatcttcttttgaaaaatgtctattcatatcctttgcccactttttaatggggttattggtttttttgttgctattgttgtgttgtttgagttatttgtagattctagatattagtcctctgttggttgtataatttgtaaatattttctcctattctgtaggttgtctgttcactgacttctctgctaatgacatagtatttggggagattccttcactgcacaattcaatggcaaggactttaggggctagggttcctgaaatcatgccactgaagcgaacatcttctccacctactggaaaaaatttgtttgagtcttgctgagtagtgtcaaaagccaagatgatgaacaaagtctttctatggggaattattttttgtaaatcataaccactgcaacgatcctttcacaaccctaatctttgtgacctatcttcttgatccatatccttcagtgtgtgcattgttttggagataaaaatccaaaatccacatcctggcctggatggtcaggcatggcccagtccctgtctcctgctttagtcatagcatactcctcattttctgccctagccatatctgtcttcttataaatcctccccatagggccattgcatgtgctgatctcactgcccagtacattcttgaccctgtcctctcccccttcttctagttaaattagctcatgtccctttctcagaaaagcccccttgacctttatgattcatcagagcttatgatttttttactgaaccctgaaaatctcctccccacaactctcaatgcaactatacattcattgacatgattacctgactgatgtttctcctccattagactgaatgcttcaataaacctatcaaaggaccaagagctttgtgatcatatgtgtttaatgcatgaatgaatgggaatattcttccaccttcagtgatatcttctccagtctcatttaaaagacaaataattgaagccaaactcccctgcttttcttcctcttgaatatgctatatttttttctggaaaaggtggaatttgagaaagtaaagacaaatcatataaaactttctaaggcttcctgaaaaagaaataaacagtaaaagaaaagtgatacttttcttcctttgtatagaaaagttgagagaggaaaaatataaaacgattaaagagaagataagtaaatctaattacagtgacttccaagaagctggcaattgaaacttctgtttatgaaggaactggaacaagaggagcaataagcataatgggattgtgagttttgatgaaaaaatgtaaggagaaagaaccaatgtttctttctttttcttttctttttttttttttttggcgtggttttaaatttgatttaacactgtgtcatagttgctgtttcttagaagaatgtctttctggaatttgcttatctttcctttgtgttaataatgcctcgccaagaggttatatggcacactagtgtggggtgggggatttggagtctgatctacgtggaccccgactggttctgacactcactagctatgtgatccctgagaagttacttaacacctctggaacctaccttcttcatccattaaatggggataatatcagtgcttatctcatggggttattatgatgtatcagtgagataatgcaggaacaccttggcacattgcctgacacatagtaggcacttaataagtattagttgtcatcattactattggtgatccatggttatctttcaatattttaatctaggagctttggtttgcagatgactgtatggatgtattgttttaataatgctgcaaagtctttcagaacaggatccatggcttatgccccagggaatataccagttaaattacctttccctgaatctggaatccttcacctctctcctttatttactctgaatgcctaagagaatcttctttttctggcttacttattgcatactaataggagaatataaacagagaaacctagattactctaagtggtgtgggtgattcatctgaagattcacatgcatgttcacatgggaatacttatggatagaacatattgtcattatctaatccagtaaaagattaaggacaatgcttcactcaaaataatcatgggatacagttggaaatcacctcagaaatcactcagtctactgtttccaaacctgtctcaacgtaagagtcacctggaaagctttcaaccaatacagatttctaggctgatccaaatttactgaatgtgattttcaagaaccaggcaacatgaagttctacacctctccctgggtgattctaataattagtcagggttgggaattgctagtttaaaacagttggcaaatggtgtcatcccacttccaacactatggattaagggtagcccccagtgtgttggaatgagaagcattctatcaggtttctgggttcaatgagaaagtgtactgtaatctgttattaatgcttcatatggtctttgttaggaggatgatggtacctgtgtcctgtacttaccagtacagatctagttcaatacccacagtttcaagatgtaggaagagaatcagagggggaaaaacctgacttactctcttagttggctttagcaacttaacaaactattccaacattattgggttaaaacaaccaccttctatttacctataattttatgggttgtctgggtaaattttgtgacctcggttggcttgacttgggctgtgtcatctagaatagcttcattcacattcttggcagttggaagaatggatggtccattgggcatcattcactcagtctggctataggtttaaattcagcatcatccagcaggctagtctgaattgctcatacatggcagaatgggtctcagcagccagagggagcagagtccaatgggcaagcacttttcaagcctctatttgcattgttttgctaatgttccattgattgaaccatgacatgatgcttaggagaaatagatttacacctcttgatgtgataacatcacattacaaatgagtatggaaacagaaatgagaggactttatgatcattttgccatgtatagcacttgtccaaaatcacacattttgtttgtagaagacctaggactagaaatccattgcttacttctcaattcaaagtagaaacagaaaccaaaggaagtgtcatgcacatatagcctgtggtggacatttggatctcaaaagtaggacaggcttcgcagagctggggctagacagcagccaatcagattgtaggatgtaggacttgtcattcccagtgacaatttcaaggaagatcttcaatgggtcataacagactcaggataatttaaaccgaggtcatatctaaggaggttaagcctggtgagtagcgtatgacaatagtagaatttcaggctgtgacttcttggagccatagggtgacagcatcaagattccaggtggtcccaaatcctgccagtaactgggtgtttagaatggtgtcagcctggaaaataagacagagactattgaggtctatgtaggttactgagttgagggtaagttcctcccagttactttcaagggaggtgcttcctatagactatgatgggaactgcatattctggaatgctgatgtgcaacacaatggctctggtttcctcttccaacaagggaattgtagtgcaatcaaaaacatagaacattgtcccagtcagaggaattgaatgaaatctctcacaacaacgaaaatagcccacagcccattttcttcaagtagtttgaatgtaacacagtatgcactggtttggaagctaatacaaatgataagagctgccattcatcaagcacatactatgtgctagacaccatccctagcactcacctctgagatttatagaagattgattttttgttgttgtttaaacacattttctagatgagaggagtaaggctcagagaagataatgcaactagctagttcatgaaggcagttggctgccaactcaagtctgtctgatgccaaatcctgagctctttcttccagggcgtctttcttaacttcgaatgtactttcatgtgactctctatgcctgaatttgaccatcacccatgaccattaataaccctctctgtaaggtaaagtcaaccattttctcttcaaacatagacacctaagtagcttgcaaatatattactttggctttcatttaggagagtagatgcacaatattttattaaaatcatgagtcttagaaaaaagttaaaagaaaaagctaaataacatttttgcccagttacttggaaatcaggcaattatcacatgattactcaggctggtaatgaaattaagataaagtttcatgaaaatagcatatgcaatttaacagccacaacagaatttgtgtaaataagagcagatgtgtctgaatctcttggatttataaatacagaaacattgttcctttgggggtaaaaaatcattctttactctggatgtgggaagagtatgactcagggccctggtggtgacagagaaggtggggattcatagctaggaggcccctgcattcctgtagcttccaacgcagatgctctcacctgggagaatctgtatctttccaacagcaattatatacactggggagctgagacgaaatggtgaaatatgtatcgggctcagcatagggatttttaaatctggataacactggtttttctctcctaagaaaagaagcaaattcatactaaccacggtttgggttcaaaatacaagcaagtttgcagctcccaactctatatcaaaggtaggtttataaagggcaaacaatttgtctaaaactatcctttgccctttgcccccttgaacttgtctccttagaaaagagtgggcagctaagccattatccttcttctctgaaaaggtctaaggaggaagaaaggcagagagagagcgcgcgcgagagagagcgagccttgagtttttactgtaaagaccttctttcttggaggcaccaggaagaatctgtttctgatcagaaaggccaaagttgtaacaacctgtagtggttaagagcacaagctcagaacagccttgaatgcattacctgacagctctatggcttcttttctcagctataagatggcactttgtgtatgtgatgcacaatgcatgctggagaaagatgagccattagtatgtaggtgaactgggggaaaaaaaactgctaaaggtggaagtcctgatcacagaaccttcctgtgcaggtgctctgtcctcactgtctggagcctcctccaactccctcttcaacaggagcttggcagaagaccagagaagctgagtcatcctcaaggaggagtttttttcactgcatccactataagcagttctctagtggaaaaaaacagggctttagcataagtcctgagtacgggagtgggagaatgggcacttgggtgactggtgctgctttctttttgtcccccacacctaaataaacaagtcattttccctccattgtgcctgaagttaaggggcactaagtcagtggcagcttggacttgggctacagaaaactaacataggtgtctgctattttgcctctgtcttgcccaagaaccattcttcaagagccaggctttccatctgggcctttcctcaaccctacagagaaacagttcagaagagaacacactttggggagaatacaaagtctaagatctctgtagatcataaagaagagacaaatgaggctgttagagctggttccttctcattttgccattaacagtgaaagccccagagctcaagtcctgctcctcacatttaaatctcttgtctggcccactgccctaaaattcagactcctacacaactgcatctttgaaacctacacttggttgactaataagaattttaaatttaatgtatctgaaaactcttaacttcccatcccgggtatattagtttgttctcatgctgctaataaagatatacctgagactggataatttatataggaaagaggtttaacagactcacagtttcacatggctggggaggcctcacaatcatggtggaaggcaattgtggagcaaaggcacatcttatatggcggcaggcaagagagcttgtgcaggggaactgccctttataaaaccttcagatcttgtgagacttattcactatcatgagaacagcatggggaagaccttccccatgattcaattacctcccactggttccctcccatgacacatgggaattatgggcactacaattcaagatgagatttgggtggggacacagccaaaccatattacctggctcatgcaaatctgcccctctcatagtacttatatgtgttgctccctccttctagttgctccagccaaaaacttggagtcaccctcaacccttccctttcttttactcctcccaactaatcatgtcttgttggttctaccttcaaaattttttcataattctcactagctccactattaccactgtgggataagccaacattatctctcactcggattctgcagtagctctccacctggttctccctttttctatcccacatccccccatctattctcaacccagcaaccagaatgacagaatgatcttttaacacatacttcagaccataccacttctcttttctagctttcccatctcacttggactaggagccattgccttcaccattgcctgcaaatccctcacaatctgcacctgccatacatttctggcctcttctattactctcttctgctaatatccctcagccacgttgatctctttgttcttcctgggtcataacatcagagctttgcttctggtccagggcctttgcacttactgtaggctatgcctggaacaccttgatctcttaactttttcaggtcttttcttaaatgtcactttctcagacaattcttcttaaatctccatattttaaattgtaccccccttcagcaacccttatcttctttccctgctttttaaccgtagcacttcctatccaccatctgtgttttaatagaatttattttcttatttattatagcatctctccctgtccattgagatttaagctgagtgagggtagggcattttgtctttttgtttgtttctttatgtttatgctgtattcttggcacctagaacagtgcttggcacatggtaggcataatagacatgtagcaattatttgttaaataaatttttaaaattctataaaagatttaatttttaaaattctataaagacactgtcagtgttactggtgaaaatttattaatttctaattcctaatatattgctagtatgtttttctaatgatatatctctatctgtgattgtgtaggtactaaaacattccaaaaggttatatttgtagggtggttgcccttaaacgagaaactacgtgcatcatgaatttggagtcgcgcacatctagccatcaaattatggctcaactatgttgatcttgggcattttactgtttctaattttacctcgataaaagtaaaaaatatagatgtaagtgtgaatatatgtgtatacacatatattctatatcatatgtcaggagaagtattttgttgagtctttcatacagaggaagacactgaggctcagagacttcaaatcacttgctctgtgtgtcactcttggtggataggagagctaagattagaattcagattaaatttactccaacattgacaccttgttcttctgagcacattgccaagtgtcctagggaatagaacctttttaaagccactaatcagctgtgggatctttgagcaatactttgcccttccgggtttctgtttccttgactatataatcaaggtgtcctttatcccaactaaggatgtctcctctcttggagcaatattgtacgtgacagtttgtttattgtactcaaaagcattaagaaggaacagagacttgccaaaaggtatttgctatacctttattccctatcaaatccagtgctcagcaatatctagaaattttctaaagctgtttttttctaaattgttcatgttctcagttggtcttgggcactagggcaggcagagtggtctcaatgtggggagtgggaaacgtagggttgcctttcactctgcagttgtgactgcgaacaagaccaggtaaatgcagaggagctatcccaactccctttcaggttccttcagggcggaaattgtgggcctgcatgcactgaaaccacaatttttactatcttttacaaccttgagggatgactatgtgactttgactttcctctgtaaagtcataaaaactgagcaagtggattttctaaaccaagaaggactttaagcagggaatttgtaatagcaacgtgtgtatccttttgtaggtatttgacctaacttcaagtaaagggtatgtaaattttattatggcttacttaaatataacagcttatagggtctgtttatcccatgacgtctcaagaggaactgtgaacagagactcctgggaactttgagtggaaatttcccaaggatattacaaggcaaagcctaaaattaacattatgtgctctcttgacatctggtaaaatcaggaaggcctcaaatggcctcaatgcaagttatactccgcactcttctcttgcaggtaaagtcccttggccaaacaatccttcttgttaaatggaccaaatgcagttcctgcttatcactgagtatcaggtttcagttccttgcagtgcatggaaatattcaaacaagctaaccacaccctcccaccctcccacaggaaccaagggtcaccccaccctcttgaaactacaaagcctgccttccacagcccctagttgttcactctgttctcaagtgtagcccatgtggccctgtgtggcctatggtgtccccctcccctgggctgtgagtatataccactagtaaactgctgtcaatctcacctgtccagtgtcaagcgacgtctgtttgaccatccccataaccctaagatgggaatccctccctcagtaacaaagtgaagagaaggcaatcaaagtaggtacattccataatactggcttactaaatataccctttcagcacagggtagtatgttcaagcttgacataagggtgactctgtgcttcgttaagaaacaaatctctctggcctcaaacttgtaacttctcaaactgtatttcagtactgtaaacatccagacttcgtgtcatttaatgactgcctagctttaattatttcagaaataaaagtagcaggactaaaggttttactcaatagctttgacaagcacatactaaacactaagagtcaggaatcaattgtgtaaagttaattgattctcatttggctgtaacacattttagttcaaatatttttgtccaggttataacttcagttactgtgaccagtacacaagtcattgttctagatggtaagttagacccaattaaatcaataaaaaatacagaaatttgagcaagatctccactgacttgcttaaatttcttctctgaaagtcttacaggcagagaatggtggctcatgcattgtaatcccagcactttgggaggctgaggtaggtggattgcttgatcccaggagttcaagaccagcctgcgcaaagaggcaaaaccctgcctctacaaaaaatacaaaaataagccaggcatggtggcacatgcctgtagttccagcactcaggaggctgaggtgggaggatcacctgagcccagggaggttgagcccagtgagttgagattgcaccaccgcactccagcctgagtggtagagtgagacgctgcctcaaacacaaaccaaaacgaaatgaaaaaagaaaatcttacaaaaactatagacagtgtgccttgatagtatagacaagccaagacctcttctgaaactcttacttcatcatcagaaaatgatcaaagttttggttgtcatagtgcagctatattagtaatacactcctgtgtatcaaattaccctcaaacttaacagcctgagccaacaaatatttatgatctcatagttcctgtaggtcaggaaactgggtgtgcttttgcatggtgcccctagctaagaatacttcacaggctgcctccaagctgttagcctgggcttcagtcatcttgagactgtcctgatgctgacagcattcactttcaagctcacttgaatggtggttgacaggctttagtctctccaggctgttagtctgagagccttggtttttcaccatgtcacatggtcctctccatagggcagctcataacaaagcagctagcttttcccagcctgggagagtgatcaagagtgagtacacagtcttcttgtagcctaatcccagaagtgacattgcatcactttgccgtattctattccttagaagcaggtcactcagtttaacccacagtcaaggtgagaagatcatacaagagggtgaacaccgggagatggagacactgttggggtcattttggaagctatagcaaacatgcatacattctggtacaagtgatggcatcctatctcgggaacctgcaactgcccgagggctttctctggccacaggagtgtgccaggctcatgcataggacagactgcaagtgctggacagtgaatgccacacctccaggaacaggtctcaagcaaggaaggatgggaggagatgaatctctagggtctgcactgctcctcagtgttcctgggggcatctaactccacctgcccacagtggtcacttgtgcacaaaagcaccatttattagctttctgcctgccatattttacttactctctctttttatttggtgctgcctgaaattgcctctccagctacttaattctaatccttgtctcatgaactgcttatgaggaaactaagaaattaaacattaaacattacttacacatgacagcaatattagaagaaattgcctaactctaaggaattgcatagctgtataagttgttctttctctcactgaacaattatttattgagcaagtgctatatgtatatatactactatgcactggacaccaaacgttttacaaagccaatttctgcacttcatggactgctttaaaatgaggaaagaatgggaatttttattcattgttacttcttgtgttggttgtaggcttgagagaaaactctgtaggctgaaaatatcatatttgctattacttctaattttgcagtgtagctagctgatacactgtgtgtatgtgtgtgtgtgtctttatgccacctcacacacatcatacaggctctttgtgaatggacgatgttggatttctcacacttgcttaactcaaaatggcagaattttcttcagctgttttaaaagcacccagccttgacctgagatggagaggtagacattccaattccaagagggtggttgcttgctaaaagtggcagagcctcagcaattgtgaaattgctttttcacctgtacttggtgtcattacaaatgattccatgtgtggagactcagattcactcagaaccattctacctcctttacaaagcactccaaatatgggaaaaggaagaaaaaaagggagaaaactactcatggctcttgctgagaaacgtgatggccaactgttgtaggaaaagtataaattttggagtcagacaggtttggatgagaaacacaatggaccacattcacacttccatggctttagtaattcacttaaatttgccaagcctctgtttcctcatctgtaaaatggtgatacaggttgagcatgctcattggagcatttcaaatttcagatttttggattagagatgctcaaccggtaagtataatgcaagtattccaaaatatggaaaaatctgagctctgaaacatttctggtcccaagtatttcataagacatactcagcctgtaataatacctactcttttcagggttgagaattaaataaagaatgtgcacagagatgtaggctgtaacctttctttccacaggggaactgtctcttcagacttttatacatttagaagtgagtttaactgaactgtgaaatgccatcctgtatgtggccagccatattatagcagcggccttgaaaataatttaaaatagtctaaagatgacttacttgactcagtgtattacgaatgaattcagaacggagagtggcttttagaaaaaggagacacttcctgtcatctttaaagttttctgatttctacatgatgaatcacttacccgtcttacactctacatctcaagccggttttgactactggggacttgagtgaacatctgctaactttgcgtttctgtcccccacttctcctggtagtggcatcttaattttgttttggggatgcatttctctcctactctcagaccatagagttcaagtggagtttgttctatcccactgtgagattatccaggcctggtcagtaagagccacaacgattagtagaggatggttaggtaagacttttagcccaggatgtgataggcctctggattttactgaaactgttagaaaatgacgattctctttccaaggataaatgtgagctgctaattgagtactcagatttttgatgatatagattgagcttctgagtccagctgtcattgaacctggtaattttctagacctgtaaatcaatgtcaccaaattctattttattatttttattttttgcttaattctgtttatgctggattctcttgtttacagcaaagagattattgtcatatacctggatgatcacaaggacaatacataacacttgttgagcactcataatgtgccagatgttgttctaagcgcttaacaagctatgtatcgcatttaatcttaaaaaagcctatgaactaagaactaatgttagtcccactttataagtgagagaaatcatgtgagatgttttgaagaaaactctgtctacacagctagtaaatggtagacccaggacttgaacccaagtctgtctgattttagtatttgtgttcttaacctctacattataattaataaaatggagcaaaactcttcatgtaatgaataataaatatttggaatttcatggctttttccaggatgcaagaattactccaaaccacattgttttccattctagaggtgatttctaattttaattttctgagatcttcacctggggtagtcttatgaaaaagattgtggctaacagagtgagaatattggcaactgtaggcgtcagttcccctattagtaggaagatgatcccagtcaaaggctatccttggacctcagcaatttcctgtgtctgtgaaaaggcaaagagggatggggtggtgtatttatgggaagacgtgggcagcttgttgaattttagtggtttaaaagcatttgctttacattatttgaactaattgaaataaaagatttgaggctcctgagagttgactcattcccgtcatcctaatataaatgaatcaagttccatttggttgatggtctgtaccaaatttctcagtattggctgacagcctcagaaagatctgttcattttacaacgtttcagtgagtcattccacacacattgctggcattggttcccagaggggaggtgggaggaggaggaaggtttcaccgggagagtgaagggcttggaagttcactggggaacaggaagcaggtcagcagcacttttatccagcacaaatttggggctcagcgttctggttttcactcctgagctccatgttaattagcatagacattgtactctcgggagaatgatacaaatcctgtggtctccagcagtcaaagaaaatagggttctttttaataaattcagctgaatagttttaacaaactacacatacacatgcatgtgtatacatatatatctactgaaaaaataaagctactgtgtatacatagacatataatctactaaaaaaagtgctgtggaatcagactgcgctacgtttaaatcacagctgaactatgttttgtctggctttaggccacttaacctcttggagactcaatttcctcctttttaaaatgtgcatacattttactttttgtgcacttttgtgaaagctaaaaatcatgtattctaagtgccagtacatagtaggcactcgataaagcaaaaacttgtggtatttagattctgagagacctgaagctatttctgactctgccatttactagtagtttggatctgggcaagttacttagcgtgtctcactcagtttcctagtctataaaatgggatcataatgctctgtaggattgttgtgggattgtgtgacacattattagttattgtaattattaccagcaattattaatctgtttaattttgctgaacactttcatataatgcatgccaggcattttataattcctaacacatagtaaataatgaataaacattagtagttattcataggttatataatagaaattactattgaatattattgttcctagagggtagaattattgtcttcaaaattctatatctagtaacccagtagcctagatgcttttcttttgtttgagctgtagaaacctgagattgattgctgcctttcctttcagggctttcagcagtgattgattgaacttcacaagagtctaattaattcaccatgttcccctaaacttctcataagcttaagaagctggtctccctcctggtgttgcaggagtgggaaaataacattagaaagaatggctaaagttggaagaatatgtgacctggtgccatgtgatgtcagcccacgcttttccagcatgacgctcggatttttgatagtagaaattttcctgcattaagaaaattcatgacatagtgctttgacttttctagcttgcagcaaattttccttggttgaatataatcttgaaggtgtgcaataaaaagaaaaaacagtcatgatgttagaggtcagtcctgttgatatcagaaagaactcatggtaaccactttcggccaactctgaactccataatagactagttgagactttaggagaccaagtaagacgtgatggtggcttgaactaggataatgacattggcagtaagaaaagaatatggggtacataatatatttaggaaaagtgctgatgacttggatggttatgggaaatgaatagaggagaaaatacgttggacacggggtagactttggtgccattttctcacatggagaagaccaaggaaataatgggatcaaggatacggagaaaattgagagatctatttcttttgtgttaaatttgatatgcatagtggacatctaagtgtaaatttgaaagcagcagctggagatacaatttgggagctcaaggcataagtcttggaagaggattttgtgaacaccactccatcaagcatgtgttctccagcatgctataatatattatgggaggccgggagcgatggctcatacctggaatcccagcaatttgggaggccaaggagggtggatcactcgaggtcaggagtttgagaacagcctggccagcatgatgaaaccccttccctactaaaaatacgaaaaaattatctgggcatggtgtcaggcacctgtaagccaagctactcaggaggctgaggcaggagaatcgcttgaccccaggaggtggaggctgcagtgagccaagatcacaccactgcattccagctcgggtgacagagacagactataaaaataaataaatacataaaaattaaaagaaaataaacactatatctatggaacacaaaataaggtcagacaaaactttgataaaggagggaataactagaaatgcaaatcaagagattaagaaacaacctgagaacaaagaggagataatagaggaaaaggggactaagtgctgaacacctcttgactgagcttgtagaatatgcgtggcattgtgctgcacacttttacacacagtaccttgtggaatactcaccagaacatgtattgcttccgagaaaactgaggatcctagggttttaagtaacttatctgagtatcatagctagttatgtacagagccaaacaaaatctacctgaccctaaagcctgtgttcagaatggataaaatgtttgttcctccttgccagtgaaataatataatttgttaacaatgaacaaggaacaagacttaagaaagagtcaaggtttttctggcttgtaagatgcctgttcatggagctcacccactggaggtcatatccttgtgtctgcaaaatacacatcttacttggaggtagaggggggaaagaagagtagaaagaagacagatagttcaagatagggtcacttgttaaaaatatgaagcaggggtatttgagtttctttaattatcatgtatcatctctatgtactgcattacttatttcttttggttgtagctcctaaaaacactccttgtccttttcttgagtgttgtctagcaggcatatagattaaaatggtttttctaccattctatgccattaattatggtttacattcagttgcttaatcattaccttttgttaccattctctagcaatatttctccagcaattcattggcttacttaattgaaacatccaagaggtaagcttctttcaggcacagttagatccaggaatttaagtgctgtcatctgggctttggctctgtccctaactctaggctacacacaaatcacttggcttttctttttttaagacacgtcttatgcatgtgatggttacgtggtgtctggtgttgcacagcactcttcttcacagtttaagatgatagaggaggcaagagattatgcttctctgttcatacaatgatgctcataaaagggactctgattttcccatgtgcccatctctttgaccatgcccatctttctatatgtgcatctctccaaccaatcacacaggaagataattggccagacctgggtcatgtgctttcccctgcgtgtagaagataggcaagtccttgggatttacagtttcatcagtaccaaatggagcaggagagggcagtcccccagtataaaatcaacagagatacatttcaatactttgattggatggaggtcattgttgttattatttgctgttgctatcattgctgctatttttattccactcaagggcagtatctgaagccacacaataaacctggcagtagcaggaggtctctggtttgattattgacatataaagagccttctatccttcctgttttgatgagagttgcatgaaccctgagttccaagtagctctgtaatcagtttctgagatcctatcaaaagaatgacaaatcaatttggaaaagagacccactgaaatgtctgaacagattcaatcttctctatgactgaataattcaactttctttttaaatccaagcctagttttatggagaagccattccttttcttcttgagtctaggaaggcaaatctggattattatatctgcaggattcagcgctcataataattgctttttgattgttttttttttctgtgaggttgctgtaagaccaaccaacaaacagggtgattaaattagggcagagtttacaaacttgatatgcacagccctcaagaattacagctctttggcctgatggtatcttttgtggggtatgcacaatattttactaatttgatttagttgccagtatttttaaaacaggtgattttacatgttaaaaaaaatccagactttaagcttattagaaaatgtggcaactctgggcctgcgtttccacattcaatagtcagagaaacctatttttgttgggaaacagagcagttaggaatatattctgctgcaagtaatagaggtttaaaccacagggatattcattgcttgttcaacaaagactctggagatagggtttgtccagttttcattcaagagcttaacagtggtatcttctatcaatcatttgctgccatcctcaatgtttttttgtttattggtttgtttttttgtttttttttttggttaatctcttaccacatcagtaaagaggaaaagaggtcattcaagggagtgctgcaggagtgctctggccaagcccagtggctcatgcctgtaatcccagcactttgggaggctgaagcaggggtggatggcttgagctcaggagttcaagaccagcctgggcaacatggtgaaatcttgtctctaccaaaaatacacacacaaaaaaaccccaaaaacctttagatgggctaaagtttagtgtacacctgtagtcccagctacttgggaagctgaggtgggagaattgcttgagccagagaagtaaaggctgtagtgagctgtgatcacgccactgcagtctcgactgggtgacagagttaagaccttggcaaaaaaaaaaaaaaaagaacaaataaaacgtgggggtgctccttgcccatctattcttttatttttcaggaagagaaattttccctagaactaaggtatggtctttcctttgttctcactggccagagctaagtcagatggccacctctagctatcagcaaaacataatgggattacccatgatttgtttacactagtgctgatctattccctggggttgggaacactatcacctgaataaaatcaggtctgtgttagcaagtcaggaataacttgtggatgggcagtcaatggtgcctgccacagcaattgcctctccatttccccatggtcctctccactccctgtggtctgatcacagccacctccactaatttacctcaccttaatgacctttgtaggtgtttttgtttatgactgtagacccagaataacttgatcactttcctaattctgacctgatgccagcaaaacaagatgcccaatttgttgggtcaggagaaccttgattctaagtctccattgaacattactagctgtgtaaccagggacattgcaaacactttctgtgatttacttaaatgtatgatgttaagattcctagaactaggcaattagtggttggtatctagatactttgtccctttttattgttaaaaccttcaaaaattatttatgaaaaagaatgttttccttgtatactctagaatattattttagcatataggaatttttctctatccaaaaactttctgctctccatttaatttctcaggttagaaggattagaagcagagagaacaagagagaaagagaggattatatgttatgtttgggggagttctttggttttgtttttaaaacaagcttagggttcaagaggtaatttggaatataaaagatgtcagtgagaaagatggtaaaatgtttcctaggttttaaattaatttccttgctctgaaaacaaaattaaacctctgagattttatttgttggcaatcaattatgtaacatgaacaattatgggtgatgtctttctttagttacataaaatatattattcgtaggaccacattatttttctccatttttgttttaatatctcattgtctgtttaaaattttttcacatatccacatagtaaaactcataatagtagctaacttacatttaagcaatggatgtttactgtatgtcagattcaatgcatgcgatgtagtaagtactcaataaatagttattaatgtaatacaaaagaagtcaagatgagtagaagaatgggacctaacccttccacactgacataaatgagaactcaggaaggcagtgtagtaggttggaaaatgggtattagaatcagattgccctggatttaaatctcaatttcaccacctgctaatagtgtcactttaggccggtcatctaacttttaaaataggaaaacagaacccacccctccaaactgtgtaagaatcgaaacaaatcacgaatctcaagtccttagtctagtgccttgcacaaggtcagggctcaactggcataggctgttgttattcatctgtcaatttatgtttaattattaacaattattgttcaataaggcagcataacaagtcaccccacaactcagtggcttgcaataataaacatttagtttacttttccagggcctaagggtaaggagagatggctctgtatcctgctgtgcactggctgggcttggttcactcaaggttgtgggtttggttcagttctgctcacagtctttgggtcagtgcctacctgggaatgttcctctcctgatgaatggcgggagaccaagacagcaagccaacacacgaaaacatcagggaggcctctacttctgtcaccaccacattttattggagaagtcagttacacggtcaggtccaaagtcgctgggacagggaagtgttccacttaaagtggggtgagaggaaggatgaaaatatttgctgaaaatagtctcatttatcataatttgaaaatgtgccatccaagtgtaacaatattttgtatccactcaactatctcaactacatttctttttgctttacagtgtcaccacccctcccctcaataccacagatatatgtatttctatatattttccccatgtgttaatggcttttggttgccttgaattaactcataatgcaatggtaataatgtgtttcctcttcccaggggtagttgtattttaaataaagatctaatgcaaggagaatgggtaacttcaaggactgaatgagtaatgctgctatgttttggtgctataatacctgagtgtagaggcagagagatcttttgatcatcatcctaattaataaaacccaaggccatgtggaagggctcagtagtagatcaagtacatctccaccgatagaaagatactcctctatagtgttgccaaagaggtaaaatgcttactagtaaatttccctctcgctaaatctccagggcctcttgggctgagaagagtccttgagaggaatatttatttgacatcttttgcttccttatttaattggagtcacatatcttccctgagtccatttataaactgtaccacatttctactgaatgcacgttcatatataagcaggctctgagtttgagttagcatttgtaacttcccattatgaacttgggggagtatttcccatgaaaatgaatgggaaatcctgccaccaaatagctgttatcagttagtgtttttatgatactattgtgttaatttattagtagtaatatagactttaccatgaatgtgttttccatactttaaatccaaccatctgatgagaacaggaaatcatgagactattatttattttttatgcactacctccatttctgcagcttcaatgtgtttcctgggaaactctacatcgtcattgtggaatgatcgcttcagtgaattgaactaattggtcttgtattgaccctgaagttttaagtcagtcagaggattacatagtttcatgtacagcattctgtagctcagttatgtttgaattactttgctgtaaactttaatatgcttgttttatctttgtcacaaagcaaggttctatttcaggaacattccttctaaaagtttactatctgactccccagttttttgtcaagtctgtgttagatccttggtgcatatggatttagcatttcagttgtttatttgtaagtgactgggaaggctgatgccataaagaaatttttaattttgctaagacacaaatatgcattgtgttggggaaggatccacctagttagtaagggagcctcgctgaatactcagtacagtgtatatatttcaaggtactttgctgttctctatacacctttgagaaaaaaataatttcctaatgtaattattttcaagagttttttgaaaaaaagtaatatgtaatatgtattaagcatttatgaaataccagtttattaagtgttttaaatgaattagcacacaaaaatattgtcattaccccattttacagatgagggaagtcatataaagaaggcttatgaaagtgaggtcttctcaagttcatgcagtactgagtgtcggagccaggatttgaatctgggaagtctgactccaaagcccagctcattatctactccccgcccatataccctccagcactggtgggggacttgaaaaggtttgcaaaattgggagttcttatgtggacattacatgtactggagacatcaaagaagggaatgttatattcagcagtgagtcagatctctacactattatgaaaacaagaaaaagtaatctgtgaaattgcttcagtgagtgttccagccaggatttattttaatggctttatcaattactttagtcccatatttacagaatcattaaagactgagggggttatttacattttaccagtgatggtttttttgctttttgtggggaagatataatttgaagagatatatttgatagtttgatggtttacaaaggccttggaatatatccaactggacgccaaggactgttgtattaccattattatttttagttttaaactgttgggcttacctgcacagaggtgactatagatgtaaaatacctaacatggagaatataacatcagattcttagcatgtaacaattggtgttgtattagaactcagagagtcgcaatttgatcttcaaacccaagtctttagccaccatatgcaacagtagaggcagagcaggttggcagggctgctcctgtgtttagagtttggagggataaacaggaagggaaagcagagcttcaggtttcggggggcagaagacagttagtggtgacagggggatgaggaatcatatttcccaaaatgatgcccttctgcaaacattttaatgttggcatgatggctattatggcattaaagaaaatattttagacaagacagaaaagcagcaagaccatgagatagtgacatgaagtggtcgaaggctggtggtacccttttaaaaaacctgttactcagtaatcattaatcattttgcaatacctctagcctggtcccgaggctctgctctatggttccccttcttctggctcctgtacctaattttcttctggagaattcctcccccattgcataccgtcttggtaactcacattccagataccctgctgtccctttgccaaagaggtggcttgtgaccgaagctggacaggtgattatttcctggtattcctcatctttaatgaagtggcatgagggagggcagcaaaagcagtggaactggttcgtcccagcagtggtggctgatgagtttttcaatctgttcctgttttcagcattcccagagtatcactggcctctggtagacttccgtacagttcttcagtttttcccttaattctgagtttcccccagtcctgccaatgaattactttgtgcttaaattagcccgactcatcaatatttctgttgtttgaaaaccaaggatcctaatggaaacagttggttttgttacaatgagatgtcaaagaatggatttagtgatatatttttgaaaatatctaataaatgatttcagaagagtagcacctatctgaaattcaggaaaaaaaaaaaaaaccacagcaggttgttattacaaactttgcaactatgtgtttttttttccagcccaactgaggtctgtattgttgaactgaaaacaaatttctaaactgatctctccctggaagttacagcaggaagcgaaaacagaaattctgagtgtttgtctgaaacagctctcctacacacacacacacacacacgcacacatgcgcacacacacacacttatcctccaacctccttctctgaatactaattttgtcttcttccttatgtattcattcaacaagtatttttattttctttttctcttcatatcaggggacaaagcattgaagttactatttattctctgagttcttctgaaaacccattaatcattttggaaggtaatcaatagaatgcaaaatgggatgatctccatggctatcagatttccataaatagacacattctgcaattatcatcagaatgatttgttaccatttgaaagtagataaagaagggagatgcagttctgcctcaacatctaaatcccaagaagcagttttctatctattctttaagtacatctttgggtctggctgttctttgctgggatttttccacttttttcttcttgctatactgccaaacagctaatcatgtttgaatgcattctgcataataaacccactctttgcactttctatgactattaaaatgtacaacaacattttaatattagtttgtttcttccccacttcctttttggaataactgcttagcatgatttgggctgagtactttttccagagttaatggtaataataataattgcaatggtaataaggtcttcagcttctgcttgatagctgatggcatgtgtgcttgtttgtgtgttagagatattgaggaatctattctaatttaagccttggcttgattctttagatacttgactggaaggaattctttggttatgtaatctgagggcaattgtcagcacttaatctttctaagaactatgttaaacacagcacataaccacatgacttttacaattagatattgaagggtgttcactttggtcttccaaagatgaccctgagacaaggattaaggtgctggtcagttacacaggaagtgatgacaagaaacactaggagaagagtggaatgtgagatgaggtagggaagaaagccagtgaagggaacctcacaagccagtttccactgtgggcagctgaagcttaacacctttgggtaactcagagaccatggagaacatttctcccatctctcaaaggaaaggaaaatcgtaggcattggttgaaggctatcctaggagcattcacggtccagcctttcacctggacctgtatgggccaaatgtgctcgcatggccaggaaaaaaccctcaggcagagaggcacatgtgttcacagtaacactccccattgtgaagagattgatactacagggatgtgggcagggcaccaggagcatctgctgtaatatgtcacatgcccataaggaatcattcatccaccttgcaaatcccaacttggaggaagtgggtgctttatgaagaggcaggattccatgttgcttatgcagtatgttttgaagggtaaggtattgctccaagatttgccttttttaggagagactcaatggttccagaaatgtagcctctagagaataatcattttgggttaagccagaggaactcacagtaagatcctctgaccatcttcatcaaaatcacctcggaatgcttcataaaattcaggttcctggatttttcttcagacctgttgaaatagaactctggatttggagtgaggtgacagaaatcagctccaagcaattttaatgaactccttaagtgtgaaaatactgacatgttttccccctccctgatgaccttaacattttttaaatgaaaatatagcttgtttttttctattacaatattaatacatttgtaaaatatgcctttttaaggcattgctttattttttatttatatttttattgatgtataatagttgtacatattttgggggtgatattttgatacctgtatacaacatgtgataatcaaatcagagtaattgggatatccagcacttcaaatatttgtcttttctttgcattgggaacattacaattcttttattctagcaattttgaaatatacaataaactggttttactatatttatctactgtactatcaaatactagaacttacttcttctagctaactgcatgttggtaccccttaaatgcctgtcttatttcacctctgtatcttctgtggtttcctagcacgagcctgccaaatagtgcatgcttaatagatatgagtcaaatgagtgaattctcattatagaaactagaatgcaaggattcttggtgattgagtgactcacactttagtgtgaataaatttgtcaactcttttcctctaaggaaagaggaacagatgcaataatagaacactgggagccagagggaaggaacagataaaaatggaatgagaatcagtcttgccagctacaagcttatccatctgcaaaatgaggatgtagtcagcacctgatgtttttcctgcctagtgtccactactttgccattggatacttcactctggtgttcttttgggaagcttctcctctatgcagtctgcattgcttctgaaggcctgactcaggcctggccaaccactttattttatctccctcctcaccatgagattggtgtgaatgaaatgggctgtaagccaactgagaacaattagagtttaatccagataagacataaaagagacacttcctcaaatttatagggaaaggaagatgaatgtatgttgattttgcttaagtggtagaatataagcctgtagctggttgtgaccatctctatcagatgaggagtgcctgtttaagaataaaaccaaaagaaaaagaagaataagagatggagaaaaatttataatgatatcattggagcttctggatctatccatgacttgccacttacatgaaccaactttggttgtttattttgtcacccgaagccaacagtcctgactgataaaatgagtttgaaactaactgatctccaaggaagattatcactgaatggctatggttgtctgaaaaagttggaccagaatccttgctctaccactttttatctgaatgaaacttgacctgctacctagggtctctaatcctcaattttctcattattataaagaactttgaatataattgaatccattggcttgtgagaattctatacatgtcaagagtagccttataggtactcatatgtggtagttattcagtaaggctcttttagatgtcaggacttccttggttttatctaagaaagacctcttagaaattccaaaaatctctattaaatactatgggtcatgtcttgaaggcatgctaccttcaagtgtattttttttccgaggggtgttcaagacattaggtaagttctttttctcctcatttctagaaattcgaggctggcaggaaagtctattgcaaggcatttgatgttcaatatgatgaaatatgatgaaatggggaaagtgtagagttgaaggttgtagcaaattatatatttcaaagatttccgtaaaaatacctccgatcacacatgctcttcaacactgtgatcttacttcccccatcaagagatagcatctaattctcttttcttgaatctagccatttcttagtgatttacttgtaccatagaatacaaaacaaaagtgacaccatatgattgccgagtctgagaatgcttgttcttcagctcatccaccttgggatatcacctttcagaacccagctgccacgttctgaggagaccaagccaagtggaaagcctgcatgtatgtgctctggtccacactcctagctcagttcagcttttgattcatccttgttcatgtgccaggcatgattggagatgctgctaaaccactccagctcctagatgttagagttgtcccttaatcccaagtatttgtaactggggtcctagatgttgtaggcagagaacagctgtgcctactttgccttttcagaattcctgacacacagaatctactgtcattttacaccactaaattttggaatggttgataattgtcaacagaaaactgcaacacaagagacaacatggccatcaaaaagcatccttaggaatggaagtcatgatgttcatgggacccaagtgctatcaaacaggacttttttttttataaaggcaagagttaaacaaacaaatagaaaacaaactaacaaaaaccatcagaacaatcagaatagaactggaaatctggttgccagaactggaagtatgtttaatggccactggtcagaactctctctctaacaggagagaaaaacacccaaagagttggtgctgtgagggaaatagatactgttttggagccaggacatataaatctatattgatatgtataaaataacaagcaaggtagtagagcatagtggttaagagctggagcttgaagatcagccagacctgggctcaggtctttaaccgcattaactgaatgatctttaaaaactctcttcactatcctaaaccacagtttccccatctgcaaaatttagacaccaatattcactttatagatttaatttcaggattagatgagacaaattagcacttaatatattgcctgatgcacagtaagcattctatattttaattattatgttaaaataattgtgttaatcattgtattcaaagccacattgcaaactctagaatgtgagataactttcaataaataagacaacaatattctatgatggagcagaataagaatcccagctaatattcattaatatgcacatttgccatgcactgggctatgttctttagagggattacctcccttaatcatcacaacaaccttaagtgtcaggtttcattattatcccatttaaaaggaagaaactgaagcattaaaactgtaggtactatggtgaaggtcacataaagattaagtagtaatcagactccagagcaatacctcttaattactctgccatattgtgtttccctgttggatacgttccctttcagttgtgaggtacggagtcctctttcaggtcaagtcagcaccatataacactagcagtatggttcgtggccctgcagaaatataaggtctttcagagttatcacattgaggtgtagagcaggtaactctcctaatatatgtaatagaatggttgaaagaaagacatgactgaacatggaatgaagacagatttattttggttccccatgagtgattcagcattttcaaggtgaatttaatatggagaatgttgccaattccgtttcattgaagccctggtgcctgaggccaaaatcacttaagtgagtcaggaaaatttgtccttatcattttgcattggatgtgcctgttaaggatggaattggtctctcactttgatctttggctcaggctgcctcagatggcttttgaaggatcctcagtgtacattccactttctgtcctggaggtgagtacatttttctggcagtcaaaaatattcactagaccctcactgctcaaagtgtagtccatgggccagcaacatcagcatttctggagagcttgtaagacatgcagagtttcaaggtcccgccccagacctactgactcagaatttgcatttaaacagtatctttaggtgaatctgatacccactaagctttgaaaagcaatgttctagacaaatatttattgaaaaccttccatgtgtcatatacttttcgagatttttgaggaggccaagaatctttctgaaatcataggggagggtgtacaagaatcaggtaaaaaaaaattccagttgttaataaatgttatggagaaaataaaacaggctaaggcttctgggaaggtttgtttagaattatcaggaagggctaagagatatcatttgatctgagatctgaatttcattccctaaatataagggaagaggatgcaaagcctaagaggcaagaatgagcctgaagtgtctagagaactgaaaggaggtctgggtagtgaatgagagcagaagtaatagaaattgaagtcattcaattcaacacttaaccaaacagacattatgcactaggagctgtcctcggtgctgaatatattgcagtcaacaaaacgaagatcctgtcctcatgatggctacatcctagtagctgaaccaggtaagtaacaaatgtgaaaatattctacagcaactaaagtaggatatgaagatagagagtgatgggaggagtcttatctttgggaaggagttggcaaattatggtccacaggccatttacagttggtctcctgtttctgtaaatacaattttattagaacacagccaatcggaaatcatgtatttacacattgtctataactgctttcatacaacaatggcagagctgagtagttgtggcagagatagtatggccctcaaagcctaacatattgactatctggctcttcacagaaaaagtttgcagacctctgtcttaagggataaagagcatccactggggatggggaagtgaaaggggatggctctttgagaaaacaatagctgagtagaaaggtagtcaggactcagatcaaataggaccttttaagttatggtgaggagtttgggttttaagtgtcacagaatatcattgggtagttttaaacagggagtaaaatgatctaattgacttttaagggctcactaagcagttctaaacacttgagttgctgccaattttcagccaacaaaggcacctggagatgagtgcctaggtgtttcccctttgatcttggctctgtctagatgacatggatttttggccagagtaagaaccaaaagacactcaatgcagaggcgacagtcccctttcccacccttgtgttttctaatagcattatgataaataggtctttatataattccttatgagtgactgatttggaacaattctttgaaagggatgtggtaattgagccccaactcatgtctacagagaatcaaagctgccttgtttttagcttaatgctatgaatacttttgcatgtcttggctgcatttattcattcatctattcagcaaatatttattgagtgcctattatggacaaggccctgtacttggcaatgtagatgaaagggctatcttaaaaaggtcttattaagtgttgccagaaagattgaagaagtagctttaggagaagttgccaggtgactacaacattttgaaggatgaaagaaatgtagattttctaaaaggattatgggttttatatttaaaaaaaaatagaggttgaaagggaatgtaattgaaacctttccaatcctaaagggcatgggttcctttaacaaatgtaggaatattataataagggtcacacaataggataagatgctaagagttcacatggctgacatgcagcacttagcatttttcagatactggaaaatgaattgactgattacatcttcacaataattccattaataagtaattattataagaatgattaaacagaaacataaaaaatttaagtgccttttctaagatcacacagcttataatggtaacttcaggactggaaaccagatgtgtttgacccctgagctgatataaaacattcctcattcagctttcatatcccagccaagacttccagatttaaaaaaaaaaaaaaaaaaaaaagatttggagcctggggaggggaggaactggaagtattacacttaatttttaaagctgatttttaagaagacaactgtcttcctctacagctctcctcttggtacctttaacagggaatgaattttggcatgatgtgcaaatctttatactgtgtggcaaagggaagttagctgcgtatgagtcactacattctctggctcagaattaaaaatccaagcagtaaaattcctcctactgacccagctaaaggtaactggtgggtacatgccaactctaggtatatgatttacaaaaaataatgtacaaaacattaataaatgtgatgaaaaaagtttgagaagctaatgaataacaaagctagctaaaatgtgttgactggttaatatgatgtcagtgttgttctaaatgcactatgtgcattatgtgcaacaactctaagaattatttattactgtcgtgcctgttttcaagatgaaagaactgaggactagaggcactgatcatgtaactcagaatcaggtgacagaatcagggcttacccccacctctgctgagtgcaaacaaagctaatgcacttaagcactctctattgggccagtgttataattctctatgctgctgactgcctatttaatccatagacgtatgccaacctgagttttcaacctttactccaactgacctgccaaatccttggcaagggggtcaagaaaacccagataaagtgggttaatctctctgatgtgcaactcctgatcattagctcctgatatgccttcagtggtgaattggaacaaagctgacctttttgtcagtgaattggaaaatgagtcagcctgaattacactccagaggaggcaatgcccattgcaactccagatagagcaagacatacatagggaaaaggagattgattaattttagccgtaccatttttgttaatgatgagttatgttagtgaccacagagaaagaagaggtagcatcttttatagctaagcaataaataaacctttgtaaaatccatctttatggcctccttttataatggttttatgtgattgatgtgatgataaatttgtacgaattggctgatccattcttttatccatccaaccaatatttattaagctctatgaactgtgttcttgtttaatattctacttcctccaggtcagtggtttttcaagtatggtcctcagaccagtagcatcgacattacctgagaacttgttaaaaatgcagaaactcagactcacccaagactatcagaatctacagtggggttttgcaatctgtgttttaacaagccctgcaattgattatgatgcatattaaatcactgatctaggcaactcttatgccagaaagaatcccctaaccatcctcttctctccaattctaattgaatctcttgaaggcaagacctttttctccaggtcattgctgggtctccagtgcctagcaaaagactgggctcaatctatgctctcaaaactatttatgctgaatgaattaataaagaaagacacggagttacagatatgttgagtactctctgtttggtccatccggtttcatgatttgtagagaggagacaaaagagcagagagccggaaggacttggttaagatataaacaaaatcatcagacacatcagggtccccagtactagtctaatgccaatgaacagaggatgtagacaactttatttcttacccctccttgcttttggagtttgacactgtgacctaagcctttttagagaaattcagcaagattttcaaaataagcattttgatcatgatttatggttaaataaagggctctgacattgaagcttctagccatctgtttgtcatacatttctactgaggacaaagtaagtggtgatgtgttttatgtactgtaagagaaaacttcttagagaagaaaaaaaaaatatcttccaacaatgaaaaaagtaacaggctgtttatgaggctcacctattcattcattcattattttatttacacattaacaatatttagtgagcatccactacgttccaggcattgtgccaggtgatggagatacattggtgaaaaagacaaccacaaaaaatgattagttggaattagacaaaatcctataaaggaatattaaatggtcctgtgaagttttgtaatatggggaagtaagctattctggaagggttagagaggctaccctgaggaatatttagtctgggacctgaaggatgagttggaatcagtgaactaatcaatgtccttttatttgaaacattataagtgttctcatcaggatggcttatctgggttagaaggaaggtataggcagaaaggaatttgaggcaaaggcaaagtttgccatctgagcttttagatttttctggttacagcagtcagagggagtgagaactaaaggcaggatgcgggccaaggttagtgcatcttttgtttgtttataaaggcaaccttggcataatgaccatggtcaaataatcaatagccacatttttaagggacagagtgtgctgtgaaagataaagatgatttgctttgactttctatgtcagccggcgccttggttatcgaaggtgcctggggacaaagatatgagcatacagacctgttctgcaaatccacaaagtctagattctgcagagatcttgctttatttatttacttcagagcaagagtgttaagagaggcagaggaaataataaaggggagggaagaaagcctaattttctcatacttctgtcgaaagacagacttgaaaaaagattataataattatgctcaggaaagcatgtggtgttgacagagaataggactggaagtggaatggtaattatgtcagattcaactgaagcattgtgcaggttctagaatcctggtgccagtaactcagctcattattgtacacactctgtttttcctggggtcaaatggaacccaatataattctaggcaattaatacctgttacaatagagtttgaccataatatggtcatgtcctgtgcaccagtactacaattattcaagaaggttatgtgactatttgtttgcacttacaattagtgataacttcataattagggataatcttctaaccactgcagtgtagacagctgagtgttatggtcaggagacaggctgaagttaattcacaagaaaatgtttagcttcttgaaggcaaggatgatagctttttattttctgtgccttttgcacccagaacactggttggcactttggaggcagagaatttggaggcagagaatttggaagaggaaagcatggtgggcagggtgaagaaggaggaagaaaaggaaggaaggaagaaagggaggaaagaaagctgatctgagctctagaccagtggttctcaattctagctacatattagaatcacctagggagttttctgttttaggttttagagtgtaacacacacaaacagaagtacccacattgtcagtgtgcagcttgattgacacatcacaagaaacagaacaccactggcatctcagaagctcctcatgtgtccctttccagtcactaccccaagtaaaggataactactctctggaattccaacactacatatgagttttggctgtttttgaaatttatgtcactgccgtaatacagaatatattcttcgatgtctggcttctttcactcgacattttgtttgagattttttcgttttgttgtatgtatattagcatgtttattctcattgtttatagtgttcctatgtgtgagtataaaacatatccattctactcttgataggcagggaattggttcctttttcatttttgactgtttcgaatagtactatggtgaatatttttgggcatgtcttttggtgtgcatagggacatttgtattggggatgtatttctgttgggagtggaatttctaggtcacagggcatgtatgtgttcggctttaacatatattggcagttacttttccaaagtggttataaccacagtacatgtgtacttctggtgtgtaagagtttcacttgttccatatcttgttcatacttggttttgcatgtctgtcattgccatcattttggtaggtgtgttactagtattacttggtagttttaaggtgcatttgcttgatgattaatgaagttgagtaccttttcctgtgcctattgatcatttgtttaaccactgttttaaaatcattactctagtcttttgtccaatattcctttgagatttttgtctttttcttcttgatttgtaggagttcttaatacattgtgaatataagtctttgttggatatatgtattgtaaatctcctctctcactctaagacttgttttttcacttaatgctatattatgacgaaaagaccttcttaagtttaatataatcttcttcatcagatttttcctttctggtagagcttttagtgtatattcatgaaatttttacctattctaaggtcatagatatatgatcttacctttttttccccaaagctttattattctaccttctttatttagatatgcaatacatttgggactagcatttgtttatagtatcaagttggagtcaagatacagttatattttccacggggatgtccagttgacctagcttcatttatctttcccaactgtactgtagtattttttcatcaaaaatcaggtgactaattatgtgtgggtttgtttctggagtctgtattctgttccatctttcatttcgtatatccttgcaccagtacctaccacactggcttaactattatagattgataataggttttgttatataagtaagtgtaagtcctacagatttgttcttcttcaagactgtcttggttatgcttagatctttgcatttcattttgattttatcatcatcttgtcagtttatgccaaaaacaacatactgagatttttaattgggattacattgaatatatagatcagtttgggagaactgacaacttggaattttgtcttctttgtattcatatacatggcatatttacttaggttttcttgtataatgttttatagtttttagtggtaaacagtcttgtgtagcttttgttagatttattctttggtatttgatacatttgatgctactaaatggtacctgggttgctttttaaaaatgccaatgcttatgccatgtggtctagagattcttatataattagctttagtattgtaatacacagccaagttttgagcacttctattgtagatgtatctttttgcctgcttaggcaaatcagttgacccttggagctatcattttattatttaaaaacatgcaataagattatctgcctcaccagttcaagaatattctgcttttaatttgatgctgaatgtaaaactcagaagcattataatttgacctagatgctttatttttaatggtagatggcaaaattaactttatttataaaatatggtaaaactgaactaatttgatttgatcacattagcctgaggcctcaaaactctgaagagtaaaaatagcagtcatcaagactatgtgactttttcccttactcataagcagcccctcctatgtttcataggccctgtttatgcttatgttctaaacaattctagctagcttggttatcagaatttccagacttcaacataatagaaagggaaagaagaatagtataaaagcaagaccaccagagataaacccataaacttcagaaaagcacctgtgacagaaacagcaaagacaaaagagcttaaaaaatagaaggctggggccatttagtgtaagcgtaggagcaaaatgcatcagggacataaaattggagaggattattttattacacacagtttcatatgtagttatcagtatttaagcttcatattagcaccaaaaacaaaatgctgtgtgcttttttcaaagatggcagaaaaatgagtaacatatttcaaagaattttcaaaaagaataactaaggtagaattttggcttttctgctctctgaaaaatacactaaaatggtattgctcatctcctggaaatattagacaaatggtattttcatttaccacctctcattgggtaaagaggtaagccctttcaaacctgtctcattctattacactttatgagaaaatgctattaaataccacctgcacagctctattgtgtgtgtgtgtgtgtgtgtgtgtgtgtgtaggaggtggagggaggacatctgaagtcatctcttgaagagtgagtgtcccagatttaacccttttctttatagccttatttgtcatttagatggtttcgacttaatggttatgatcttgcctgactcattcatttgatttccctacgttgtcttcagaagcaaatttggaagcagaatatttccatgggaaactgaattatttttccctggagctgcatttcaccaatttctgccccaatacctctataccaaattctaaaatagaatgatcaatattgctctttttctgtaaaattagactccatgaagccattatttatcgcataagaagccggagcacatatttgctcacattgagataaactaaccccggataaaagtcccccacaatatctgggaaaatcccagggatctggctgacagatgttgctttgtgcctacaaataacaaacacatctgcaagagccagacctttgagcatttctctgcttgaaatcagcaaacactaattcagtcaacaaatatttattcagctatctactctgtgtctgaggctggagatagacatctggtcaaccgaatcatggctctgacctataggcctatgagactgggttgccaattaccacactgtaaaagtttcccagtgttagcattacaaagaaatctactcaacattggagttgctctatttgctgattgaaagaagcctagtgccttagaagaattgagatatggttcctcaaaaggttttcttagctgtaatttgggatggcaagtggcatattactgaaagccatctggttttgtggctatgatcacagactctggagcatgactcctgggttctggtctcagcactagcactaccacttactagctgtgtgattgcctgtccgtttataaacttctttggttctcggttttcttatctatcaaatgggagtaacattaataccttcctcatagtttgttgctaaaatgagtaaacgagttaatatatgtaaagcatttatgcaagtgcctggttcttaacaagctatcacacgcagtggcatacgggtgggagaggctgtggatgtgatatggcccaggggtggagagaagtatttgattgataacactgtttagaatttctgatgctcgatgataacaaataggctgattttagtccagttcattattgtttttaaattgctcacaggcaacacaccctcttagtgccagcacctgggcagtctgcacctgtttcccccagccccccaacactaggtccatcaggaccatttctccatttaaagaagttgttttctccacatttatcatcaaaatctttggcctttaaattataggctggtgactatgcataaaaaattacttcaataactaacactcactaaacattttctatgtgccaggcatggtgtcagtttctttaaatgctatatttcatttaatcctcacataaattttatgaggcagataactcataatccccattttacagatgaggaaactgaggctataaagcaggatttttccaaccttggcaatattgacattttagactggatgattatttgctgtggaggctgtcttgtggattgtaggatgtttagcagcatctctggcctctacccacaagatgctagattgtgtcagactgtcagctgtgaaaacaaaaaatgtctccagatattaccaaatgtttcctgacagtaggggaaaggggggtagtaaacctcattcctcactctgttagagaaccactgttataaaggataagtagcttctccatcttctctcagctagaaaacaagagaattaggttttaattcaggcagttttgaccatatgtactattacattctcatccagtgcagtgcggtctcaaattgttgtcctgagaccagaagcatcagcatctcctggtattggaactgtgaattcttgagtcttgcctcaaacatattgaattagaaattctgagggcaggatccagctccgagcaattctgaaatatgctaaagtttgagaaccactggtgtccttcaatgtttctcaacgttggctttacattagaatcacctggggtagctttaaaaaacactgatcttcagaacttatttcagaccagctgatcagaatccctggtgttggaccaagataatcaatgtctttagggtttgtttttttttttaatttttaagctccccctggtaattgtaatgtgtagccatagttgacagtcattggtcttgtgggaaaagtactgtctgttcaggaccagggcttccagtctccatccaaatcaaccttggacaatattcttactctttctgggctgcagtttcctcgtctttaatataaaagtgctggattagatgctgctttcattttctggcttacattcccaggtgctaaactccttgtattttaaatgattaatcatctccatctgacagtgaccctggataaattgcttattctttttgtgctttgatattttcatctataactgaagaaatactggtgttggttaaaaaaaaaactatataactaagacagacagaattctgaccaagaaagcacaaaagagatgagccttctcattctgtggtttggtactttgcaactgactgaattacagagcaagtggtctggttcttttagctctgcctgcatgggcttgatgtgggcaccatgacagttggtactgtgccacccaagagattcagaggagattttacaaaaacaaacacaaaacctcttctgtaggcagtctgggtagactatgctgttctgggtggggcaatagctattatcctggataaatattcctataggaattttagataggagcagatgacagagatccacaccccaatccctaaaatactgaggtgttgtcctaggcaacctggttaagatttcttccttttacatttgtgcgatgccctctatttttccttctcaagatgttcatgtagtgagaaatcgggctgtatggatgcaatgccaaaagaaagaaatgaatggaagccgttttcattgtcttcttgagaaagagatgaaataaaaagggagaaaatggagtaagggaaggcccatgtaggttcacattggctttttcatttcttcctttaaataaaaacataaccagagctaatgttctcatatactgctaaaggaaattcatttccaacaacggaatagcagtagaaactctccagaggcagtgcccaaacttatgtgcatgagaatctcctaaaaagcatgacaaaataaaagtctcggctttccccagaaattccattttaacaagtgtctaaaggtttctgaggcttcggtctgaggaacacttctctaaaaccacttttctatgaaaaggttatcattgcaaatattatattgcattggtaatttaagttacctataatttccgtctatgtgaccctggatgaatagcttcccttctttgtgacttggttttctcatctgtaaactagagagaaatactggtattggcaaagagcatatggcttggtaagagaattgaaactgttttagtccttctcctttattagctccttagctacctggtggcaagaactagatcgtacgctggtaaatagctggcactttagacatgtttgccaaatgaatgaatggacaaattcttgtatgaatgaatgaatacaaatgatgggatggcagaagccttagagcactttttcccccctttgctaaagcttgtcatcaagacttccaaattgtgttaaagttactagcccatatactttaccacctcaccttcctagagaatccagataatgaacactatcctttgctttctttgaaaaacctgtttttattttccagatcacagtggtgaacaattcttagtaatagtgacctgatcatatattaatagacatgaaattattagactgctgagctatgtgaaattcttctcagttcacactggtccccaggcaaccaattacacatttttttcttgctttaaaataggtgatttaaaaagcaagtatggttgagaagcttctctttcattggtatatctcactcttttaactctaccctctgatgcaaggatcacatttgcctttttttataacagtatatttaaaagtatgtgtatggaatactacttggcaataagaaaggaactgactgctaatgcgcacagcttggatggatctcaaggaaataatgctgagttttaaaagtcagtctgaaaaagttacgtattgtatgatttcatgtgtttagcattcttaaaatggcaaaagtatagagatggagaatatattagtggttgccaggtgttaggaagatgggaagggaggggggtggctatggctgtgcaagaggtagcgtgaaggatctttacagtaaaactcttctgtatcttgactgtggcagtagttatatgaaatcaacacagatgataaaattgcatagaagaaaatatacatccacatacataaatgagtatgtgtaaaactggtgaaatcagaatcagatgtattaattatatcaatatcaatttcctggttgtgttattgtactacatagaaacataagatgttaccattggaggaaaattggggaaggaatctctggattactttttacaactgcatatgaattattttgaattatctccaaataaaagtatatatgtgttatatacatgtctatttatgtatatctgtatgtatacacacaatacatgcatattaagtaaaccccatttacgcagttgtcttaagaaagtagtgtcattatacctctaatgggtctgcatccttctccctgatgccagtttcccttcctcacctccaagagaaaacactattctgaattttgtggttttcattctcttgtttaaaaataattttaacacttgtatgtacaggaaagattttaccagtatagcttgaaataataaaaagctagacataatataaatgtccaccaaaacgaaaataactagtaagttgtagtcaattcatacaaaggaaaactaggcacgagtgatataaactacaattatatgaatcaacaagattgaatctcaaaaatataattttgggtaagaaaactagtagcagaaatatatctgtatgattccatttatataaaatataaaacctgtgtgcagccaaaaatattgtttaggataagccatattgcaattttactttagaaactgaattatcaaaactctgcagctttggaggaatgtgggagaattggatcaattatctttaggatgatcatggaagtgtcatatatatggcttttagaatgtttctcctagtgaccctggttttatttttagaattggcttcacttcactagagaatgatttgaaatggaaatggtgtaatttcttccatttctgagaagtcatttgaaagatagtgctggttgccacttgaaattttctttacttgttccagagtgataaaaaaatcacccaaagttcatctcactggatggcttgaagagtatctttttattttggagaggaactgagaacctaggtaacacatcatgtggactatgcaaatgctaaatatcagtcactattatgtgagcaagatctagctagtacagatgctgatatgcattggtacaatttttaaaaatcatcggtttgtctttttcaatatctgcctttttatttcctctgaggatatgtatttctggggctatgactaccttcagggttaatgatataacagaaacactagtaggagactcattaatattctaaagactttacatatattgacttacttaatcctcacaacaaccctgtggggagcgtgaggctcatgctcaagatcaacacagccggctataggcagagctaggatttaaccccaggcagtctgtgctcacaacagttatagtcaactatctatacaaagctaaagacatatttgtgtgtttaatgtgtagacattttaaaagagataatggaaaaggtcactgtaaatggtgaacaatctgaaacatatatttaacacacacgactttataattcttcagttcattaagctcactctcttttaaaattgtttttaatttttgtgggtacatagtaggtgtatatatttatggggtacatgagatgtttagatacaggcatgcaatatgtgataatcacatcatggaagatggggtatctatcccaagtatttatcctttgtgttatgaacaatccaattttacttttctttattttaaaatgtacaaatagttattgactgtagtcaccctgttgtgcaattaaatagtaggcctgactcattcttcctatttttttgtacccattaactatccccactccctcccatccccctactaccctctccagcctctagtaatcatctttctactctttatctccatgagttcgattgttttgatttttaaatcccacaaataagtgagaacatacaatgtttgtctttctgtgcctggcttatttcacttagcataatgacctccagttctatctatgttgttgcaaatgactgaatctcatttttcatggctgaataatgctctactgtgcataagtaccaaattttctttatccattcatctgttgatgaacacttaggttgcttccaatttttggctattgtgaacagagctgcaataaatatggcagtacaggtatctctttgatatactgagtttctttcttttgggtgtatacccagcattggaactgctggatcatacagtagctctatttctagtttttttgaggagcctccaaactatttttcatagtagtttgtactaatttacattctcacaaacagtgtacaatggttcccttttctccatatcctcgatagcatttgttattgcctgtcttttggatataaggcattttaactggggtgagatgatattacattgtagttttgattcgcatttctctgacgatcaatgatattcagcaatttttcttctgtctgtttgccatttgtatgtcttcttttgagaaatgtctattcaaatcttttgcctgttttttgattggattattagattttttttacctgtagagttgtctgagctccttatatattctggtttttaatcccttgccagatggataatttgcaaatattttctcctgttctgtgggttgtctcttcactttgttgattgtatcctttgttgtgcagaagctttttaacttaatatgatcccatttgtctatttttgctttggttgcctgtgcttgtggggttttgctcaagaatctttgcccaagaccaatgtcctggagattttccccaatattttcttgtagtagttttatagtttgagatactagatataagtcttcagtacattttgattttatttttgtatattgtgataggtaggggtctagtttcattcttctgcctatggatattcagttttcccagaaccatttattgaagagactgtcttttccccagtttacgttcttggcacctttgtaaaaaatgagttcactgtaggtgtgtgaatttgtttctaggttctctattatgttccattggtctatgtatctgtttttatgccagtaccatgctgttttggttattatagctctctagtataatttgaagccaggtaatgtgattcctccagttttgttctttttgctcagaatagcttttgctattctgggtcttttatgattccatataaattttaggattgttcttttctaattctatgaagaatgtcattggtattttgatagggatttcactgaatctgtaggttgctttggtagtatggacattttaacaatattgatttttccaatccatgaacatagaatatttttccatttcttagtgtcctcttcaatttctttcatcagtgttctatagttttcattacacaaatctttcacttctttggttaattcctaggtatttaattttatttgcagtatttaagtagtatttatgtttgtgaagatgaagcaggaaggtttgctaactagagctgttttcttataatctcactagacttttggcttccctaggcggaaaaaaaaatcattataaaattgatccttaaaaagctcatgggaaaaaagatctttaatgagcacctatgacaagaagcaacagtagtcaggaatctctgtttttaacaagtacctttcctctgaccctgcccaattaatatgcttagttatagttaagagcagtatgtcagttaactgtgcttcccaaagagagatccttgaatggccagagccagagtcatctaaggtgcttgttaaaacatactttcctgggcctcctgagtcagattctcttaagaactctcacatgggaggatcactcttttagaacaagctccatcttcagatggggagatgtggtgagaaatagtccccatctatgagcagagtagggacagggtgtatagtactagtaatacagacattttcttcattccagttgagattgattacctttttattggcctcaaaatttttccgcctgtgaaatgccagttacttccttataccagattctattagcttatttgaaattggcagatgttacatattttgtattcagcatctggtaaatatttattgagcatgtactatggtgccagaggcagttccaggcactggaaatacaacagtaaaaaatggcaagtttcccactgtcttgaatgtctgttctattggcttgtggggaaccgacaataaagtacaaaataaatgctataatgttagactttcataagtactataatgaaaattatctcaacataatgagaaaaaactaactagtgcaaagggaatagtttgtttcctgaaaccaatcatagcaagtgcctttggagacaaactttggttgaacaagcctgcaactggatagatagatagtagatagatatagatatagatattacaaatcactttgcccaggactttgctacaaaatgggaaataattaaaaacatgaaaaaccaaggtgtctattttctgagttattcagattgagttgagacatgctatgtttgtgtataagtttaaggtggtttgaatggcaggattgaacagcgtgtactagaactttggttcagaaaatagtgtcactatgaactaaaacaatcgggtataatctaagtgatgatttgactaaaatcagagttttaatcaggattttcctccattaacaggatgaaaatgcataggaagaatattctaggaagataaaaaagacaacatgagcagagagaccatgagcatggagtgccaccgtgtagcactgcacacggtggaagggtttgggaaaacgaaaacaggagcgattcatgctctcttcactttctgtttgactctccatcctgtctttagttctctctttttttctttaagtattttttctttctttctttttttttttttttttttcagaggcagggtctcactctgtcacctaggctggagtgcagtggcgtgatcatggcttactgcagcctcaaactcctggactcaagtgatcctcctgcctcagccttccaagtagctgaaactataggctattcccagccactgctcattgctaatatttaatgtattttgttgttgttgttgttgtcgagatggagcctcacaatgttgcccaggctggtctcaaactcctagcctcaagcaatcctccgcctcaacctcccaaagtgctgggattaaaggtgtgagccactgtgtatggccctttatttctcatcttgcttttctgcttactcaaggcatcaaatggggcattactaataaaatatacctttctgaagcgatgaaaagaaaacaaatttcccttaagtgtgaaggaaattctctttcatttcatctcacctgtagtgtaaacagcctagaatttggggatagattctaatctaggtccttgtgcttctgggatgtgtggccttgtgattgttttttttttttttttacctcttggaatctcacttaattcatctgtaaatggggattaatattttccttggatcactggaaggattgaacacattcatgttatgactgttcaaaatttgccacaaactccaacttttctacttgtgagatttattcatttataaatttattactggaggccattcttctccaacctctctgttcagttttgttcttccaagtcttacttatctctgtttctttggcagagaatctgctacatacatgatagatggccatgtgatgcttaatgaataaatgaacaaatggagtaggaccaccctgaactcttgtttctatggagaagatctgagagaagattgtgagttgctgtacttcttcatgggtcccagttacccattagtcttttttttaatctgtaagatcacattaggcctctgattaccattcctgctatagtgttgcaaaatggcttccaggacgttggctgggagaaaataacagaactcggctttgagtcctatgaaaaaaaaaagctctgaacagattctaatagtgttttatgacattatttcttccattgtatactgttttctgtatccttgctaatatgtattggttaaaagtatctcaaaagactagtgagaagagaaaaatgaaatcatcttagagtatgtctcttgcagaacaagagacacagcagtgggaggagagtaagataatcagatatgaaataaagcaatttggacaagggacaataagggaaaagaaaaagaaagagaaagaagattacagtagtggggataaaggggaaatttgtggaaaatgttcctttgtcagttctaagactctcaggcccctgagggaggttctgaattctttttgcctgaatgttaagatgagaagacctagttttatttcctggctagaaggctatataggattcttagggttgtacggcactgtatgttcaaatgatgcaaccaccagcagtgacatggtctcctctgaatcactgcctgctaggcacctaagctgtgcttgcttgcctccaatggtgtggagctcgctatgcacagcagagacccatttcgtacttgttcttccctatacagaactgcagtctgtttctctgacatttcttcttgccaggatccttcgcaaacgtcaatgcctactgttgggtgaccttgggaacgtgatataatcaaagtcagttttctcacctccaagattgggataatagtatctagttcattcagtttgggtaagaaataaatgaaaacagtccatgtcaaacaatgagcacccccaggtccttacatgttttttcttctgtagattaccattttctcaccaatctgaaagtctttttgttaatctaccatccttccaaaattcttctcagttttcagattttatcaaaattatttggtgaccatccccctacacctcccatcgaatctttgcatcacctacacatggaactcacagagtttcaagaatgccaaaggctgtagttcacctgatgtattggttcaggttccctgctattaagttaaaagtctaagtgctccttgtcccttgccatccaggtccacaaatccaatgaagccctaagatcatttggataagctactagtgatttcagggaaacatacagagtgagatctagctgctcaatagcctaagttcatattttatctagttattttctttacatacttttaatcttattttgttagaaaagcaatacacaattactgaagaaaaatgagaaaataaagatgaacaaaatatccaacttatataaaatacccatatataattgttttagaattattgcttattttcctccagaattttttcccatttgatatacaaataggaaatatgttttataacttggtattatgttaaacaaacagatgaataaatcttctgtttgactcaaccatatattttgaaagtttttgaagtttgatgtcaccattgtctattgttgggcaattaggattacaatttttttattttatacacaatatcatagtgaacattcttgtatatatatctctctgcacttggatgactattaccttagagcaaatttctttacgtgggactggtgggtctaaatgcatatatgaatgtgggagttttttgtctattcatactgacaaattgacaccaagaaaggacacatctacatctacacaatttacaaatgtacttattttctcatatattctatgattatgtattactaaataaaaagaacttaaaaccatgcctcacacaataaatgttagctacagtgattcctgtcattattattctattactgttgttttcttgatgttgtcattattttccatttcttcccagtgaatagcctgtgatttaattaaaatggattatttgctttttcttggaagtatcccacatgtcaaatctctgcatcttgctcatggtttttgctctgattagaatgtctctcttcctcgtctgtcaatattctatccatccttcaaagtctatgttacataaaggtccttcattaagctttttaaattttcccctgaagccatcaactgcatgatctatctcttcatcttttgaacccctaatcgcatttgggacatccctttttgaattataggcatttgtattcttggtttaggatgtaactattagagtgtaacttgtttctttgactttgagaaatgtgtgtttcatagctgcgttgcctgtagtgcctagcgtcatgatagggacatagtaggtgttaaacaaatgtcaaattgaaggggccagatgttaatgaagtgtgatagtcttaagcatctttacaaagagccagttgtttactaaaaagaaatgaattcataggcaaatcatcacaaaaggagtttactatttctttttgcgatatatactgcccttagatactttcagcaaggcacaggcacacttgataattgtactttaggtggccttttcggaaacttatatcctgggagacacattttcgcttcattggcttccccagggctcacaaatctgaccactctcctactttttttggccacaggatgtttgcatagcatgatcagagaggatttgttacacagaagtcaacaaaaatggccttcgataacagggaaaatcccttgcattagcatagacacattgagtccataaactgatttcacagatgttattgcacaatttccaaggccaactgaagaggcttaaaactctgtggctacaaatttaaaaaaaagattaacaaagttctccatttattttggtatgtcagatagcactgagtaaactgttcttagtgggttctcggtaaataaggttgtccacccaccaggacctagaaaccgcagagtggcatctcaaaaaaaaaaaaaaaaaaaaagaacaaaaaaatgctatggttacactgatttaagcactcaccctgaaccctaggtttgtactcatttctcatccaccagctgagacaaaagcttaagagtgtgactaaggacttgtcaggcaacttcaatatctaatgaattatagtcattcctgatagccagagatggggatcatgatgaatccagcccgaagatatgctttttcaggttaatctcccaggctaaagttgtttttgtaatagtagctgacacactgggatttttgaaaaacctgaaaggaacttaagggatttatggatagaattttggatctagatggcacctaaactctagttccagtcctattatttgatgatttgtcattttcaggcagtcctactaggatctgtctcagcttgagagatgattgccataggatcaatacttcgtactgcagtgtttcaggctgcattctctgagtgggggtggaaggcagctctgggtgtttactcagccacagggaaaagagggagatctggagaagacagtgtgatttgtagagccaggaagccttgggggccccagcagtattagacaaaacctttatctctcttcatatgcagatgttttctctgtggattaaataattttgaaggaatgaatgaaatgcccccctactatgccttctgtttctccacaactcaggtagacccacttgaagaaaatgtaatgaaaggaagcttcgagtatattagtgatgttttatttcttatgccaaaggataagtatacagttttctttgtgttttatatttcataccttttgctctattttgaatgttacataacacaacagtttttaaaggaagaaaagagaaaaaatatagggttttgtatatttggttaataaacagttaatttgtgatgcaacaatatctttcctttacccaaatttctgtttctggtgatatggaactagcatggggtgggtaagggaagtgaagttgggggaaaagccatggtacctggggttcacgttcatgaaggatctgaaacttggtcatttgagattgtgtggaactaaggttatcttatagtcacagacgtacagtttcaagatcaaaagggaggctcatttatcaattttgcgctagttgtcccagcactgaaccacatagcccgaagtacactgtgaattgttaatctaaaaattatacatactcatatgcacatcactacttaaaattatacattggcatttcttatatttttacatatgaaaatattggaggagtctgcactttctctgactgtaaaagagtcctgttgtggagctgctacagcacagagacagatgataaactctgagctcagagataaaggttccagtctcagattcacagcaaatgggccatcgaagtcagggcttagagccttcttatcttttcaaaataatcacatgtgatgaaatgtgtgactgtggtgaagtgagactctttaaaggccgtaagcatagattacatgtcttatgagactgatgcactgctggctacactaagagggcagcctcttgtgtattttaatgttggttaaagtttcattgagcccttcctttgttcctaagctctttacctatattttctcattttatcttcccaacatcccatgtgatagcccctatgattatcactattttactgatgaggacattgaagcttaggagggttaagtaacttgtccaggttctattattattagttttctgagcaggtatttgagctaaggacggtctaacctcaaagtctctgtgtttaaaccatatgtcatgctatagccattatgggcagtccgaaagctctcactgatcaattttttgactggcatagagatagagggctccagccagtcccaagtagagtcagagacttcttcaaccccctaggtattttagcactacctgcttttatgaaaatccattcacgttaaagtagaagtgaatggtcaattagtaatatgattattaaactgtcaaaaatctagcctttttgtaaatatttggcctgaagtacaagaggagaagagaagttctggctgtagtacaatttagaaaaccattttataatgtttctcttaagattgttcaaatatatttcaatttagcaataaacaagaagagagaaaaggaagacatttcaatcatctgacaaataatgttaagagaatgcattgggatatttaattcctaactaaatgtcatcttttaaaactcaaatgtccttgggtggaatgactaatgaagttagtttacgggaaggcaagtttaacagaatggttacatatccgggctgtagaattataccactctaggtatgaattctgctatttcataaatggtgatgatatagaaaggagatgaataaaacaattcaagctatccagtaatccaaagcatttgccctagtcatgattagatatgtgccataagtagctatcaaaattttcacaaatgtatgtaacagaaaatccaattcaaactcatttgaaaaaaaaaaaaattggttcagctttaagcatcatgagctagctccaagctaaaatttatttcatcaggatccagcaacctgcctttatctcttgactgccttttgttctttgttagctccattcttagatgattgtcctaatgggatgtcaggatggttgcaaatgagttcagtcttagattcagttttaagttcagaattggaataccttatttcttagtttttcaaggtacagtactagggttaagtttgattgaatcaattgtcttggtctctgttacatccctataagcattcatggagtcaagaggatggggtgttccagaagccaggactgtgccccatttcttgcaaaatcacatcgtgctagtatgaggaaagggatttcctagagacagttggagtacttttactaaagatggggttgataaattgtaggcaggaaaaaaaaaaaacagaattctatacatacattttttaaaaagatctatgcactactggatacaaataaggtgcatttcctttctggggaggaatatgcatgcttccaaaagggaggcttgccagccacctgacgatgggttgcttctttccaggctgttctgagctctggtttagctgctgatttgaaaagtcccctcttgcataacaattacacctggcacacccacttgggagcatgcaggagaattttcttcatcctttcttaaagatgcaattgtttctgacagccagtgtcatctgcgttgacagatgtcacttctgactctcattccccgcagacaactcagctcaaggagaccgctaggctctcacaataggtttaactcttacctacaaaagccaaagcactgaaatgtttaggtttgtgggattctcatggtaatataaataggagggtgagggttctctgtgcaataacgcacaactcatgtactttcctagtcaccacttatcaggtggtcttcaaattatttgttcaaatacactgcaatgtaaactctaagagaagcagacattgagtcttgtgctttgctttgccctttgtgactagcacagtgctgggcacatagtagaagataactatgtagtagaagatagagaaatatttgttgaatggctgactgaatgactgaatatgggaattttaaatgaaatttagcactaatttggttatcgtgtgtgtctgtgtatctgtgtgttacaatataaccagggcctgtcatttcttcctgttgttcatatgggaaatcgaggcacagtagttagggaatttgtatcaatcccaataggtaattaataccatggctgaaatatagatgttttagctctatttttgaaatctcttattgaaatttcagctctctcaaatatttttaatagtattttccaattcatttacagcctagttcattcaacatatactcattacataattactgtttttcagacatgtttacattctcattttgattttgaacctcacagcaaggaaggtatccctatcttcaccctatatgaaaaggtggaggttcagtgggtgatgtgaattttataaaatcaggaagagaaagggtaacaccaagaatcaaactgagttcttctgatcccacgtctgatgcttgtctccactgggaaacgatgccttgtagtctattgagtatgtgggcattgggggctccctttaagtctcagaggctcttccgtgtagtgaacttcatgactgacatgcttctttactgagctttgttgatgtatggttataaaacagtaatagcccagcccattatttttcacaattatgactgctgttggaattcagtctagactttgccattgatttctcattcatttttttccagacataaattaatgaaatggaatagaaggctgaaagatcaccatatgcacaattctctttggatcttaagatctctgagtcacaatttttcaatgactgaaaaatggcagggacacaaccttttattttcatcagctcatcaaaaataataagaggaaaataaattttgagtacatggaacatcagatttctttgtctaaatacctaacttggaatatattctgctgatggctcaatgcctggctgtctgacttcttaactgaggttattagtaaaagtaatatttttgaattctcagccccaccactatggtatacatattttcttaaatatgaatgctttagaatttttaatcatggatgatagaaataatgctcatagtgttatgaacaaataaatataatgccttgatgactccatttagtatttttcttctaatgatctcaaaaaagatttccataatctatgttatttttcatgtactttatttatttcccaggtgtgcaaattgtggcatggaaagtttgagaaatgtttcaaaagaagataatcaattaatttatttaacttttaagttcaggggggtacatgtgcatgtttgttatataggtaacctcatgtcattggggttcgttgtacagattattttgtcatccatgtattaagcctagtacccattagttatttttcctgatcctctccctccttccaccctccaccctccagtaggccccactgtgtgttgttaccacccccaatgtgtccatgtgctctcatcatttagctcccacttataagtgagaccatgctgtatttgcttttctgtttctgcgttagtttgctaaggacaaaagcctccagcttcatccatattcccacaaaagacatgatcttattctttggtgtggctgcttagtattccatggctatctttaccacattttctttattcagtccaccattgatgggcatttagattgatttcatgtctttgctattgtgaatagtgtggtcatgaacatatgtatgcatgtgtatttttgatagaatgatttatgttcctttgggtgtacacccagtaatgggattgctgagtcaaatggtatttctgtttttaggtctttgagaaatcaccacactgttttccacaagggttgaagtaatttacactcccactaacagtgtataagtgttcctttttgcctgcaacctcgcctgcatctcttattttttgactttttaataatagccattttgacttgtgtgagatagtatctcattgtgctttttatttgcatttccctaatgatcagtgatgcgagctttttttttattcatatgcttattggctgcatgtaagtcaaaagaagacactttagattcaaaggcatgactctgaattctttatcttctccactctaccaggctgctggctttgactatgcatttttggatatgagaaatagagtcttaattaagacaattcaaataaagtgaatagcaagctgtcataaggatttttgtgaaggtaataaatgcaataggaaagattacacgtaacctccatggataagatgctttgttttgcttccatgatgcagaggttttgttttcattcatcatcgtgaatgaaaatgttaacatatatttaaatgaataataaaaacaatagtatgaataaaaatagctaccatttattgagtgcacaccatgtgccaatcatgatgccaagacccttacatagatcagtttatcctcctaatagtccaatgaagctagtagtattatcccatttttacaggtgagaaaaatagcaattttagtaaatgtccagctcaagattatatagctagtaggtaaaggaactgagatggaattatagaactacagatataaaagccagtgccgttagccactaccagaacccaaaaacatgagctgctggagacaagctagatctagtgagatgcttagtattatctcagaccttatttctttttcagtctttctttctgtctcatggcccacacacggtcttctattgcttttactaattttcttctcttctctcactcttgacttgcctattccctccttcttccctgaaagttttctattcagactatgacttcttcttccttatggactctgcttcttcataacttgggattgccatgacctcttgcatcttaactctgtctcagaagattaaatctatctcatactctcatattttaaaaaaatctatttaatactttaagcttcagttcctgttgccaatcacctcatttcttatgagttttaaaattcaaattatcaagagcaagaatccagttagtccagctccttttcgggggccagcctaggttactgggaagcctgtgtatgcattgactgggctgagggctggggctgagcctgaggtgggtcttctgttccctgtgctcccctgcacagcagcctcccttatgggctatggggcagccgcaggaggggcaggctgagaggggctgccacagcttttcactttggctggatgtcagaggactcggacaccagcttcccatcgcaggtctcaatcatcttcacgaccacggccctggcggaactggtgcggctgaaggagggggaccccgcgccagagccaaagctagagcccaggccatagctgagaccgggcttgtgagacccccataggctgagctcagcacacctccaccgccactggtggtcttctatggatactcctgttctgcatcccagactccagccggctctccttgccctccagcagcttcctgtaggtggcgatctctatgtccagggccagcttgacgttcatcagctcctggtattcacgcagctgccacgccatgtcctgcttggcccgctgcagggcggcctccagctcggacagcttggcgttggcatccttaaccaccaaatccccgtgcagctcggcatctgtgatggcggcctccagggaagccctctggtcaacatgagcctggagctggctgatgttcccgtatatctaggagatctcagtctgtgcgccgccggtcatccccgtgcttcccagccagcgtctgcagctcctcatacttgatctggtacatgctctcggcctcagcccggctgcagttggcgatctcctcctactgtgccttgacctcagcaatgatgctgtccatgtccagggagcagctgttgtccatggacagcaccacagacgtgtctgagatctgggactgcagctcccggatctcctcttcatatagctgcatgaggaagttgatctcgtcagtcagcccttccaggcgagaccctagctctaccttgttcatggaagcttcatctgcatccttcttgatgaggacaaattcattctccatctctgtacgcttattgatctcatcctcatacttgttcttgaagtcctccaccagcggctgcatgttgccaagctccgcctccagcttcagcttctcctggcccagtctccagctgccacctaaggttgttgacgtagctctcaaacatgttgtccatgttgctccgagccgtctgctgctgctgcaggaggctccacttggtctccagcatcttgttctgctgctctagggaccttaccttgtcgacgaaggaggcaaacttgttgagggtcttgatctgctcctcctgggtgcgcatggcctggatattggggtccacctccaggttaagggggctcagcaggctttggttgaccgggacggtggtgatgcctcccacaccgctggtcccaccatagcctccacccaggccacctcggaagctgctgctgcccacttaagagaagttcgaggagctgagcgggctgaaccaggcagaaattccagtaggagtggagaagctgcttcttgctccaatatgtagtcttttatccctcacctacctcctacccttcccccttaagtcctcaaagtccattataacattcttatgcctttgcatccttatagcttacctcccacttagaacatatggtatttagttttttattcctgagttacttcacttagaataatggcctccagctccatccaagttgctgcaaaagacattattccatttctttttatggctgagtagtattccatggtgtatatatacaacattttctttatccacttggccgatgggaacttagattggttccacatttatacaattgcaaattgtgccactataaacgtgtgtgcatgtgtctttttcatataatgacttcttttcctttgggtagatatctagtagtgggactgctacattgaatggtagttctacttttagttctttaaggaatctccatactgttttccatagtggttgtactaatttacattcccaccagcagtgtaaaagtgttcccttttcaacaaattcatgccagcatctattgttttttcactttttaattatggtcactcttgcaggagtaaggtcgtatctcattgtggttttaatttgcattttcctgatcattagtgatattgagcatttttttcatatgttttttggttgtttatatatcttattttgaaaattgtctattcattcctttgcccactttttgatagaattatttgtcttcgccttctgaattgtttgagttacctgtagattatggatattagttctttttcagatgcatagtttgagaatattttctcccactccggagttctctgttaactcctctgttggttatctcttttgctgtgcagaagctttttagtttaattacgtcccatctatttatttttgtttttgttgcatttgcttttgcgttcttaatcatgaattctttgcctaagtcaatgcctagaagagtttttccaatgttatcttctagaatttttatggtttcaggtcttagatttaagtcttttatccatcttgagttgatttttctataaggtgagggatggggacccagtttcattcgtctacatgtggcttgcttagctgggactttttaaactgtatacaatatacactttatgtaaaaaaataataagtaacatagtttaatgttttttatatatatatatattatatatagagagagagtttaaaaataaaaggaaatgtttatgcttgattcagcagtgctaccaagtaacagggactttctttcttttcctctagccttatcttccctttctgttagtatcactctcaagtaaaattcttctacatacagctcatggaaactgagaccttatatttctacgtgtccaggtttagcaaaaagaggaactatgcctctatttttcaacaaaatacacaagtcctagtaataaaacccagattgtgtctcaaaggctcatattgggtatggactcattcttgatccaaccgtagtagttgggtgagtaaggaggcaatgaaatgctcacacaagccaaattaataacttgtcccccatagaagctggagttgagatgaaaccaatactatataaacattttggactgtaagtaggataagggagatttttcagaggaaaattgggggctcccctctgaagagcaaatgagtcatgggcctacagatttttccatcacagcttggacctgctatgctgggttttgagcctggaacgggagtaaagactcatgcttcctattctaggtcaccagtagccttatcattaataaaattagtagagataaaggaaatgagacttttcctatgtaaaccttggtatatgacctacagcatgatttccatttcagaacttagtagtgtgacagctcctcagctgaaatgaacaggtacagtaggtcagatggcttcaggaaagcccagtttcttcatctctccaaaagatgattggatgggttctgctccctattataggaagaaacaaggtcttgaaagaaaatacagatggaaaaacaggaggctgaggtgtgagaggaggcagatcatctgggaaaaatggatttttttaaagttttggttatatttctgattagttatgtgacctcaggcaaattacttaataactttgggcatcttcatttgaaagacgaagaaattgaattttttttattgtttctattactttgctgaaattccccatctgttcacacatcttgtccgtcatttattctagtttttaacctacattttatcattctttaaattttctatgttatactactgtatgtctctattgattatttcttatattgaccatgggtcacatgttcttccttcttcagtgtctctctctctctcttttttttttttttactgtgtcttatgtactacgtgcaaaagatcaggtgagacataagtaagcaatatttgcctccagaaaatgacatgttccttattctgtgaggctaatgtgttgggagctgagtcaatctaatctagttttagctttgatgaagcattagtttgattcagttcacctgaaaaattttaacttcacaaggacttgagatgtgagtactggtaagacttctgggatctctgtctcagagcctctcctggcattttgaatttgggtgctgtttagaaatttatttcctaccacattcacatgtcttaaaaatatcttccttatcagccaggactttttaagttgtatatgataatatatatgttatgtaaaatatgtaatatacagtttagtgttttatgtatatacataatagagagagagttgaaaaataaaaggaaatgtttatgcttgattaaagcataaactttatggaatttctcttagtcctcctgccccacattcagcctttggagcaccactgaaagttggagaaccaacttgttgaaaacctgagatcacctggatgactttctcttagttctcctgcactgctgttattcatcagaataacacactcgagcacccagaaaaagcctctgggaaagaaatggagaatcggtgcaaagtttctctgtgtttgaggcttcttgggattataatctctcatgatgcttgcatccagtcattaaaaatttattgaaagttagcctagtttatcttcattagcattttactagattttccttcctcccccaatactaccagggttaaagtaattgttttcctctgttaggaaggtcttaccattttctggaatttagctttttagttttccttgcaccctcagacttctgtagcttatccagtgtacccttcttagggatactttggaaatgatggtcttctaggccctaatcctaggtcattttgaatgatagcttctaaattctaaagtcattggcaatctgaataaacagagacaatgcggacattagatatttgtgtaatcagaaactgcctcataacttctctttttggctttttgatagttgaataatagactcagcaacacagcaactaacaggaaaaaggggatgatgtaaggtgagataccaacacttgcttaaagcaatcctagtcaggacccagcatggctaaagcacatagtggttttgctcttattgggttttggctgctttatttttgttatgattgtttttttctattataagtattattttgtttgaggcaaataaaatgtcttctttatatgacaggtgttaaggtggttacttttgcttttagcgaatgcataggaggaaaatctaagctacattctatgaaaaagagctaattttgaccaaatatcgagcagctacgtcatgagtggagttagcatcgctgatgggtctctacactagggatagttattttggatctgctgctgcgttgttgcatagggaaaagagaaaaaaaaaacaaacaaacactttataccccagaaaagtggaggacagaggtttgactgatatctcagccttgaggcactgactctctcttgctgactcaagaattcatgcccctgaggattctaggtctaacttaagctcccagtattcctgctctattaattaaatcatccacttcacacaggcataaggagattctacttacttttgaaaagtctaacctttctagcactttctcacatttcttaatgttggccttttataggatgaatagttcagtccccagaaagtctattaaatcatttacaagggcaaatgaatgacattatgtgcaaggtgagtttgcagcagaattgattattttctcagctgatatcagtggaaatctactgagtctctactgtgttggtgaaaaacagatcatgtttgacaaatgtggctggatatttttatacatttcctctattgactgataagtgggagtgagggaggtggaatttatctgaatatttgtaaagtgcatgacactgagcacataggtggaatgatttatgaaactagtaatgcttcctttcttgggagagtagaagtcatctagatcagtgcttagaaatataggctttggagtcacctgggtttaagtcctgattgcaccatttgtttgggcaaatttctatgtcctaattttctcagggtaatagaggtatctattatttatctcttgttgttcttttgaatatgtacaatggtatttgtatagaattttgcacagtgcctggcacatagttggttctaagtggtaattattataataggaggaaattagaaggcttcaagaaaactcaatagctagtatcataataactctcgtggactttcttcagttgtacactcattttattctagcctggaggtgtgattgaatattttctgccagtacaactgactagcagagaattagttgctcaaaatatgttcaactttataatgcataagatttagcctgagtgtctggtttgatattctatttaggtcctgcacagttcaatattaaatggagtttctaccctagcatgaaaggaggaagagagaaaatcggatccaagagaaattcggctccaacattccccaaatattagagtgagaccatctggaattcaaaatgttattgtaggtaactgacagctgaatatcggaaggtatagaaaatggaaggctaagggggacattatttctatgcctatactcaggtgagaatgttatcagggtcatgagttacagatcctgcataatgatgccaaacagcacaaaagaacagttattaatattgtatcagattatttagctatctccttacccccttcccattaccaagaagagaggcaagaggcagagtgtgtgatggttaagataagccaagaggctggcatcagggaatctggatttgaatctttgtattgcctctttgtacatcctaggcctcagtttccccaactgaaacactgtagtaataatgcttacattactgggttcttgtgagttaaaagaagaaaaggtatgtaaaatatgatgttcaatatagcttaatttttctttttaattcagaagaaaagctcagtcttatatattccccctcttaaggctgacggtgcataaagaactggatgtcaggtgaggtgattctgggccataaaccacattttcaactatacactcacagtggttattacctggggtctgcatagaagaatagaaaaggtgatgagggagcatttcttactttattttctgaattcaggctaagtatctagctgtgtgtaagagctttgaaatctgcaaggtatcattggtgtcagtgccaagaataaaactgtgccaaaccaccagtgactgccctggcttagccaagcattgatcagtcaaggctcaaggctttgagatatgtgctaggagctgttcttgggaaaaagaatcactgactatagagtcagcaagccagcaacaatgtgctcatcctttcatcagggatgtcagagggtgctcataggtgccaaggggcttgcttgcagcagatactcacagtcaagacatctccctttatgagcccttttgtggtctcccaccatttctgtccaactgtagggtaaaatttcttatttcaatagagaaagttttcaattactggctgctatcctaattatataaaaagttagatgcccagaacaacagaatggaatcttaacacactgtctcacttatctttgtggttccctgggcttagcacaaagcttaacatactgattctttcaaaaaaatgtgttgatcatctcctttatattctcacatctatttacgtacagagacatccaacctaatttatcatgctcattatgcagataagaatattgatgttcaaagaggggaaggaacttgcttgctcaggattacatccctactcagtaattgagtaacgctagagttctttgattgcaagcaacagctatgcattgcagtaacttaagcaataggcagataaatcaacagacaagtaagaagatactagacaatttgtggaattgaaggtagagcttaaggtttaggttttggaaaagacatggataagcatcctgaggggtcttgatggcaggaactcacaagtagtctctccatgattctgcaatcaggtctttcatcctcagccacctcatgtatgtgactccccaagattcaaaattctggagggagattctgattgtcatcaagtcaaatcttcagtcctttacctaagctgtggtcagggactctggattccatgattgacgtccctccagaacacacagggtcagagtcagggtcaaattctcaaaggatgccgagaaaccagaaagacaaacaaaaacatgtatgaaaagagtatacactgcctgtttgaaacagaacaaaccctttcccaagggcaaaaatttaactttaaaacatatgcaatttttctaaaaagtttagaaataggtacccgcttgatataaaatgattcctttaatgattcctttaatgaatgtagcttcagaccgatgggtaatgatcaaggcccttggggctacctccagcttttcttcctgatgcatggccctgtttctgtgttggaagtaaggaaacttgctgttccagggcttaacctatatctagagaatgattcagatataatgaagaaagtacctggtgttataatatcttagcccttgctgagcatttcaatcccttaaaaaatcctatttgcaggatttttaaaaactgtattactcatatcttggagaaaacggggggtattctgaagtaaaactttgacccagggataaagcacattagcttgaggatgaagaggactgggtttgggtctgccatttgctagtttggacaaggctgctttaccttccttgacctcaatttgttaatttatattattaatgaagatgttgaactacacgctttttattgaaatagtatgacaagtgaatgtgaagataaataaatgccttaaaacttaataaaactaaatttcactttacggatgagccttactttcatccttttaaacacaattttgagacatacaaaaacagacaagatagacaccaatcaaacttcaaaaaaattatttaaattgcttatctatcctggctcccagacaatgcaaatcatcattgatatactatggccactacctctgccctctgatgaacttgttgttttgaatgcctgagcactcttagaagccctctctcctcactactactaccctaagttatgagtaacttggataaacaggtgggcacagagggttaacggcccacccaccctctttttaatgactttctcagaaacagaaatgtgaggcaatgtgggtattcaatcataactcttggatctcatttgaggctcctgggcaagttcctctctgaatataaacattaaacagcaaataagcataaacaaagagaacattattagagagattctacaaatatcatatagattctttctttttatgtgtataattaaacttctttggtggtgcctatagagtttaatactcatattttatttccatcactgcaaggagataggaagtaacattggatgtcagcaggtcttcttgaataacccagacactcttctgaattctaacgatagagccttaagcctttttctcaaggaacccacaggtggtggggtgtggagagggagtgctctccattatcccttcaatgcatgataaatagttgtaatcaatatctacctgtaagtttggctaaaaaccagcttctgcaaagcccagccaggagctcaagtgttctgttcccccagctgtcaatcagagtagggagggcatgaaggagacataggagatagattcatgaagaatacttgttacttttatatgtgatctgcaactttaagaattttttttcctgatactaccaaaatgaattcatcaaaagatagcctaatgatgaggcttttctgccactttgctgttattagactccagggagtaaatgtctcttattatcataaaaagggaaattatgagctttttctccaagagctataagacaatcttatcttcattttcattcttccaggtggttatgttgaagatgtaaatattctccctgctgtgagtattactgcagctgcccaaagatgctttattttaaagatgtggatacaggaagataaaagcatcagaaacactgcatggggtaagactgtcctggctgccagggtcttggtttagacagtggtagcaatgggacttttgctgggacaatgttgaagctgtactttgtcttagtcaaggtttgttttttgttacaattatcatgtgtctcctcaaatgagctgaaatattaagaggctataaggatacaggagcattttagggggtgttaattgtagtctgacctctgaagagtctgggttgaaaaattgagtatctattctctgtctctcctctctctctctctgaggccatatggtctctcattttccttcagttttgcacctccgcttcattcttctcttgattttcaacactcctgctgaatctccatctctgcccatatggcagaagacagctgcccctggcttccttattcacatgcccttgacattcacatgtcaagcggggagtgaagactaaaactctcacatctttttcttcaagctcctaggaaagagtctctgatcagcccagttgggcccattttatctacctatggtttaatcaggaatttcttggaaatcctaaaggccaaatgtggacccccaagaaaaaagaactccttaggtagcattgtggtgagcacttcatgggcattgtctttgtctaaagttcatagaaatcctatgaggttgctattacagtctaattttctatgtaacaaagcagagtctcaaacagttaagtaatttgcccaggatcatacactgacttttatttcttttagagacagggtctcactctgttgctcaggctggagtgcagtggtacaatcatagctcactgcaatctcaaactcctatgctcaaatgatcctccagcctcaacctcctgagtagctagggctacaggcgtttgtcaccacaacaagctaaatttttgtttcaatattttattttttgtagagatgtggtcttgctctgttgcccaggctggtcttgaactcttggcctcaagtgatcctcctgcctaggcctcccaaagcactgggattacaggcgtgagccactgctctcagctccctcaccttccccctcaagctttttaccactaccatctcttgctcctaaacaaggtttctcaaatttcagtcagcatcagaatcacttgcagggctcattgaaaccaagatatttgggccctatattcagaaatattgattctgtaggcccaggaataaggctgagaatgtgcatttctaacaagctcttttgtgaaactgatgctgttagtccaaggtccaaagctacttggtccttgctactttgagtagtactgcttgctctaagcaatcaagaagttaatgttctcatgaattaagaaatccctttgaattgtagctatactccataaataatcagaataaaagaagttcctgtgagctcatttatttgctttgtctaatcccaatattttgctcattctgtttttaacacatcttcctaagaaagaaaaccctttctgacttgggacacttgcatttagagggactcgcagtagtcctggatacatatataactttggaggctattatagaagccacttacataattttccccttaaccctccactgagatttttaaaaatcactacaattctcatcagagaagtaattctgaataacgtttcctcactaggagatggcagagatcagtttcctgaactagggtatatatgaaattcactcttctaatcccatatagtttcaaaaagttttgtagtcagccaggaaaatgaagaaactactactacacatagtgatgaatctcacatgccaagtgttgcatgagaaaaacaaagcatacttcatgcctccatttatataaagttttaaaaatcaagatctatggagatggacgttaagaccagaccgtggttgctgttggggcaggatagtgactgccgggcacaggggtaggggttggggaggtgcactcccaggagttggtgatgttctgtttctgatctggaggctggttgaataggcatgttcagtttgtggaaattcacaagctcgtatacttaggagctgagcgcttgtctgtgtctgttgttatagccagtataaaagattcagaggtgtttaaaaaatgagtcatttgtagaaaggcagtatatgaattgtattgacaaacctattgcaaatgtgctatacatgtagaaagaacaagcctgaaaggaaacattccaaaccatgactgcttctgggtggtggaaatgtggctggatttactttttgggcttttctgtattgtctaaattttctgcaatgtgcatacattgcatttattaatatatcttaacatgttcagtttttatttaaaacattgattttgttaaagtagaagtaaataggaggacccaatcccaccaaattcagaaacagaaactttctgcaaatgtctatttaatacaaatgtcagaacaaaaaagtggccatgggaattgtggggccttgacaatcactttatcccatgtaaatggtatttcccaagggcctctttcaggttctattggtaattataaaacaggattcatgaggaaagggtacttaggaagcaaggaaatgatcattttgtgaggtttgcaaaacagaatacaaatgtccaagggccaagtaataatgataaattagttttttgaccaaagctcaaagatgctaaaatctccagaaaatccatcaaatgttccccaatactttcaatatttttgacagtgacaaaattgaataaaaatatagatgtgtttgtggccagaatttataatgcattctttcattatttccccttggaactctagtaggataaagcttttcaaagaggttatacattttatgttaagcatctcaatgtttttgatgaaacaatttaactttcttgaatatcaaagaggaaaaaagaatgatgatgtgatcttcaattctggtctctaactatttcctgaaatttcactgtccctgcctatatcaaacacataaggaaaggagaggagccatggataatagagcccagtgctaatctggttggctgggtgtagattgtacttgctatattttggaatcagtctcctggggtttgaattctggctctcccagtcactatgtatggaacttagggaagacaatatagcctatgtgaatctcagcttcctgggctataaaatgtgagtaacttttattccttcctcatagggttattataaggattatacaaaattacatgtgtaccagttatcatttttttgcttttcatctccaaatttacccttcgatacctgctctgtaataatggtggactttaagcatttctcctttactataagcacgatgttaagctttcttagtagcaggcactggatgcacatcagaggagaaaagggactctcttgtccagaagctgcactgacagtcattggtgtggaggggaagacatgtggtggggctctgcccttatcatgaagccagagcatgagtccctccatgactcagcagccccagttagtctcacctgtccatggtctttccaatggggcactgcacattcaagctttcttcccacacctatccaacaccctctgcaagcctgcatgtccagttaccagccatatcacacctatgccccaaggtttacttccggcttgtccagcaactgcggactggctctgacctagcaaaacagcacatttctctaccacctagtgagttgcagccttctctaatcaggtctgaatcccagccttgggaaggtggcccccccttccaagtttgtcctcttttggatactctccctcagctctgctaccatttagagttctgtcataattatcattttttacttggattctgcaaacttttcttgtaaacaatgtagtgagttaaacggggggaagctcagagtcaatgaaaatacagtctagggacaaatgcagccagtggcgtttgtgcagcttatgttctaagaatgtgtttttacatttgtaaagaattgcttaaagaatgaggaggaggaggaagagaaggaggagggggccacaaatgagaagaaaaggaggaagactagaaggaaaacagagcttatttggcctgcaatgcctaaaataataccatctgatccttcatagaaaaaaacatccaagacctactgaagtacaccctagcagtgtatattttaacaaaccctcccagtgattctgatgagagctgaagttgagaaccactggattaagagagtagctgattgactgaccacagtgttggtccttaacctattgtacaaatgaccaaaagtaattgaggatttgtgtgggagctggcagaaaataattctcttgagtagtgtggtgtgaagatggaagttccacagctgttttggtaccacaaggggagtgtctggagctggcaggtgagaggcaagatcctgaggactaagccaacaccacaataagcaagacaaaaaggcaggcagaactcaaggcctggtggattccttgaagctgctggatcaagctcacctgactcaggacttgtcagatacacatgtcccaataaattcactctagagaggtgtttttccacttcagcattgttgatatttggggtcagataattttttgttgtagagggttgtcctgtgtcttgtaggcttcaaccgcatcctgggcctctactttctagatatcaatcagcccagccccttagttgtggcaaccaaaaggggtcttcgatattgccaaatgtcccctgggagcaaaaatcactcatagtcaacaaacacggctctagagtttcaactggtttgacctgtgcttttggacccggcattataaatatttaatggatcctgtacgtgttcaagcattggtatatattactaagattaacagattcaaaaagtttctcttagcagaaaatgtccataatcaaggagattatccttgagatactgctccttaagtgaatagactctggattcttgctttgcagaatatcataacataaatgtcatctcaaaacccacattccgtattatccccagaacttcttggcatggtttctaatgggcttgtgctcaaagtttctattcccaatgcatgtttaactttgatgtgtgtctttctctctgttctgtgtaacccacatgacactctgttctcattttctgatttccatgaaatcacttttgagggtggagcaggcatggagagcaaccctacaaagggcagtcaagaaaggaaagacatttgatcttagccaaaaggctgagaattgagtaataaaggatagaaacaaggtatgtgtgcttaccatgtattctatcattgttgggtatgaatctttgttatctgatttggtccaggtgagactatcacattgactaatatcccctgggcttcacaaactggaagggagagtagaatgtagactggtcagattggataattaccaggtttagttaggtatgctctagttttgctcacttaaaaagatcctctctttctttctttccttctttctttcttctttttctttctctctttttttttttttcagagacagggtctcactctgctactcagattggagtgcagcagcatgaacacaactcactacagcctcgacctctcaggcccaagcaatcctcccatctcagccccccagtagctgggactacaggcacttggccactatgcttggctaatttttttttctttttttggtagagacaagtttttgccatattgccgagtctggtctcaaactcctgaattcaggcaatccacccaccttggcctcccaaagtgttaggattacaggcgtgagcccctgtgcctggaccatttcatttgcttacatccatagacttgtaagctcctctaggtttgttgagtacttttttaatatttctggttaggtctcttttccacattcttaacactaagtgcattgtgtgtttgcttaagttaatttgtgtagagcttgactttaagaatgtactccaatggacaacatagatacatgcagatatgaagcatatatttactaagggtacagagtaataggcactagaggtgggaagtgatgctgtaggtttacaagcagataaataattgtctctcagggcttaaaaaatcttataatgtgtggtaatttaggcctcaggcataagtctttagctcaatttcttgaccctcaccaccatcctccagcaaattaaaaacaaacaaaagaacctctcctattgtattatgaaggcagttcatctctctcttgatcacctctaaactcactttgaggtctctttgcacattcagatattcatcactgtcctcagccaacagagaaccttcttctccaggtcttaccctttgtctcatctctaccagggagcaaagtaatataattccacaaaatacagcatcctgtgaccccttcaaggaaggacatgctgctcagccctatgagaacagggtcagcagacagcatctaggtgtcagctccttcaaggttgccatcagctgcagagcctccctgcccaaagtcatgcctttcctgaagaagcctgtatccattggattgtattgagctaagtggagacataaaaggacaactagtttggtttaataaaacactttgaaagtctaaacttgctctaaagatttcccgtcaggttggccaaggctgtgtagggtctgcacctcaaatcttactcagcatctccttttggggcacataatctataatagagacttatgttcccataacataaaagaatccatgcttattctttacatttttgagtgcctactctatgccagacagacactgtactaggtagtgggattacaacagtaaagtgatacacctgtggttttggtcctgtggagcttacagtcttttggaggaaactgacaaatcatacccaaacaaatgaaaatggatgggtgaatcaactggaagccctctagtttatgttgtggactagttggtattttgtataccttcagtaaaatgacccaagcaattttactctgcatcttttgacagaattttcttatagaatattggacagccagttgtcagtgggatttctttcagttcagtgaattttgtcttttgcctcctcattctttattaagaaaatcattcagactgcagcttcctggttttagacatccccactggcaattgggacatctattttggagatgtaattgaaaagactgaagaatgtactgaggaccttctggctgatagaagctgacaaagaagccaagattggtgaagatttctgcaatacctgagtttctaatcacaacaacaaaaatggtatttatttcctattgacccaaacagtggcaacgttttagtcaaggtgatttagaggaggttagaaagagaggtggatgcttgggccatattaaaggcagaaaatgggttattctcccattatcttttactcagcaatttttttatctccccaaaacactttgagttgaactttttgtcccctgggaattggacaggctctagaaataacatatatagattggttgtatattttctcattaaccattatctttctaagctccctagtggcaaattagctaggtctaagaagttattatggcatccaagccattgtgtttgttttgggattatgatgtaacccagaaatattaactccctcatgttggtgcctagagtcttggcaaagtcccccttagttagctagccagtgtttgaaataaatccataaataataataatagttaacaattactgagtgttcactatgtgctaagcagtgtgccaaatgtttgatacacattttcccacttaagctatgcaagtattctataaggtagatgttatcatcatttcccttttaccaacatggaaaatgaggtttgggtgggttaaataatttgccttagagacatagctctgtaacaccattaccttcatcataaattaagattccattcatttggaagccactaaaagtttataatataactgctgcatcttcagcaactcacaacatcttgtttatacattacttctgacactgttctaataagcctctgtgccgagaattaaaaatgttccagtccattttaattcaatccactagaagattcacatggcccacgaaatgttttagtttctggggagggaaaagaagacaaaaataaaaagaagcactttttgccctcaatgaagtcacagtctattaggcgatgctagtccttattttctttgcatgtatgactctattcttcatttcctcactacagtttatggaagttggaccaggaaagtaatggaaagcaagtcttacccaaagaattattgacataactatttagaactcagtttctttgctatttggcaaaataccaagcaagttttcctgaccagcatagggatagaacctatggcctctatctcattagtactgtttgttagtattaagtaggcgaagccagtctggtacctaattaaagtataatgatctccatttatctgaggtatggctccagtcaccagctgataaccctgtcttttgggggatactgttgtcttcatatctacagaaataggccctagaagtcatgtttgaactgcatagccctatgggccatggctggttagtcaataggttaagactacccaagccaagccaaccagattgtttcccctgggattctcagatgttttacctctgttcttgcaagtggttaaaccagtaatacctaaacttgagggcaatgggatagcctttaatgtgtatgtgtcaaggagcaaagaaagcctgtctgtatctggaaagacaaatactgatgtgcaaagggaaacagccataagaaatgaagagaaagtcatgaaaatgtttggatttctggctctagtctgttttcataaattctggttacaagtcattccccaagtcattcctttattcttataaaaaattcccattcttgccataagctagcctgagttgatttttgttacttgtcatcactgacacttaagtgatacataaactgaacaatctttaccagagttgtcatgtacagttgtacactgcataacactggggagtgccagtcatatcactgattgcattatataaccacatgcagtcctgacttgtatggtcattgagtttttgagcaatatatttcctgagtgcttaattcatcaaatattgattgagtacctattctacttaataaattctattctagagattgtactagttataggatgcaaagattaaaaataaaaacaggccctactctccacatggtcacagtctaggaaagcagaccaacaaaaaaacaatcacaacataatgtgatatagacgacaaagaagcatttcagaggggaacataaatacaataacttcctcaggaagtatcaggggaggcttcacagagaagcaatgcctaagcaaattccaggtagtaggaacagcatgtataaatgtatgagtaaatgtgggaggctgaggcaggtggagcacccgaggtcagaagttcaagacgagtctggccaacatagagaatgaaaccccatctctactaaaaatacaaagaaattagccaggtgtagtggtgcatgcctgtagtcccagctacttgggaggctgaggcaggataatcacttgaacctgggaggcagaggttgcaatgagctgagatcacgccattgcactccaaccttggtgacagagtgagactccatctcaaaaaaaaaaaaaatagtataagtggaatagcatagtatgtttccagaaatgtggatggtttgcagttgcagaaggtggaaagaggtaataaataaaagagcaggggcaaaatcacaagaagctttgcataccaggctaaagagcttgtacattatgcagtaaactaaagcttttcacattgtgataactgagtaataaaaacaaaatcctaagctccacatctgactgaacaagcccccttttggtcaaggggaccttaaaaattgagttcccagtaatgactggataggaggtagggcactccttaacatgccccttgtattagtctgttttcacactgctgataaagacatacccaaaactgggaagaaaaagaggtttaatggacttacttacagctccacatggctgggaaggcctcacaatcatggtggaaggcaaggaggagaaagtcatgcgttacaaggaaggtggcaggcaaagagagaagaggacttgtgcagggaaactcctatttttaaaaccatcagattgcttgaggcttattcactactgtgagaacagcaggggaaagacctgcccccatgattcaatccctcccacaatacatgggaattatgggagttacaagataaaatttgggtggggatacagaaccaaaccacatcactcctccttattaacctttaaccagaattctttcctaaggggtacacagaaaccagctctagaaaacaagaaacagatgacttattcctttgtcacctttagccaatcatctgaggctgtgaccagattctccctccctctttacagtttccaggtgacagctcatcacttcacaatgcatcccttcctaaagactgacctccatctctgggccagttttggccaactcttgaaggatgtgcagtgacggttttcatgtcctctgcttcaccttttgatgtcagagggtcaagaactccaccctcggatcatgctaatgttgtcgtttttgaacacaccacccatgaagaggcatgaagctcaattgcacatatgcatgcttctcctttcataaatattcatgactcctatagcttattaaatatgtatacctggccaccccattaggcataaattcctatttcatttttcccttcctagaaatgcttgctcttggcttttgctcaagagttcaagagtacacttcccagcctgtgggatgaccagcctgcatgctgcaaccctttaggataaataaagctctcctttccaaatttatgaatctggcaattcttcagtcaacataatatatgaagcatcttgggaacttgctaacatactgattctgattcagtatgtccaggatagaactagcattttgcatttctaacaagctctgtaatagtggcaatgctactggtacatagatcaccacactttgagtaacaagcctttaagcaatggggcattgtaggctattaagcagggaataaaatggcactgcagaatgatctcccaatatagtgggatggtcatattaggcataggatgtgaggaagcattaaggcagaagaccagttaggaagctatttcaagatccacatgagaactgaggaaggcaggaattagactcactatatgtgaacttgagtgtgtagtgctagggaacagtaaggagtattcttcctttcctgcttctgtctggatttgtgctgcagaataatggagaactttaaaattgtcttctttaatagcgcaatatgtttgctgagtgtctacttttatatctactgcattcttaaagcccatttaaaattattttcattttgacctgcaaaatctactcttgatcaaataatttgcaatcaagtggtagtttcaagtgggctgaattcagtgctaagacaggtttatgatgaaagaaagtattcacagggatatggagcattgtcattttaactgcggacaaattgtagctccaaactgtgctcagagaaaaactgtgctctgtatagcacaccagagatgaggaggcaccttggtttgcataagaattgtctggaataattattaaaaatgcagacattttacctatccctcaccttacctcatccttactgggcttacttggggctaagacaattgcatttttaaccagcacctccaagagattgtgacacatttgaaatatccatgagaattgagaaataccagtctagctcattttggcaaaaatgaattgccttcttataatgtaagtaattgcctgttactaatcaatagcaccaaacacacagacaaggtaagatggtccctgccttctaagaggttatagtctcaatgatttaagtgatcagggtgttttatagatctctactaaagatccttacttccacaccatacttgtaaagacttctgtatctggcaaggtccacaccgggtaaccgttgttaataaccggaaagcaatctcaaagagtttcaaacaggtcatgaaaactctattttccagacctggatagaaaaccttggagatagtaattgatgggcatcacgtagctggttgctggagaaacactgaagcagaacttgtaatatcttcaaaacaagtgaaggccaggaatcagaaatgcttctgaaggtcagctgcctctccagccatctatgaagagctatggttctgaatcctggctaatatcagaatcatcctgggagcttttgaaaatcctgatgctcaagtcacactccatactcaggtagaagcaatcatcagtactttgtaaatctccccgtgtgcatccaagggtgggaatccgtggatgtagagcttctgctacatgtggatttactgtgatgctaatgaagcttcagcctcagggatcttcatattgcatgggttatgtacaaggaccaatatttaaatttgtagccggaattgtgatttatttttctcaagccaggccccttgtgtcagtttgggttttctgagaagtagacaccaagatgaaattaggtatataacatattcattgaagggaggatgaaggagagagacagcaggagtaggtgggggagagcatttagattgtggtaccagtctggcttctgtgaaaggagagaaagaaggaatgggagtcagtgttgggtaggaagagcctcagactccagagaagtttttagaaggtcttggcctggccaaaggggagtccacgaacaacagtagtcaccacaggagtgctgtatcaaggacaaatgataagcaatatgttatgtctcacacctgtaatcccagcattttgggaggccaaggcaggaggattgcttgagctcaggagttcaagaccagcctggacaatatggtaaaactttgtttctacaaaaaattctaaaaaattagccaggcatgatgggcatgcacctgtggtcccagctactctggaggctgaggtgggaggagagcttgagcccagggaggtcgaggccacagtgagctaagatcatgctactgaactccagtcgggttgacagagtgataccctttctcaaaaaaaataaaaaataaaaaaaaaaaagaagaagaaaagaaagaaaagcaaatgattgagctttgaaacctttcctctgctcagtcagtggctgaaataaccagaggaagcatcactgctcagtggatgtcactggggatgcgggtgggtagggtgcgaaggtgctgcagctggaggctattaatacaccctggatcccatgccagtttctctcaagaagagatctgagtgacacacctccatggtcaccacaccccccatttatatattaagttcatacctcaaacctggatccatccctcctctgaattcataactgagttggggagagagggaattaatctgacagccaccagggttaactttgagaattttcagtaacaattcatgggacacatgacacatgcacagcgttctctttccttttaaaattcactgagaaagcttggctgtgatgcaaaagtgttttctctcaagtgaataaacactgagtgaataaacaccaccaaggctgtcatcaatctgccagcctgttgtctttagggacctaccatttaggaaaacaggtgaaatttgggcttcttcattttgttagttatacaacgattttccttaagtgcttttctatgtgccaagcactatgcaatgcccagttttcaggatacaagacctggttcttgttctcatggagcctgaattttaatgaggtgtgatagatcaaaagccagtgaatgtataaataaatacaatcattacaacttgttacaaatatttaagaaggacacaaagtactatgatagagagtaacgggattgggaactattttaggtacggttgtcagggaaagcctcattaaagtggggggtacttaaatagctgaattttggggattaagggaggatagggaggagaaaaaggagtatcccaggtggagggaagtcctcagttttttctaacttttttctaggcatcttcagttttttctaagtacctggtgtgctggagcacacggagtgagaggaatccaagcatagaataattttggagaggtggaaaggtcatggagatcctgtgggccatggcaaggagcctgaattctattttaaacgaaaggaaaaggcatggcaggatcataagcaatatggtgacgctggtgagggtggaggtgacataagctaacctatgctttaatggtatcactttggctactgtgtatggaatggattgagggaaaagaagaggagaagtggagagaccagttagcaggctcaatcctgagatctggtgttgggtagatggcccagacagaaggagaggacatgaaatatttctaataacatttttcagtagagttcagtggcttcaagagcaacagctagggttgctctagggttacaatctaataaggcatctttttcagagtgtatttgagggcagctttaataaacaatacttatgagttcatattacagatttgaaatgcctcccattgttttatttttgttaatttttaaaatttcaattatttaaatatcacttaacatttcaatatttgtaactgctggttaaattttcttaactctatgcctcaaacacactacaaccactgtgatttactgagctgatactatatgccaggtactatgttatatgtttgataggcattcagctatttaaataccccccgctttaatgaggctttccctgacaaccccacctaaaatagttcccaatcccattactctctctcacagtactttgtgtccttcttaaatatttgtaacaagttgtaatgatggtatttacaaatactacacttctacacataccaatagagtaactaatagagagagagagagatcctttttgggtaagaaaaattagccttaaacaattcagaacatgctcaagatccttccacttatatgatacaaatctaggattcaaacccatgtttacttgatttcaaagctcgtttgttttgaaacgctaagatatgttgcccaaagatcatttttcacctttgttttttcttgaactatagaaaagagagttttcatgtcaacatgtacaaaatataacttttaaaagcattcctctgcccaaatctgattctgtatgcattgggaaaagccatacttccggtataaatgcctgcctccataaaacagaattcaccatccacaggtatttgttgctgatcttaccacagatgggctgcctcctgaaaatgaaccatagacttcttttttatgacaagaaaatgtatctcaatatcccttgagatctctcttaatatcccattggtaaaatgtgacctgcttggagtttacaataaactcatcccagagatgtattccatggttcatttaaaacacactccctcttattccctaagtaaagtcatctctctaaacacaccttatatttgtatagtgcttcacagcttacaaagcacttttgctacatgtaatttgattctgagggtcaagtaaggcaggtgctatcatcctctttttaacagacaagaagctgagtctcagagagagaaaatgactcatccaagcaaggtttgagacctaagaaaggtaggtcatggcattaggatttcaacacttttacaaatactaatagtaaagaagatgaaaatggctctaagccacttttttaaagagtaagttagccttacatatagattcacccccatatcaggatgaactttggccctcctggggaatgggctggctggtaacatgtccacaggtatttgcaaggatggtacaaataacataaatgtgggttcttctatatttagctgcttctggcaatattactgtattgatttcctgtctttgttttcattcactgctgctttcattcacagctggcctctatcaggggttctcttccttctatgcattaatttctattccattcagaatcaacctgaatcaaatataactataggaggtgccttttggacaatacagaggccatgctcaaggaacacaaaaggaactgaagttgtgtggattacaagagagttcgatgtgttctaaattcattatgtaggtaatgaatgggatctcgtgaaaagtggaactaagcctctttggtaaagcctgaagagtggagtcaaaagcaatgagtagaaatcattttacccatgccatccacctacctatctacccatacagacacccaacaaattgtaaaagaaaagtaggcaatcaggataatcagtagtttaatatgatttgggggttcattaaaggctttcctttagaaatcacatttaaactgagacctgaaggatggcttctgtcgttagccagatgaaaagagaagataagcattccaagcagagggaacaggaaaggtggaaacaaactgggcatattccaggacgtggaaggaagcagtaggtagcttaagtagcatgaagaacacttacagaagagtttagaatgaagcaggagccagaccatggaggtaggacatgctagagcaaatcaattttagctgagtgtgaataatacagttctatcatacggatctgccctaaaatggatttggtttctgatgaccaaggttgtgtaagcagaagctggaagacccttgaaaagagcattcattcaagaaatgaagcatgagataggatggaaggagggaagaaagacaagcatatggcatatcaggtctcttccagtgctaaaggtctgtaattccattattccaacaaatatccaatgaagctattttaatttctaggaaattttaaagttgcctgtcttcctacactgaattttacatccattaaatcttcaggatttaaatgttataaacaataaaaaataaatacaatggtgagaggacaggggatgtatgatgggaggtagggaggggtagatggtgtggtatggtggttaaggttacagactttaggtgaatgctcttaacttggggtccaaattccaattgctagacatatgaccaataatattgtagtctggcaactgagaataggggctcttgtttctttactgttgtacccccaggccaagaacagcacctggcactacaacaaatatttggtgcatgaatgaatgaatgttactgctattggtgtacccaaatctgcctgttggctgttgtgaaatgactatagctccaattctatccatacattcctagcaatgcctgagaaaggcagagaaaatagagaaataatgagcttataagcatcatcagcccataaattcttcattcccagggaaagtaaatcaagctgttctttctccctttgtgtgtccctgaggctcagctctgatcatttctctttttcttctaggctgcctatgatactcatctgacctgatttctcctgcacagtgttgcaactgacgagtagcagacttgcccttgcctgcatttggggggatggctgagactttccttacagaaagccctactttcagcatgaacactaacccagtttattggctcagggtgtagagagttgccttgtcactggcgaagtcagatgcagccagtaccagagctctgcactagctgtgaacactaaggaagaatagctgagtgaggaagcagagtgccaggcagcacatccttcttcaggtgtttcctgccctgggccagatcccaggcactgcagcaatatctctgcatgatctagggctcctggaaatagcccattaagggcaaaactcgctgcccagaaaacattagaacattaaaagagcagggtctcatctgattgtcttggtttcctgaggctcattcagtctgtgtccactggtttcagtctgagttctctgcactttgaggatgcagacagtgaagttctcccatggttatagggggagagatcataggaatgctatggaaagaggcctgaagtcagagccagctagtggttattatttattaattgcctgtgaggtgccaggcgcacatattagaccatatgtgattgcagtgagccacccggatccccttcaagctgctgctgcagctgatggaagtcctattggcagacagccttctctcatcagccccttcaggacttgcctcagttgcagagagctgccttccccaagatcacacccttccctggggactcacaaccaatggctgatccagaagaatccataaagcccgtatcatttcagcccaatttaggacagctttgttgagccattagacctacatgcagcccaacctctccttctacccacttcttctttcttccctttccttccacggtgtctgttccaagcacttgccttaataaacatgtaacaggttaaa

SEQ ID NO: 406 - DNA, 4991 bp, Homo sapiens
agcccaagaaacatctcaccaatttcaaatccggtaagcggcctcttttgactctcttctccaacctccctcactatccctcaacctctttctcctttcaatcttggtgccacacttcaatctctcccttaatttcaattcctttcattttctggtagagacaaaagagacacgttttatccgtggacccaaaactccggcgccggtcacggactgggaaggcagccttcccttggtgtttaatcattgcagggacgctctctgattatacacccacgtttcaagggtgtcagaccacgcagggacgcctgccttggtccttcacccttagcggctagtcccgcttttctggggaaggggcaagtacccgtgaaccccttctccttcaccctcagcggcaagtcccgctttcctggggcaggggcaagtacccctcaaccccttctccttcaccctcagcggcaagtcccactttcctggggcaggggcaagtacccctcaaccccttctccttcacccttagcggcaagtcccgcttttctagggggcaagaacccccaaaccccttccctccgggtctctatgctctcttttctctgggtttgcttccttcactatgggcaaccttccaccctccattcctcctccttctcccttagcctgtgtgctcaagaacttaaaacctcttcaactcacacctgacctaaaacctaaatgccttattttcttctgcaatgccgcttgaccccaatacaaactcaacagtagttccaaatagccagaaaatggcactttaaatttttccatcctgcaagatctaaataattcttgtcgtaaaataggcaaacggtctgaggtgcctgacgtcccggcattcttttacacatcagtcccttcctagtcgctgtgcccagggcaactcctcccaaatcttccttctttccctcccgcctgtcccctcagtcccaaccccaagcatcactgactctttctaatcttccttttctacagacccatctgacctctcccctcctcaccaggccgagctaggtcccaattcttcctcagcctccgctcctccaccctataatccttttatcacctcccctcctcacacctggtcctgcttatggttttcattccgtgactagccctcccccacctgcccagcaatttactcttaaaaaggtggctggagctgaaggcatagtcaaggttaatgctcctttttctttatcccaaatcagatagcgtttaggctctttttcatcaaatataaaaacccaacccagttcatggcagcaaccctgagacgctttacagccctagaccctaaaaggtcaaaaggctgtcttattctcaatatacattttattacccaatctgctcccgacattaaataaaactccaaaaattaaattccggccctcaaaccccacaacaggattgaattaacctctccttcaaggtgtacaataataggaaaaagttgcaattccttgcctccactgtgagacaaatcccagccacatctccagcacacaagaacttccaaacgcctgaaccgcagtggccaggtgttcctccagaacctcctcccccaggagcttgctacaagtgccagaaatctgaccaccaggccaaggaatgcccgcagcccaggattcctcctaagccgtgtcccatctgtgcgggaccccactggaaattggactgttcaactcacctggcagccactcccagagcccctggaactctggcccgaggctctctgactgactccttctcggcttagcggctgaagactgatgctgcccgatcgcctcggaagccccatagaccatcacggacgccgagcttccggtaactctcacagcggaaggtaagcccgtccccttcttaagcaatacggaggctacccactccacattaccttcttttcaagggcctgtttcccttgcctccataactgttgtgggtattgacagacaggcttctaaacctcttaaaactccccaactctggtgccaacttagacaatactcttttatgcactcttttttagttatccccacctgcccagttcccttattagaccgagatattttaaccaaattatctgcttccctgactattcctggactacagctgcatctcattgctgcccttcttcccaatccaaagcctcctttgcgtcctcctcttgtattcccccaccttaacccacaagtataagagacctctactccctccttggcaactgatcacgcaccccttaccatctcattaaaacctaatcatccttaccccgctcaatgccaatatcctatcccacagcacgatttaaaaggattaaagcctgtgatcactcgcctgctacagcacgggcttctaaaacctataaactctccttaccattcccccattttacctgtcctaaaaccagacaaggcttacaagttagttcagaatctgcgccttatcaaccaaattgttttgcctatccaccccgtggtgccaaacccatatactctcctatcctcaataccttcctctactacccattattctgttctggatctcaaacatgctttctttactattcctttgcacccgtcatcccagcctctctttgccttcacttagactgaccctgacacccattaggctcagcaaattacctgggctgtactgccgcaaggcttcacagacagcccccattacttcagtcaagcccaaatttcgtcctcatctgttacctatcttggcataattctcataaaaacacatgtgctctccctgctgatcgtgtctgattaatctcccaaacctcaatcccttacaaaagaacaactcctttccttcctaggcatgcttagtgcggtcagaattcttaaacaagagccaggaccacaccgtgtagcctttctgtccaaacaacttgaccttactgttttagcctagccctcatgtctgcgtgcagcggctgccgctgctttaatactgttagaggccctaaaagtcacaaactatgctcaactcactctctacatttcccaaaatctattttcttcctcatacctgacgcatatactttctgctccccggctccttcagctgtactcactctttaagtctcacaattaccatcgttcctggcccggacttcaatctggcctcccacattattcctgataccacacctgacccccatgactgtatctctctgatccacctgatattcaccccatttccccatatttccttctttcctgttcctcaccctgatcacgcttgatttattgacggcagttccaccaggcctaatcgccacacaccagcaaaggcaggctatgctatagtacaagccactagcccgcctctcagaacctctcatttcctttccatcctggaaatctatcctcaaggaaataacttctcagtgttccatctgctattctactactcctcagggattattcaggccccctcccttccctacacatcaagctcgaggatttgcccccacccaggactggcaaattagctttactcaacatgcccgagtcaggaaactaaaatacctcttagttcaaatagacactttcactgaataagtaaaggcctttcctacagggtctgagaaggccaccgcagtcatttcttcccttctgtcagacataattcctcagtttagccttcccacctctatacagtctgataatagaccagcctttattagtcaaatcagccaagcagtttttcaggctcttagtaggtttcagtgaaacctttatatcccttacggtcctccgtcttcaagaaaagtagaacggactaaaggtcttttaaaaacacagctcaccaagctcagccaccaacttaaaaaggactggacaatacttttaccactttcgcttctacaaggtacagcccatttaagctcctgtgtagatgctcctttttattaggccccagtctcatttgacaccagaccaactgagactgtgcccccaaaaaacttgtcatccctactatcttttgtctagtcatactcctattcaccgttctcaactactcatacgtgccctgctcttgtttacactgccggtttacactgtttctccaagccatcacagctgatatctcctggtgctatccccaaactgccactctaaactcttgaagtaaataaataatctttgctggcaggactatgctgaatctccttaggcactctctaatcagatgtcctaggtcctcccaattcttagaccttttatacctgtttttctccctctcttattccatttagtttctcaattcatccaaaaccatatccaggccatcaccaatcattctatacgacaaatgtttcttctaacatccccacaatatcaccccttaccacaagacctcccttcagcttaatctctcccactctaggttcccacgctgcccctaatcccgcttgaagcagccctgagaaacatcgcccgttctctctccacaccaccccccaaaaatttttgccgctccaacacttcaacactattttgttttatttgtcttattaatataagaaggcaggaatgtcaggcctctgagcccaggccaggccatcacatcccctgtgacttgcacgtatacatccagatggcctgaagtaactgaagatccacaaaagaaataaaaactgccttaactgatgacattccaccattgtgatttgttcctgccccaccctaactgatcaatgtactttgtaatctcccccacccttaagaaggttctttgtaattctccccactcttgagaatgtactttgtgagatccacccctgcccaccagagaacaaccccctttgactgtaattttccattaccttcccaaatcctataaaacggccccacccctatctccctttgctgactctcttttcggactcagcccgcctgcacccaggtgaaataaacagccatgttgctcac

SEQ ID NO: 407 - DNA, 292288 bp, Homo sapiens
gtgagcaacaaggctgtttatttcacctgggtgcaggcaggctgagtccgaaaagagagttagtgaagggagataggggtggggccattttataggatttgggtaggtaaaggaaaattacagtcaaaggggggttgttctctggcaggcaggagtgggggtcacaacgtgctcagtaggggagctcttgagccaggatgagccaggagaaggaatttcacaagacaatgccatcagttaaggcaggaaccagccatctggatgtgtacgtgcaggtcacaggggatatgatggcctagtttgagctcagaggcctgacaccctcctatgccttgcctggcccctgactgcctagggacctgcagtctatctggtcctctgtaaagctctttttagttccgtgtaaaacagcaggagagtaaaattggggtccagatgaaacagaactattcaggctgatatccaagaagcgccctggctccttaacgtgttttccttttcattggcctcttaggactcaggtttgccaaggctcagaagcaagagccaggagtgaatattgcacataacagcggtgaacctggcctgcttctgagtgtgcaaaagccctttacacaggatttcctgaggtcagcccaagcccaggctcctcaccctcccagaatgcctcagctagctggcaaaacattgtaagtggaagtagagatttgtccagtgtcaaaaatcatttcacacaatagcaagacacaccctgggtggaagtcactgctacagaaactgtgcccttcctccagtcttcatctcggcacatctgtgaccacaaacgctgtctgtctaaattcacatcttgttcaattttagattcatagttttctctactcaaatactttacgcttgtaagacatgttgtgtggaagtgggttaaacttgtcttttaacatcaccaataaccatcttctacatttttttcagtcattaatttgatatcttcactaaaagaaatgccagtaatttgagggttttcagagtaaagtgccttgagctcccccagacagagaagaagcagaggtgtcactgttattattctgagctgataggaaacacatcatggattggaggcaaggaatcagccaccacctgcccggcacgcacatagagcaggtgttggctataattgcctctagacttcctgccatggtcagttgaaagtcaaacctgtaaatgctgcctgactgcaatagaactggagtccacagacatttctgcaacactgcctggtgaaaatatactgactgggtgggatgagatggagggcgcgtatggagcagacacgactggaatagcaaccaacaggctgtcagtcttcactgccttttctcgtcttccattttttttgattctatgaccaaaagagatgacagacctgtaagaaaatggatttggtcatttccggaagaagctttttctttgatctgtctgagagcaggtcagtagaaggtatttttgttaacctggatcctcaccatggatatttcctgagcttctacatggcagttctatgttttaaagttccctttgccgtggcagcacaactgcacaccagacagtcacccttcttcctgagagccactgtgatttcacttcaggctcaaggtgtcctcagcagatctgagggaggactaaaacagatatacacgctttgcttttctgcatcaccaccgttcacagactcccaggagctcctgcagtcagtagaaaggagatcattcaagtggctttcacctagtaccaaacccacacagccttcagacccagcccctccaatctcccgacctcctgggcaccatccctggccaacctggtccagaatggcctccgtcctctagaggccccaggcaccaagatccacaccctctattccagagcattcttggcttcaagttaggtcctatttatcaaacatttgtctagagagcagccccagcacataagtgtgtgtgaaccgcagagtagaggcatggcccctgctcactgtcccctctgactctgggcctgggtaagactgggctccccaaaagcaatataagtgtaccaggaattttctatggtgctcctgggagaagtaggaaggaggagggagacggagaaatcaagtaggggtgtgattcaagccccattcttgcttgcacctgcagcgtgactcccagtgtgagctgaaccttagagcttgtccggacttgaatcaaagcaacgagcctcaggtattggtgtgggtcaagatggggagacataaactccctggagcatcacttccagctttctgcacctgtgaacaaagcccaaaggtgggtcactgaggagagacacaggtatggtattagttgctgaagaacacagatgctgaggagtggtcctgggtgggaggggttgggcggagcaaacaccagcttcacggccaccttcataggccagtctcctgccaggggcacgagacgctccaaggagccagaaatcagagctttcatttcctttgtgactctaccaggtactcacagaagcaggaagggagaggcattgtttaaaaaagcaaacacttatatagcacttactatatgccaggcaatgttccaagcattttataagcactaattcacttagtttctcaatgtctcaatttccttataggtaaagtcaagctaataatattagctacttcacaggcttgcagggaagctaaatagcctatgtaaggttacagagatgatctgccaagagttgaacctgggcagtccagctctgaatctaaatgcttaaccaaaccattaaaatgagtgcaggctcataggaccagacagacacaggtgcaagtcccggtttatgtcaataaaactgcatatcatccacaatggttgaacactcccaccaacagtgcaaaagcgttcctatttctccacagcctcactagcagctattgattcctgactttttaataatcactattctaactggtgtgagatgattcctcaaggatctagaaccagaaataccatttgacccagaaatcccattactgggtatatatacccaaaggattataaatcatgctactatataaacattctactataaagacacatgcacatgtatgtttatagcagcactatttacaatagcaaagacttagaaccaacccaaatgcccatcaatgatagactggataaagaaaatgtggcacatatacaccatggaatactatatagccataaaaatatgagttcatgtcctttgcagggacattggtgaagctgtaagccatcattctcagcaaactaacagagaaaaccaaacaccgcacgttctcactcataagtgggagctgaacaatgagaacacatggacacagggaggggggcatcacacaccagggcctgttgggggtggggggcaaggggaggaagagcattaggacaaatacctaatgcatgcgaggcttaaaacctagataacaggttgataggggcagcaaaccaccatggcacatgtatacttatgtaacaaatctgcatgttctgcacatgtatcccagaacttaaagtaaaataaaataaaaaatttaaaaaactgcatatcatctctgagtcttcactttcctgtttttgaaattggtttttcttaaaaaacaaaaaagccactaatacctgtatctgtgtaagaaatgtccagcaggtgctgaagccttgctgggaactcagtaactctcagggatcattacaaaaatcctcggtaaaattgactgcctgcaatctttgatacagcaatgcctgtccccagtagcttccagtggcagatgtgttatgtgtgtgcatatgaaaaaactaaacatgtaaaaaaacccaaatccaggccacccagtacattcatatggcattacccaggtctacacccctggggacagtcggccatgcctggagacattctaggttgtcactgctgagggaagggtgctgctggcatctcatgcgtagaggccagggatgctggtaaacaccctgcaatggcacaggacagcccattctgtattctttctttccaacataacaataatgataaaagcagctgccaacacacatattcaaggcacaggtctgagtatattataaaggtgatctctaaataacctatctctgagaaacgatctccttttagcccctttacagttagggagaggagacttaaagaggctgagtaattttccaggatcacacagcagacagggaagcttggatttgaatcattgtcatgcagagtccaggacttacactcttcaccattatacattcgttcactaaactttcctaagtttgaccacaaattagaaggcagaaaatgaaaaagcatgtaacttggtagttctagcaactgatttacttccatcaaaggccctttggttctagaaagctttatctatgtgttaacgatagcagtatattaaattatgggctaagtgtggtatcaaattgtaaaataacctatgaaatctaagctttactttttctcatagttattaatggctggggtcagactctcttgggagcccctcaattggaagaaagactgacaagaacacacacacaggacttgaaccaaacccatgtgaattcaaagggaaggcaggtttattatctttcgctccccagagatgaagtcagccagcttttctgttcatcactagggaggatattaaacacaattctttacacgtggggaaaaaaaaataattgattctgagaacagctttggtgaaatgggactttggttggaacagcacacacataacctctccaagacagcaggtcatccgccctggaacctcacccttggtctctggctctgaaactctgatcaccttagggagtgtactggcaatgaccaatagaccaggaccttttgctgcaaatctactaatgttccctaaagggtgacctctggtgctcaaggttgtttcccaccacagggctgcaggctgccactctgcaaagtgaataacttccttagtcaaggctggtggatacatgaaaacctgtcattaaaagaaacacatgctggactggttctcctagaattagccatttggagtctcctcgggaatcattaaggggacattttgcctgactttgaaagcaatctttttttttttttttaacaatagaaaactacaaagtactatacaaaggggactttgggcaccatcagctcctctcaaatcccctatgatgagattattacttagaatagcctaggctattcgacagcaacatattaacgctgaaatctcagtggcttaaaaaatctaaaagttgatttcttgctaatgcatattatgatcctggacaaacaattctgcagggcagtcatcctccatgcagtgcctcaaggacccaggcacctccacacttgtggtgccaccatatcaaaaattggcttccaggtcaccacagcaagaaagcacaaaatttgggacttgtggatcacttcctaaatgctttggcacttctgcttatagcccatcggtcataactagtcatagagcccccccaagtgcaaggaggctgagaaatatatagacggcacatggtaaatatctctatcatcatttatttgtgttacacactctccaattatgctcttttagttctcttacaatgtacagtattgttgactgtagtcaccccgttaatctcccccatatgtagatgaggagcctggtgagtgtggcctattgcaaatattttttcccaccaacccaaaacgtagattcaaaaactaatgctgatttttagagaattttaggtgatacttaatttggtaaaatttattgaaactatacttctcctaatcacattatatcattttctataatcttataactctaacatcaaatttaagataagaaatatatttatgccctatatccataagcaacaagatcattaaatctctttaggcactattgtctagaaaaaagaagaaaaaacctatctaattattttcagcaggaaaaaatttacagagcttacagcccagcattttaccgcttttctttttttgcattggtgaatcattttgagcttataatttcaaagtaaatattttttaaagcctcaggacattcattgtgtaatgatcatttgaaagattttttggttatggtgttctcaaatgaataaaaaggctgttcatagcaacagttatttctatattaaaaagatgaaattgttcattaagtggtacaagtcaatttctttcatcagcctaactgcccattttagcaaagattccatctctgaattaagcaaatagctacacatttcaaagtcaatagctatactatgtttcctttaacgtgaacatctcagacatatcaatgttgtcagcctctttactaagcctttctctgaaaagactgaagaccgtgttttgttgttattgttgtcattgtgtgttttgtacttttgctttttttaaggcaatatttttgtgtgttagctacagtctggccggtcatgacatgcacactcaaaagagagccagatattttttaaaaagtatggtgaggctgagtagcccatttgacaataaatgtaaagtgctcacatttccattggtctgtttggaatttccctaagaagagttatttctttctgtaataaaaccagaagtcgaatgtaataaaccatagctggtctgtgggggtttgtggctaaagtgagtatggaaaagtctgtgaactttctgtttatttccttttcccaaccaaacccttgaaactagaggctggaaggaaggggtagagttgagggccattggactaggtggaggaagtgaccttgcagatcctttcacattctgtaatgcatgcaaaaaataatgagaatgagatagctgaagtttcaattctttagagagagattcaaattcatttgtcggttacaggaagcaaaaaaaatgccattattaatttaggcaattagagaactttgaaagtaatatttagtactttttttaaaaagcctgtcccaggagttcagcccacagcctaggaaagcttaatttttatagtatttcaaatgaagaaaggtcatttcttggatgtgcttgacagaagattgtaattataaactggtaattttaatgagaagtggggtttccataaaaacggaatgaacttttgaggaagtaaaattagagtgcatgttccatccactgtggcatttccaaacaggtcagtgttcccaacattgccacctgctctgccatactttcctgaaaaacgttaatgctttggtacctacatctgcttctcctgccttctcaatgcaccaaacaagacatcagacctttttcttgcatggaggcctgcctcctgcgatgtctgatccacacacttttctcttctctgaatgctaaacagagagaacattgcattgtgatcttcccagatttagggcagagacagggcagtcagtctgggaaggcacttagtggagtgagcccacagtgtggaggggtgagtgcctcctgaggaatcctgccctctctacagtccacgttttctggcagatccaagaggtcacttaaggagttttgaacaacctgtactgtaatgtcctgagggtgcctcagcgtcatctgtgctcatcccattgttatctaaccaaatggagtcactttgcctgtgtgcaatggaaagccaaaaaattgacacactggatttttgcagaaaaacaaaaaaaaattattgccggtcaactggcaacgagacaggaggaaaccctcaaatctgtctccctgagctgggggctgagtggggttttataagcacagggtaataaggtgtgatctgcttggatcttgcaatgaggtgatgctgggaggcataatctcactgatcctgccgcaggacaatgccagggtttgatgtgcttgaatcctggatcctgccatgtggcatccacttttaaatttggtctcactcctcagttcgagcacttggggctgcccatcgtcgcgcacttggctcatctgggcatgctccagcaatgtgaccttcgacctgcaggtccatggcaactgaacaacaactcacaaccttgttacgtggaagctgagccagaccggtctggtgcagttacacatccctacagggtctgattttactgactacgggggagcttgggtattgttttttttaagctcctcagatgattctaacactcagcaggggctgagagccacggagttactttctgagaaggagtaaatatcagcaaagaaagagagacaggaaaggcacttggcagcagcctggtgagtaaggggtcaggcagcaccaagcaaggttggaggatgagcacagtgaggacccacagggcctatcaactgtgttaagataaacaccaaatcctgcggctgggcatggtggctcacacctgtaatcccagcactttgtgaggctgaggcgggaggatcacctgagatcgggaattcgagaccagcctggccagcatggagaaaccccgtctctactaaaaatacaaaattagctgggcgtggtggcacacgcctgtaatctcagctacttcggaggctgaggtagaagaatcgcttgaaccagggaggcggaggttgcggtgagctgagattgcgccattgcactccagcctgggcaacaagagcgaaactccgtctcaaaaaaaaaaaaaaaaaaaccctagaaagccccaggaagtcaaagaagggcgtcagtgcagagcaatgcgccagctcttggttgccgtattcctggtgctacaataaaagtttgttgaccatgtgcactcaggtgggaatcagaggctcaagagaaaagctaaaaccacctggaagctaagccttgtctaaccaaatctattgagtctccctccagctaactgaggggtcagatgccactcatttctgtttgggaacagtcatttgctttaactctcagcctcttgctgcagccatgctgccttcccctcagtgtcctccttcctgccacagtaagtcactctggagtgccacgctccacttaaaaataaacaccttctgtctccatcctggcacagtttcagcttatttagcattctaacatatgtcgtctgttttcccaaacaatctaacatgagcatagcacgatggggttgataatttgggcaaatgagaaacagcctgccatcagcacagacacagtgacatttgatttgctatcggtagattccattgtgttctctcttctcatccttggatgataaacacagaaaaagactgcaagatttccagccctggctctgtggcagagaataaggtctggaggcagggaacctaaggctgcttcaggctgacttcttagaactaagttgaaaggaaaaccttaaccttccatgcctaagtaacaaaaggaccacaggctactccctttgaccttttctccagggcaaatgggaaattggctgttctgcaacaaatcagactgattaccggtcaagtcttcgtttgcaactttgcaacttctctccagcctctgaaaggttactgtccacaacccatcagactgattgcaggccgagtcttcatttgcatagaagtataactttgtagcttcatcctagcctgtgactgctcctttaggaaccaatcagatgtttgcacaggagggtgacctttgtaacttctcttcagcctctggttggctgctttctgcaaccaatcagattgattgtgggctaccacttcacttacctgagatgagcaagaagtggccaatgggaaacttctagggggtatctagacccaagaagattctgtatctgggctcttgagccactgcggctcagtccactcccacactgtggagtgtactttcattttcaataaatccctgctttcgttcttttgttgcttcattctttctttactttgctgggcattttgtccagttcttcgttcaaaacaccaagaacctggacagcttgcagttatgaccctctaccggtgacgtatcttggcaagccagccaggaggaaaggtaggcccaaagtttgggatttatttttctcctttccccttttaaatctttctctcttttccttttcaactcgggaccctctgtggacagtgcctaagcatggagacaactgcaactttctggccagcgccactctggtgaaactgaaaggtttccacatggaagcgccttactgccgccgcccagttcgggtgagggacctgagtccttttcttgttttcatttttctgagtcctgttcctttttccctttttctgagttattttcctttcctcctttttcagtctttcagcagctgtttcctagtggctccttggtaattgagaggaactggccagggccgctctccagtgatctctgaagtccagggagtgaacagggatggctgccctgcctggaagggggaaagacactttactatcctttccagttatcctttcacaactgcatgtgacgcagttggcagcggcagctcgtccagggcaaattcacacacgtttcaggtgacttaaactccttcttttcttatgctaaattcttccctaatcgtactcaactggctaaggaacaaaacggcccacccagcatccagttcttattacagatcatgattattttttataaagctcacagtatgctctggagaggaaaacctgcatgtggcgccccctcctaaggccagagacgtctggaactcttaagattggaccccgcaggaggacgttctttgggttctacggacctcaaactctccaaaggggatgcccttggcagaggttcagaggtctagtattaagtcctccttagaatttcctctcggagttgaaatgctgcttggaccgaaaagtgtctagaatctgaagtttactgtctaatggaaaagtgggatggtattgcataaatacaggtcttataggagttattaagaagttattttaggcagatagagaggaaaaggggtccttgggaagtttttcttttaaagcagctccagaaacctttcttgtctagcaggaaaggcccggctcttagatcccgccgacaagctttgatatccaaatcccggccattagaaactgggtccacccaaacatggtgattcccgctgtcttcttgccattgccccgacttgggcctggaaacatggccacccccacatatccacaggtgtgtaggacaccatggcgccctgtattcgcatattaaaaggttagggtgggagggccaggtttttgcgggccacgtgagtgatatgcctggtcaaaccaatcccctgagccctatgcaaatcaggcaccacctcctccagcctcctcatataagcagccacttttcccaccacacgggttttctctttgttcgaatcccctctccctctgtctctgtacagggaggctgttttcttccttctttcttgcctattaaacactccactccttaaaaccactccacgtgcgtccatgtcgttttatccaatttggtgcaagattaaggaccctggtgtacctccattcattggagacttatcacaggcttttgtgctgccgttctaagcaggggcctggttaacgtgtgatgccttgctttggtactgtttggccccagtgctccttggagtctggggaggtttagcctttaaaattcaaactgccaaggagactgctttatccaaaattttggttcacagccttccttggattatctattggggcaaagtaaaaccggcaagcttgtactgctatctcatggctaaggttccgagctgttggatctttgtttatgtgtgtgtatacatgtctagatgtgtttatacaacaaatgtacacttattgttgtatattgtgtctacaaaattggcttataagtgaaagagcgctcatgaaaactgagtaagtctaagcaattttcaagttcatgtgacttaaagtataactttactaaacgagctagctttaaaattattggtggaataaaaatagaaatgttttcagaattgtcaacatacattttggctgaattttatgtttttctgtgctagatattttaaaatgtcagtgttaattcaagctggaagctgcttagggcaaatctgcctcccattctattcaaagtctcactgagataaatacataactaattgcttcctttggaaaggctaataagaaactcaaaagaatgcaaccctctgtctcccacctgtgattggaaagcccccagcctcctcgcctcgagttgtcccgccttctgggaccaaatcaatgtttgttttacatatgttatttgatgttacatgtctcctttgttaaaagtcaaaattaagtacagtgagtgggataaatgttttaggtaaactttttgtgtaaattaaaatcttagagctatttttaacacccatttgatatctgggccatttccaattgagaaagtgttgtaatatgaggaaatatgtttcaaaaattatggaattcataattccatctatttttcttatctgaaaatgcccatatctgatagttcttatctataaatgcccatatctgatggttcaggatttcttgctttttggagtttcactaaagttttaggttactaaggataaaattctagttaacatgtaattctgtacacaaaatgtgccggaaagggttattttattagaaaaaaaagaataataattttgtctaatccagaagttatctaaaagttagttcaaattacagatttgaaaaagttatttatgaaacaatgtagtaaggactcattaagtaggggagaaaagtgtggaaaaagttaaataataaaatgttctttcaaacctggaaaccttggagacatttggctaattaacactttcatagttaaagcccttagtattaattaaagtaaaataagaagtattgtaaaaatgcattggcagtttgataattcttttttataatatagttaagcatgaaactaaatttagtgtggagccaaatttcacatacatgtttgcgttgtttcacactgtttactgttttgcatggatagtgctagagtacttattggtcatgtgccttaagtggatttcttgattgcacagaatgtgatattggtaaacttaaggatattgaattgtgtatggggaataaaatattcattatgtgggttttttagggcccgggataacactgcagcctccagggtaaactgagtataaaaatttacacctggtttcctgcttatttgttttggcttctagttttcatttctttgctgtttattctcctgtggctttgcttgtatccatatatataaataaatgatgttttccagttcctagtggaaggttttatttagttttgtgatcctatgcacttcttgcaagtcctcattcatttcatttatctggaattcctaagctacctttgttgggcctgcagaaattaacggagcacaccagctttttttttttgtttttttttttgagatggagtctcgctctgtcaccaggctggagtagtgcagtggtgcaatctcggctcactgcaaccttcacttgccaggttcaagcgattctcccacctcagcctcctgagtagctgggattacaggcgtgcgccaccatgcccagctaatttttgtatttttagtagagacagggtttcaccatgttggccagggtggtctcgatctcttgacctcgtgatctgcccgcctcagcttcccaaagtgctgggattacaggcgtgagccaccgcgcccggcccatgccagctttttatcctttaactaactttttgaattttagggttcctgatagtttaagtgtgttgagtatactctcacaaatagaatttgagtcatatttctctctctctaatttctccaaaatctgtaaagtatatgtaaacagtctaattcattgcaatgtattcatttgcatacagtcaagcagggttgccagggttgctcagggagagagaacccagaaacctggcacgccggcaaaagggtaagaatttcttaccagtcagtctctggcctctttctttctgtgcaaactggttaaatataaagtagaagtcactatatatctcctgtgtaaagttctaaattaattggtttaataataataaaagcttaaatcaaacattttgtcagaaaagtgaaaatataatgcgaactttcttagttcatttgacttgagtattctttgggaaataaagacagttttaaaaattattggtgaaatacaattgtcttcaaaatgtaaacgtggtctaaattacgtttgaatactaggtttgctaaacgctttaaggtcataaactgcttctttggcttttgaaaattatttaacttgcctgctttccagctagttaaggcctggggacatgtggagttggccacaccctagctatgctggaaacagtcaaaggttatcagaacataacttaagaggttttacattaaagttaaaattgcttaaagtcaccactgtaacatgcggttaagactactagaaatagttttacatgcaaggtgtgtaaaaacagtagaaagtgttttttcagtttttttttgttttttgttttgtaaaaggttacaaaagatttttacttctttaaaatttctcagtcatcattttggcaaaataaataatttatggtaatctggaattccaaaagcaaactttagttttaaaattgtctttcctaatgcccggctttttggatgaatcagagggcccctgaaaacatccagaaagaaggtatacaggattatttgacttgtttacgcacatgggattgccaaaatgatgttcaatcttctttaggttgtatttttgtgaataatactaatgtatgttccaaaaaaatatatgggatttctaaaattctaatgtctaagtatatgctatcaatgataattatggttattatgttaagttattataaatcatagaaataacttgtcagtgctacgtacctaatttggaaaataaactggtatcaaagaggatataagtctaatgttaattaaacatggactcatgaaaaccaggatgtccaccttgtccttcgtgaatccttaaagcttttgtttctaaaagttatgcattccatgactcatcacggaaaagataaaataatccaaattaaatacattggtgcaatgacttacaaattgtttaaaataatttataaccagtgcttaatcccatattactgggaaaacaattaaagcttcaggtacatttggtcacctgatgggccatttagacattttataaaggggtttcattcaattgttattttcagtgcatgttttctagttgtataaaagctttcccatgcaagaggggtgatgttgtaacagtagattattatgctacagtgtatttttaccgggtaaaaaagctttttatggcttacatcttctagaaacagcaaagaaggactgttcttgccatccacactacaacaaaacttcaggaccttggactttgagttcatagtctcacaattgagaagggtccctccacacttttggagctgtgcacccattggaaccctagaggtaaacctaaccagggaaatttctcccaagaagaagatggcatctttgatgtgaacagctttttcaaattcacagattaagacttctactatcatgaaattcttatctttgaatttttttttcttatggggtgtacttttatttgtgaaggattttgcagccagccttatacatgggtaaccttgtactttaatagataaaatatgaaggcccaatgtaggtaagaaactttaatcatacatgcactgcctcataatcagtcaaaaacaaaacattggtttactcctcttaacccacatcatgggttaaagagaacattgccagaaggccttcacttttctaaaagggcatcctttgttaggtcttttttccatggtttaaagtaaagaagcaaagataagaaatgtaaccctcatgataggttctatagcaaattctactgtaaaggctacagttacacaacagactttaaattctcttgtgaacgttatgctaaataatataattggctaaacaaaaagtacctatgcagctgctggcacttatggcctatggagaaatacatcaaatgaagattatagaaattcagtggtagagaattaatgaagagatcacttagttaggtaagtaaattctttatccagctcattctttgatctatttgatgttaggaggtttggtttatgggaaccttgggtaaggagcatactccaaactcttggtactatcctcccaatagtcataataatagtctccctggtgcattgtattctctcaaaggtttttaatgcttgcatttggccatctccagaatgtcatacagtctctcttcaactggaataacaggaactgaaagaaatgtgcaaccatgaggacaccataacctataaatgatgtgctgagattggaaactcaaaatcatggtaactgagagtgatgctaaggccctaaattttggtcatgctctcacctaagtgaaaaatggggaaatttttaaacaaaattctgggaggccattgttttggactaagctcatgcactaggccacaacaaaccaaactgaacaaaaatggagtcactcatgctgactttaaggaaacacatagattctaaaacagaccaggttttgttttttctcctgcaaatctctatgacaaacatttctgacaaaataggtatcaacctcctgaagttcccattaaatcttttttttttttttttgagatggagtctcactctgttgcccaggctggagtgcaatggtgcaatctccacctcctgggttcaagtgattctcctgcctcagcctcctgagtagctggaattataggtgcccaccaccatgcccagctaatttttgtaattttagtagagatagggtttcaccatgttagtcaggctggtctcaaactcctgacctcaagtgatccacttgcctcagcctcccaaagtgctgggattacaggcatgagccactgcgcccggctgcccattaaatcttttaaccgaatccatttcctctagcatagagaccattgagcttcagatgactgtgcaacaaggtttcagccagttccaggtgaaggcaccacccctggccatcaggaagccaccctgcctccactagacagagtaaggtgagagttccatgatctccaacaggtagggactatgccccaagtcagcatgaagcagttagagaagaaagaccttcagtgcctctgcctcccatgaagacctatggggatcatttctctcagcggggagatgaggcaggagaatagggtctggaggcagggaacctaaggttgtttcacacctgacttcctagaactaatttgaaaggaaaaccctaactttccatgcctaagtaacaaaagtaccagaggctactccctttgacgttttctgcaggacagatgggaaactggctgttctaacaacaaatcagactgattgcgggttaaatattcatttgcaactttgtaacttcactccacaaccaatcagactgactgcaggccgagtcttcgtttgcatggaagtagaactttgtaatttcatcctagcctctgattggttgctttgtgcaaccaatcagatgtttgcacaggagtgtgacctttgtaacttcacttcagcctgtggttcatgctgtccgcatccaatctgagacatgaggtgaacataaagtggccaataggaaacttctagggggtatttggacccaagaagattctgtatccgagcccttgagcccctgcttgggtctgctcccacacagcggagtgtacttttgttttcaataaatccctgcttttgtccttttgttgcttcattctttctttgctttgctgggcgttttaattctttgttcaaaacaccaaggacctagacaacttgcagtcaccaccctctcctggtgacagctcttccagtcaaaatgattgaaacatcatttgcctttaaatatcctattcatttggcaagcatagagtggacgccaaccatgtaagagacacgttggctctggcgtgaaaatgtagaaacggtctctgctagcaaggggcagataggttcatgagcgagaccggattacagagcatagcgagtcagatcacagctggcaggaggaacaagaaggaaactcacaagacaatgcatggccaatcctacactcaaagatgaggcaaagcttcactggtatctcagtccgtgcgtgctgctataaaggaatacctgagactgggtaatttataaagaaaagaggttgatttagctcacagttttgcaggctgtacagaaagcatggcgccaggatctgcttctggggaggactcaggctgcatccactcacagcctgaggggaagaggagctggtgtacgcagaaatcacatggtgagaaaggaagcaagagagaagagggaggcatcaggcttttttttttaatcctctacatttattaattaaaaataatttcaacttttattttagacttagggggtacaagtgtatgttttttaatatggatatttgcatgatgctgaggtttggggtatggatgacagatcactgaagcagactttttaacaacagttctagggggagctaatactgtgagaagtcactcattattgcaggacatcaccaaaccactcatgaggtatccaccccatgactcaaacaccttccattaggtcccacctctaacactgaggatcgaatttcaacatgaggtttgcagggtcaaatattcaaactccagcaaccagaacgaactggaagaagttaccgctgctctcagtcaagcccagaattcctgtcccatgcagactaagcattttcacacagatctttctaagtccttaggtcattagaggagtaacattccctctggctgaaagggagacatcaccaggaggtccctcagccttttgcacaactgattgtccaggagctctgtcctgttctgataggggctgagctgaaccctaaggctcaggattccggggaatagcaccacccagccggacctccccagggaccccagaatctacagtgactcagacccctgtacaacctggagcttgcacatctatttttttcctctcacttatctgttcactgggtcaatcagtccttcaacaaacatttactcagccatcactgctcaccaggcacagaataaaagcaacacacaggaccagagtatgggccttagagacctgcccgtctacagtgcaagtttctaccagggacatgggaacccaggtattgaaaagggccttgtggatgctttatagagatgagagatggaacaactttgcatttccagagggccctgggctgaggccacatctgcagaccttccttgaagtgagcaagcaaagttgcttgccttggcttcatgcctgacgatggcccctctgtggaaggctgcatgcttggactcaaccctgagtcttgggaaccactagaggaagagtaacaggaggtggaacccagggatggccacatgcaacctgtttgtcccacctcatgcctcttcccagctatgggtccattcagtcattcacttattcccataaaaccatacactacatttcttcaaatttcttatgggcctgaagcccccttaatgctcaccaaacatttaatgatttttttttactctctcagaaattaaatatgaacataacgatcgtcactgttaactattgtcctcaagaaagttccacatttctcagatagataaattttacattattaccacaaatgggccatacaatgcttgcaaagtgccaagagaagtctctggtctacaatggtgccagctctctctgcatgttggcactgaggaatgaagaaggagctggaaaatatgcaggagcagacccagacagaagtcaacaggccaggctgattggaggggaatgttggcggtctgaaaaaaaccaattcttcaccccctacttttcttcttcctttctcaatatttagtctccttaaggagcagtaggaggcctaggtgaataaaaccagacatagtgaatgcagtagaaggagacagtctttagtcccaaactagaaagagctgatagacaaggtagcgatctccctttccctggaggaaagcaagcagataacagacaataaacagttgataaagctatagaacaaatttaagcaagagaaggactttaagggagagaaaaaaaaataacattgccaaggcatcaactatcaggaactcagcttggcctttgtatattaccttatttaatacccacaacaatgctaaggaatgtattaccatctgcattcgcctaagaaggagatatagctcagaataagtaacatattccaaagtcacaaactggatgtggttctgactccaaagcccattctcttttcattatggtcactggctccctggaggggcaggaacagtgcacaggagtcatttgtgcattcagcagatgtttgctgagagtgaagctactatgctggtgtgaagatacaaaaatgattaaacccctggattatcacatggaattccaaaattttggaaggcagccttgatgcctagggaactaattgcatagattggaatccataggccggcacccctccttctgttcctgcccatctgccccaagcctgggtggcctacatcagtacaggggcgtccaaagagcaggtgctggctctcctgtgcaattcacctctcccagaagcagtatttcccaaagtgcatttctcagaagagtggggctgtgtgttttagactaagagcgttctctggccccaggtgtttgggaggcctgcaggatgcactcattattagaggatcacagtgcgtgctaaagcaggagagggtctgcccccacccacgctggagctggctcactcattcacgtctcagagggctctgctgctctctacagaacaaaggctttcagcccagcaggtggctcatgcctgtgatcctagcactttgggaggcccaggtgggaggattgcttgaggccaggagtttaagaccagcctgagtaacatagtaagaccccatctctacaaaaattttttgttaaaattagcaaggcatggttgcacacgcctttagtcccagctacccatgagggctgaggtggggggatcacttgagcccagaaggttgaggatgcagttgtctgtgattgaaccactgcactcctgcctggatgacccttgccccagcctggagcaagaccctttctctaaaaagaaaagcaaaagaacaaaggctttcagaatcttttggactgtggcccagagtaaggtatagattttacactgcaactctatacagataccacacacacacatacatacagatgaagccaaagttcagtgaaacaatacttgcctttactatgtgggttgcattctaaccgtttctatttggttttcttgtaatactgagtcatgaccctctaaatcaatttcatggctccacagtttggaaaacactcatctagaatacaagaagtcacttgagctgattgctaaactagccccactctgaatgagagggtcgaaaaactgacatgaaactgtgaaccaggagcctcaaatcccagcgtcactgcttttgggttgtgtgatctgagtcagtggcttctctttcctgagtgaatgtgaaaacctaatggtatcatttagcatggatgcatgctagaaatacactggaaatagacgtcactcaagtggcgttctcaaggaaaatttaacaaagggactgtctgaatcatgtgtgcagggttaaagcaaggaaaaggagagggagcgtttactagaacctggagtgagagctgtgagagaaggtgccccataggacacaggcagagaagaagcttggtggtaaataccctgaccccttttccttcctccctgcaatctcctattaatatttccattaaccaacaccaaccagaagccagagggcagaggggtccattgttgaaatccttacaggtcagcttcctggcaccccagcagaatgaagagtggaaagtggatcaggagggctgaatggagaagagtcctcaccccagtgatgacagcatagtgagggacagtgtttactgtgctgcctcccaacagccaagtgccattcagaaaagtggtgccctcactcctacagcccttacagtttggaagtgtttcccatccattttcttttttaaatttttctcttctttctttctttctctccttccttccttccttctttctgtctttctctctctctttcttctttctctcttttttttttttttttgactgggtctcactttgttgctgaggccagagtacagtggtgcaatcttggccgactgcaacatctgccttccgggttcaagctattctcatgcctcagtctccaaaatagctgggtttacaggtgtgcaccaccacacctggctacaatgatgccattgcactccagtctgcgtgacagagcagccttgtctcaacaaataaataaataaataaataggaagagcctcagggttggcactacaaggtgtagacatggatcaggctgagggtggagagtcctaagggaaggcatgggcccctgacatctggaaactggtctgacactgacagcgagaccatgttctttatgctagacatacctgatctcacagaacacctacatcaagtgaggtcactagacaaaaacaaaatcactgtgcagccctcctaaaaaccaccactcttggtaaaaaatgagtgactgctacttctttaccaattacagccttgtcctcgctctagtctgcccttcctgtctgtaacatttatcaagataccaaactacaacatccttctcgctttctgtcagtacccaatccatggcaaacgtcaccttcttacaccctcctcaacattacccaaccaaagcccagactctaaagctttcatcaatatcttcttcctgagatgccccactacttttctgtggagagcatccttcttcaccatatcaagtaataaacccagctggccaactgcaggtgtgttcctggtggtctgtgactggaagacagtgacattcagaaataagggagttcagaacatgttgcccccagatctgctgctgtagaatattgactattttgagttaaaaacggataagaaaacagcagatgaaagaagaccactctgatctgtttcttaaaagcaaaaaataattcccatgtgaagaaggcactctgtaccagaagcaaagtcccactcccatcaaggatggggaattgagaccaagaaaaatctgcacatacaaaccttgttagactcacccttatcttcctggccacttctccacccaactaaccatgttagcccaagcccctttgccttgtcacattttcataatgcactaccctttgtccaattcactatgtgtttactgtaactgcctttttgggtcttcatttccttaataaggcccccgtgtcacataaaacttgtgtgaaataaatgtgtatgttttcctttcgttcatctgtcttatgtcaatgtaactcgcaggtgcagccaaaaatccctatgagggtagaggtgaagttgtgcctcccctccaacagcaaggatccagggcaggcccatggagggttgggatctggggacgagcagaggcaatagccctgctcttctgggtagtgggggatcccaggaaagccaccgaaggcaaaggtcccaggcctgctctggacaggaaaacagagggcttgcccaaacaccataacaaatagaacaaagaccttgcagagtccagaatttacttcagaaaagtttattttaagcaaaaagaacatgataaaactacagttaaaagaaaaaatccagctgggcatggtggctcacgcctataatcacggcactttaggaggctaagggaggatgactgtttgaggctaggagttcaagaccagactgggcaacatagtaagaccccatctctaaaaaaaatttttttttaattagccagattgctgatctgtagtctcagctacttgggaggctgaagttggaggactgtttgagcctaggaggttgagacttcagtgagccgagattgcaccactgcactccagcctgggtgacagagcaagactgtctaaaaacaacaacaacaacaacaaaaaaaaaaccataaaagaaagaaaaagagagagaaaggaagcaaggaaggaaggaagatgtaaaagaaagaaaaagaaagaaagaaaagaaaaggaaagaaaagaaagaaggaaagagaaagaaagaaagaaagagaaatcgatcgaaagaaagaaacaaaaaagaaagaaagaaatccatctagtagctctgtgttgggggattaaagagacaaatactggtggctgggagcccagtgaggaagctgtggggaggaagtaagtacattgggatgctcagagactaccccaagaccctgcttggaacttggagtctttctctccttcattctctgcaaactcaacgtattcctttgaagcagaagtgaaagaacctaagcagctccagttctcagaattgcttgctgctcccagaatgcagctgcctgtctccttgctcctggccaaaaaacaccgagaggaaggcactggagagcagataattcagctcctcagagaaacactacacacagatgtcagaagagaaaattaacccagagtttgtggactagattctccttcagtcatacaagatgcatgtctaattaatggaaatgactttggagcaatgcctttggtttcatgaggggaaaatatttgagatgaaggatttgtccaaatgtattttcttgatgccgcctccaaagaaccttgaaaaggaaggaaaacaaaatgcaagctaagtgtcagtggtaactgatttgtagcttgcaatgttttattaacaatatctggttcatctgctgttggggagagaaacttttaattctaactggtacctaaccagtcctaagcaggctctctgaataccttacttagcacctatgaaaaatgtctgaagcttgaagtacaaaagactaaatagtaatttggaagtttgctgtgctttagagtgaagccctttcctgtcctgcacagacaaagatgtctgctgggtttcatgaatgttgcatggcacgtgtaattacgctagataatcacacctcacccaagccccacacctgatgatgaacaggctgtggaaggctctgtctccatcctcatgaggaattattcagcacctagactgtattccacttctgtttgggcccataaacatacatattgatcaaaagcttttgcaattctgacaccatctactctaaaacactatcttatttgtgggtaatcagcacctcatgaatattagatttctcccttaatttcgctagcgtggctttctttttggcagggaaaggtcaggactcaatcaggtgaatgttgctaagaaaaaaaaaagcagaacaaattcctgctctgggcaggaggatgctgtgggtcagggatgaacgggcctcctccctgtttttcttccgccctctcctcggttcccagcactcccctgcccccaccaccctgacccagccttcctgtctcatggtccagagatggctgcgtggttaaatggctcatcactgaatagaggtaaagaagtatcaaaggcatgagtacctgtatgtcagaagaactcagaaacagatgatgggcgagttgccgggagatagctgagccttgtactgagatcgtgaatggagatacatcttcctgctcccatctacagctcggaagacccaaccttacatcccagtccagtcctggctcctcaagactccagacccacggagaggtggcgctgatggtgagacagccaggaggatggtttctacagtaataacccacagagtgctcagaactcattccccaaatcagccactttcaaatcagaaactagaaagagggagatggaataaaaaataaaggaaggttgagataatcacacagctggaccctgggaggcagtccatgggctgggcagtatctcagtaaggtttaggatccagggtcacatctgtgaggcctccaccccagccccccaaccttctatccagccagccagcctttaattcatttggctatcactaagtgagcacctacaatgtgccagacatggggctaagcactaaaagtgcaaagacaagctggacagtgtctaaaccttttaaatccattcattcatcacttcttcaggcgtgtactgtctctactaggtaacagatattgctagctgaatttaaggcaaagggccaaacagatgtggtcaccatcctttcataaagcacagtcttcacgggtggacatatgtttattttgtgtttatttgtttgaagatcaattataaattgaataagtactagagaagcaatacactgagttttgtagcaagaaaaacaggaaacaccaaatctagcctggtacctttgtggagcctgctctgaggaggtgagctgaggtgaggagtgagggaccaggtccaggggctgaaagaacattctaggcagcaggggcaaccaggggagaagaccctgacttaggaagcactgaacgcattcaaagtggcactgccatccctacactttgggaggccaaggcgggtggatcacctgaggtcaggagtttgagaccagcctggccaacatggtgaaaccctgtctctactaaaaatacaaaaatgtgctgggcgtagtggtgcgtgcccgtaatccagctactcaggaggctgaggcacaagaaacgcttgaacccgggaggcggaggttgcagtgagctgagatcacgccactgcactccagcctgggcaacaagagtgaaactctttctgcaaaaacaaaacaaaacaggacaaaaagaaacacacaaagtgacactgccagaaggccaggggactgggcagagtaacaagggaaagagagatgaaagatggggtgggaaggcatagggaatgagtaggggctttccttggggtccaaagaccccaccaaggggtccacaaatagaattcggtgagtctgtgaaggtggataaaaagtgattctttctgttttttttttgttttgttttgtttttttgttttgagacagagtctctctctgttgcccaggctggagtgcagtggcgtgatctcggctcactacaagctccgcctcccggattcatgccattctcctgcctcagcctcctgagtagctgggactacaggcatctgcctccacgcctggctaatttttttgtatttttagtagagacggggtttcaccatgtgagccaggatggtctcaatctcctgaccttgtgatctgcccgcctcggccttccaaagtgctgggattactgtgcctggccaaaagttattcttttgtgttcaccaacctcgagctgaaattgagcatgtccctaatagtattattagtacctgggaccttgtcatcaatataagccatagaggcctccatttcacagcacggtttttgcagatatcatgctgtgtcatttatactgatcacaacgttggaattatgatgcttatcagacctgctgctataatgtattactagaaaagcaaatctgttattatattacattttaatgttaataagtatatttcaatataattgattttgttaattctgtgtattttactacatgcatttaaaaaattgttcagaaacggggtccactggctttgcccaaaggcatctatggtacaacagaactaaggacccccagctaaagctccctggaggagcttgcagtctggaggagaaggcaatctggggccagaatgagctgaactatgaatggggcagtgccaggggctctggaagaccaaggaggcaatccttgcgccacctgggatgggtgtcagtcatgtccacaacgatggttagaggcatcttctcagagtgcatcccaccctgccaccagccaaaggcaggcacagcacagggaaggccaccaagtcaggccctgcccagctgctgtgacctggtctgcttcaccccaggaggggtgagagcagccttccccaaccctctgcatcccatcaccatggagaccagggcgcagtctagccagagggaagacagtactctgtccttgttatttacttactcatattctccctccttctcttgttcatttactctctctctcctctctcattcccactttctctcctctttgatttttttctctgcctcttttccccctctctcttcccctcgccaacttcctctcatctctattcacttctgtgtttttcctctgcatttattccacaatccttcacttctaacctgccacagagccccgaagcatgaggaactgggtgggaacccacaaatctgatagtcaaggcttctctctgccctatttttaaggtgggaaaacaggcccggagagtggagaaccacaccctgtctctagatgtgcctagcacatcctagtcctagccctgtgctttggcccctgtgcctggagagggtctcagcatggcacgggcctcaaaggcagagctggaagggccttggcttgcctcctcctggcagccctcagcagtgtctatggggtgggggggtaagcaccctcttcctcatgcagaatccctgccttgcccacagtagagctggttcccaagcagaagagcagcaaactgaatccaaaggcagggacctttggaaggcattctctcctcagtggaaatgagcctctctctctgctccacctgcctccccagcacctgccctgggaaatagaaccccatcatcaggggaatgacaaagaaggaatgacggggtcccttgccaacctgctgagcttggcaaggacctcacagcctcttcttccagaaaagacaatgacagcagggagggggaatgaggtgacactaattcctgtggagcctgcctgggatggggagggccagggctggggggtgacttcccagggtgaagctggtgcccccagcccgaccctccctccctcctctgtgcttctgaagcgttttgcgcactggctcgtcagcactgcagcactatctggtagctgccaatttactttattatgacttgttggagcacgaggcctgggaaagcccaggcacttggtaaatttcagttgaggaaagtgaaactcagtgagctttaacacaaatataaatgactgttgaaacatttctaaagttacagagtgaagggagaaagtggcataattcatatcacacaccaaagcatatgtctaaactgctttctttccctcccaagtcaggagaggagcaacgaaacgggcaaatggaatgtcaaagtgtctccccattcgtggctgccggaaggtggctgagcatgatgggccaatcttcatgagatcacataagtgagtctctggccaggccagagggaagtaacagccaagagccctgatgaattaaaaaaatatatatatatatatataaatatataaatataaatatatataaatataaatatatatatatatatatatatgaagatttgaatgggggcccaaagagaaggggccctaacatgggagagtggaggaacagtgggagggttgaggggccaccaagcaggagcactggggctgcacaaagacctcttccagcactcctcatgatgggatccccctgtctctccaaagccctcagagaaagcgtattttggggtgagccactgtccatgggaagcaggcgaaagcccacagagcacgtgtctgagctgtggctggagtcagaggtggggctgagaggatgcagggcaggcacaggaggtgctggacaagaatgtgtaagttatgagtcaaaatgactggaacactctcctggctcactgcaccacctcctccactgctcatgggttgaatgagatgggatcccccaggagaggccagagcccctggggcccaggtgcagctgaggggaagggggcatccagcaggcttccctgaccagctgtccatctaggcccctggccctgctggcagagctggctgcagcctgatgccagactgggtgaggacattatgctaagtgaggtaagtcaggcacaggaaatactgcatgatctcattgagatgtggagtcgactgaggtgtggagtctgaaaaagaagaagaagaagaggaggaggaggaagaagaggaggaagaaaaaaagaagaggaagaagtagtagaagaagaagaacaagaaggagaaggagagaagaaggaagaaggaagaaacaagaatgaaggaagaaggaagaaacagaatagaagaaaagtggctcccaggggtagggaaggcaaggaaatggtggggagatgtaggttaaagagtgcaaacttgcagttatgtaggatgaataagtctggggatctaatgtacagcaagaggactacacttactaatattgtagagtatattgaaaatttactgaaagagttgattttaggtgctgttagtgtgtacacactcaaggaaactatagaaggagatggatatgttaaattggtcatctgtaaataatcacttcactataaatatgtatatcaaaacatcttgttgtgcatcttaaatttacacaattgaaaaaaaaaaaaggctgccagaccaagactcagggccactgcattccaccagggggtgctgtttgacatctgccaacacctttcacagcctcctccgccaaatatttcagaaaccaatttccaataaagcaaacaccctactcacctggctgcagagttggaaaatatcttgtttcgttgcaaatgagttttaccatctcctcagagctctgaacttagccatcatgcacagtctcttagttgggtcagtgtcccgggatggaatttcctgaccttgtcaccggttcttggatccacaccttagagcaattcattactgttggaactgcctgcatctggttctggcctctcctctcaattaagggagaaacaagacaggagggagggctgcaggaagctgctgtgctgtgagaagcaggtgcccttggatggcttctgcaaactccccaggtcccagttttctcattggtgaagaaaccagaatgggcagaccaatagccttacaggcttgctcagtggctatcctgacaaaacaaaagaccaaaacacaggttaggaggtgttacctaaaatgtacaggaggccattgatttgggcggagttcctggctgtgcatctggcctgcggtcacccagtactccgggctctgacacacaggcggcagctcctccctatgaaagtgccacccaggttggacatgtttttaaaagctgatcgttaatgagctggaaaggaaaggaatagaagccattatgatcactctaagaaagcatctctgattcatggatcatttactattgattattgaaaccaatgccatcgtgcacgccctgtggctggttttaaaacctctatatcgtggagtttgggatttatttggaagcactataataagcagcacatgacaattacttccctcagtattccctgtaatcaagataaattatcctgctattgatgtaaatgggatatgaaaatctatagagtcctcctgaggagaataaaccctacattatgctcacctcatttaacagcaaaaccattttggggtcaatcaaaaatacattcccccaaacttttattgccatccatccttagtcacctccagaaacaattagcaaacaataccagtgaggaagcactcagcctaggggcgcctgtactgctgttattatattcgccttatagagcctccatgtccacagacctagggcatcctttgacactcacaggtgtcttatcataaatgtatttacataggacacatatgtatttaaaatttgttttccccattgctaaacaacctcttatgaaaattcaaagtacgattaattatatatgaatttttttataaacaacaaatggccaggcacagtggctcacacctctaatcccagcactttgagaggctgaggcaggtggatcacctgaggtcaggagtttgagaccagcctggccaacatggtgaaacctcgtctctactaaaaatacaaagattaaccaggcatgatggctcatgcctgtagtcccagctacttgggaggctgaggcaggaagaatcgcttgaacctgggaggtggaggatgcagtgagatgaggttgtgctattgcactccagcctgggtgacagagagagactccatctcaaaaaaataaaaataaaaatatataaactcaatttgcattacttctccttctctgatttttgtctcttcttttccatcaagtgcttgccttttgagccagctttctgtggctgcttttcttctgccagaaaaggtgctgccctgagcagctctgtactctctctttctttgattttctctgtttttcctgtccctgaaaccccatactttattcattcagtggggatgccacagccttctttcctaggaattcctttcagtgcagaacgcttctggcagtctcaacttcttttacgcacctaacctctctttctgaatttgttatttaatatattgtccttttattcagcatctttactataaaaccttcttctttatagcaagacaagcataaaatcctctctaagccatgtcttttcaagctattttatctcagtcttaattctcctaatctcacctgtttaaatgaggagagagaaaaaggaagaggaggaggaggaagatgaagagaaggaggggagaaggaggggagaaggaggagaaagactcacagtgacaatgatttgactatcactggatgttaggattatgagtgatttattttacggtctttattttttcagcattttgcagactgtctgcaatgaacatgtacactttattccagttgccctaaaaagctgagcctacgacaaaagcttacaggctaaagctttgttggaggtgcaatcccaaagaaagaagcaggaatgaggaagaaagaggggcagagaaaaagcaaaaacaaatactgagcagtgcaattccaagccggtcacagtctcacaacaaaacatagctgactgctcagtcacttaggacctcaccagagaggccacaaggagctgtgagccacagtcagccaaggagggtcaggaggcactggctgtctcagcctctcctgggcaaagtctgcactgactccccacactggcagaccacgtggctccacaggaaaagccgggctgcaggggacctgacccagccatgcccaggtgcaccgttcctcctgtcacttagcaccacacgtgggggctcttggtctgcagagctggtggcagcagcggaggcagtcagggctcctggaacacagacagctgagctattgctagagctgctctggctggaggcaaggcaagtctgctgatcaaatgcttttatagctaagaaaataagaatagcttgttttaaaatattagattccattataaagtcttgatccttttagcctcagcttgctgtaggctcattcaaacctttttatatcccagatctacactggacacagtcctttaagacagagtcataaaccacaaagcccacggggccaggccaggaacacgcacaggaaagtgagctgagtggaggctgcggaagtgccggctgggtggaggcggagcgcacacacctctaagtcacgactgcctggcttcggcccacggctgttacaccttttgactttgttccaaaatattttaaaattgaaattcacgacttctctaaacgtgagaaatctcatttttcactgttgacaagtggactttttttccccaatattttgagctaaacaaaacatgtcagctctccacagacagtttttatttgtccacaagcttgtgacgtctgctaataaaaagactatggaaaacacttcattttcccaacctctgcattgcctcacatgatagctcatgttttcatgaaggttccatgtgtaagacactgagtgttacacatggagttcctcatgtcgttttggagcagcactgttacataggtaatattattagtcccattttatagatgagaaaactgagcctctggaagcttaagcatcttgctcaagatcattcggatggtgcatcgctggtgtggactttgcacaccttcaggggccaggcctccgttgacttttccactgaagatgtgcccacacgtgttaacctctctgaaactcacaaccctgtctaattgcaggctgcttggctatcactattccgccgataaggaacttgagactcagggatgtaaagtgaccctccagaggttccaagcgtaagaggggaggcagaattcaaaggcaggcatgtgtgactccaggcccaggaagccccagcctggggatccccagcctgctgaattcacagagcttcagagcggtcctgggtgctggaggcagaacagatggagatgggcccagtactcatgctggagaaagtcctctggacacaacttgccagtctcatgcaggtttccctggggcactcactaaaaacaagattggttcttctgacataccctgaaggtagccactgccaggcagccttccccaacttatttccccagtggcttcatttcccagcttccacacccaccactaacagccttcccctctgagaactagactcactgaaagcgcggactgcgttttaagtggctgtgactccccagggctcattttacctaacaaaggaagagataatctgtgacactgtgatataataagaaatagacatatatacatatattttttaaccccatgcctcttgcttctggcacagagctcttaagacctttgtaatttcctgagccattgactatctaacacagagctcctaaatcccttggaatttcctaggtaacaggagtctctttggttcttatgaagtgactcttggtgggctcctgggtggcctcaggatgggggctggttggcaggggaaccaaccatgtgattagggggttggaagtttcagccccactccttgatttctgggaagaggataggaggtgaaggttgagttgatcaccagtggccagttgatttagtcaatcaggcttttgggctggatgtagtggcacacacttgtaattctagcactttgggaagctgagtggggagggcaggatcccttgagctcaggggtccaagaccagcctggacaacatagtgagacccatgtctctacaaaaaaaatttttaaatagccagatatggtgatgtggtggttctagctactgggaaggccgagcagagggatcaactgcttgagcccagaaggttgaggctgcagtgagccatgactgcaccactgtactccagcctggggcacagagtgagacactgtctcaaaaaaacccccaaattatgcttttgtaatgaagccctccaaaaaatccaaaaagacagtttggaaagcttctggttgctgtatgtgtggaaggtccttgaagggggcactgaagccccctgccctccacacatccttggctgtatgcgacccaccacctggttgttcatctgcattcttcaccatatccattattaatataataaactggtaaatgtaagtgtttccttgagttttgggagccatgctagcaaactgtggaaccccagttaaagccagttgatctaaagtgtaggtgataacctactacctgcaattctcgtccaaagtggggcagtcatgtggcactgagccctcatcctgtgggatctgccctaacttcaagtagatagtggcagaattgacttgtaggacatgcggttgggatccactgaaaaaaagtgtgggaaaagcccacatatttgctgtgaagtttggctgagtggttgtgggaataaagaaaacacaattttattgtcatcatcaaactcatcaattagtaacatttcttagcttttaaaaccctttgaaaggctgataaaagctgttggttctcccctcaaaataagcacttattaaacccagtgctccatctgatttcggagacgtcctgtgccgcctgaagcccatccctgcactgaggttgagaactcctgatgcagtcgtggtccttcttcatcgataagtcacttccggcccacaggcttgtcctcagatcactcatgagtttctggcaggccaaggattcctgcttcctaaagtttatttagagttcatggtagacacagactaaaaacctactcaaactggcctcagaaaaggggaagggagacatagtttcagtgtggaatgatggaaaagctctggaagtggacggtggtgacagctgcatgacaacgtgaatgcacttaaagctactggattgtatgcattaaaatagtaaaagtggtaaattttgtgttgcatatatattaccacaataaaaaaaattcaaaaaggtaaaataaaaggaagagtacattttaggggctggagagtacaccagggaagctgctggctgctggacctcaggaggtaacgagaacattgtcacactaacccctgcccctcccctgtggcttctccctgtccactcttccagcttaggcccacatcacagctctcatgcttttattcccctccagcaagagaaatatttcctcaggctgggaggccacagctcataccaagacacaaactcattggaggaggaatctgattgctccaaattggagctaacaatcctgtcttggcagcaggcaagaatctgttaatataatcatggccaccagagaagtgccatcacagggggaggcagaagaaagcagtgtggatgcacatcacagaaacgaagccatgagacgcaccagaaggctacacgcagagcagcacagatagagctgaaccgtctattaccgagtagaaagaggaagaaacagaagatctaggtgggagcttctccagcttgaatcacagaggaaatcactaagggaccctcttaaaatgcagggactgcttccacagatcagaagcagggcctaggactctgcatttctaacaagctccaggcgaggctgctggggcacacaccacactttgagtagccaggctttagagcccaagctcagcttttgtgtaaatcaaaaatgcatgccggaagcagctctacctagtttacaaggatgcatgcattctccagcacattaccaaacacaagatgagaagcagggaagaggtgagggtgtggaagtgcaatgagaatacgggaaagagaaatctacaaaatgggagagggatcttgccccatcggccagtgagagcacgctgagagctgagggtgtgattaacgtgactcgtacccacagtccacagaaggagaaggaagggctctcatgcgatggagcaacttcctggaccctgctggcttggcaggtttcctgggccagccccaccggcttccttaagggacatttgaaatggtgacttagctttcacctataagcagatggcttggtgagggtggtgagatttaaaatccactgcccctgaacttcccacacacttcccacacacaactgcattcaatgtgtctttccaggatatagaaaaaatatttgcttagatttatgttaaccatttgatttgcatgcacaacgcaaaaaaaaaaaatcaacatcagtaatcaaggaggctaatatgcaaatgtatcaaatcatcatccccagaattttctaataaacaaaaggctgaggagcaacagccagtgacgctggcagagctgcaggcgggccacagcgaggggagagggagagccccacagcacagctcacgtggcacagagcacatcactaaatggaaatggtgtgatccatttcacctgcccccaaaacacatgctgctatggctcagctgtgtccacacccaaatctcaccttgagttctcataatccccacatgtcaagggtggggccaggtggagataattgaatcctgagggcagtttcccccatgctgttctcaggatggtgagtgagttttcacgcgatcttatggctttttttttttttataaggggctcttctccctttgcttggcacttcttcctgccaccttgtgaagaaggtgcctgcttctccttcaccttctaccatgattgtaagtttcctgaggcctccccagccatggtgaactgtaagtcaattaaacctctttcccttataaattacccagtctcaggcagttcttttctttatagcagtatgtaaatagactaatacacatgctatccaatagattaaagagactgaaacacaagtgtgtccccaagacaggaagagctgggaaaataaaatacctgacatgtggcatggtgccaagcggaggtcccatggtctgctttccctcaaaaactttattccatctctgtttctccactttcaccctattacctggagagtggaaaaaatgctccttcaaacaaatcactcaaaccaaggaacaagttttagctcatggagtctcactgatattgaaatatgggcctatagtttgaattgcttacaacacactgattaactcaggactaaaatgattcatcatactgttggtgaacttagcagcttagcttctgtgtgtagtaactagattggcacttactgagcacctgctgtatgctgggcagtgtactaggcactgcaactgaggaaaaaaagtattttttttttgagacagagtctcactctgtcacccaggctggagtgcagtggcgtgatctcagctcactggaaactctgcctccggttcatagctgggactacaggtgtgtgccaccacgcctggataattttttgtatttttagtagagatggagttacaccgtgttagccaggatggtctcaatctcctgaccttgtgattcacctgcctcggcctcccaaagtgctgggattacaggcgtgagccaccgcacccagccggaaaaaaaagttttaaagcctggacaacatggcaaaacctcatctctacaaaatatacaaaaatcagccagatggggtggtgcacgtgcctctggtcccagctactcaggagactgaggtaggaggatcgtttgagcatgggaggtcgaggctgcagtgagcgatgatcacgccactgcactccagcctgcatgacagaccttgtctcacaaaaactaaacaaaaacataaacaacacggtcttagatgtgggcattgtctatcatgtgccacccacctatctatctagagagacaagactaacatatacagaatagattagagcaacaaattgtgttcctatacgtccagtggatggacttcatgcttcaggcatggctggatccagggatgcaaacaatgtcaccaagacactgccgcccaccccctgctccctcagagaagcttcctaggcttgaagctgtcatagaaggaagcagccaggaaggagaagcaaaaagaagcgctggcaggccccggctggaagatagtgagatgggggagaaaacacagagcccttctttctcttgtgtctccatcagtccctacatcaattctgcttggctctctgggtcacctgctcctcctgcacacactaagcactgggcaagactatggcactctggttggtctttctgaatcctggacccttcccagaaggggaagggagctgcctaatggtcaggttcaacaaagtcacatggaggggcagagcacaaaggtcactagagaagaatctgctgggcagacaagcaacacaatatgattgagaatgcaacaatatcacactggagacatcaccatgggttgaaataaattaggcgagagtggagcgtttctaaaaatgcttgctgtagactgaatgtttctgtctccccaaaattcataggttgaaacctaatccccactgtgatggaagcaagaggtggaaactttgagaggtgatgaggtcatggggcagagcccttatgattgggatcagtgcccttatacacaaggccctgggagagcttcctcgtcctgttctgccacgtgaggacacagcaagaagccgccatctgtgaagcaggaagcagccctcacagacaccaaatctgccggccccttgaccttggagtttccagcttccagaactgcgagaaataaatgtctgtggtttgtaggtcacccagtctgtgggatttcataatagcagcccaagtggactaagagagtggtaaaattaaacacagcaattacacacatttggggtctcccatatgacaggcaagtattctttgttatcaaaatccaaaatccaagactcaagggctgcaggagccatctctgcccatcccccacgttcatcttttggcatctgtccccctcctcccatggggcttacttctatttttattatttctggctcttacctcagggcccttgcacttgctgttccacttgccaggaattctcttccctgcttgtcttaaaactgattcttctcatccttcagtgtccataagaagtgtggcttccttagggagtgtttctccttccacccttgatgagctggttgcccccctccctcactcactactgagtccccagggtggggaacgcatctgtactgaccattactgcaccccattgcatagtcctaatgcacagtagaaacttgataaatgtttccttccttcattcaacaaatatttactgagcactgacggtgtgccaggcatgacaacaagtgtttaaaatacatcagtgctcaaaacagccaagatcctctactctcaaaaagtgtaaatatttttttcaaatcaatgaccgagcccgctgaccagaaccccagacactgagtagctaagcagaaagcagctgcaagggcaatgcaggtgaagggaagaacaagccgatggcccagaaggcaggatgagaatccgagatccactctccatgatctgccatgagttccaccagaggcctggccatgccttggtttcccccagcccacagcctgcaaatagctcctcgaaacccttggggtgttatggcccctgctcatcctcctgagggcacaggcagcgaactgagaacccctgtgaatagcactctggaaaagtcaagtgccctccacctgctgaatcacacttgacttttgctaaaatcaagacaattacaagattgttcctgatcctatttagtacggctggatggcccttgagccaaattagagggaggatgggcctggaatgagagaggatgagataggttccatgaagctcccataagaatttcactcttgaggcgatgccacagccctggcaggctgcacagaataaaagtccaccttggttagatgcttcacctgtttctaaaggaaactgtactccatcattgttcaggaacttaaagcattcatttaaaaagtaatagcaaacactcagtaaaagcacactttgaccacccactcttcagaccagggccccacccgtttcagaaataaccattcttaccaaattagtgcatgcctcttccagaattttctatgcatttacatacacatgtattgtttaatttttttcttggttttgttttatataaatgagttatattgtcatttcggttcaaaagcttttcttcctctacattacattctatcttgaaagtcttattagtacatatatatgcttttttttaatttttagaaatgggatctcgctttgtcacccaagctggagtgcagtggtgtgatcatagctcactgcagctttgaactgctgggctcaagcgattcttccacctcagcctcctgagtagctgggactacaggcgagcaccaacacacctggctaactttttaaaattattttttgtagagacagggtctcagctcgctatgttgctcaggctggtctcgaactcctggcctcaagcaatcctcccacctcggcctctcaaagcactagattataggtgtgagccacactgctcagcctgtctattcttgtcagcttgtatgtagtactccacagtaactttgtcattatttattcagcattaaatcattatctattccactgttaataaacatttagcttgttttcagtttttccagattccacataatgctgtgatggagagccctgttcacaccttctccctaaggtactgctgagtgtcttcctagagcagatatctacaagtgaaatcactagttcacggagcacacacagttattttaacgtatgctaccaagctcccccatcgtggctggattccccctcccacagccgggcatgagcatgtttatccctccccttaatgtttatagggtcctctttttttctccaacctaattgatgtttttccctaaatcccatcaggcctagtatgaccatcaaatgcagggtgccattggacagccctgagtaagaactgattgccaagtaaaggaaatccttagactgaatagaagaattatccttcaatattccaagttttttctccaggatccatgacatgctcatggtccatccagaaaagacatccaatgtagaagacagagagctggagtaagaggaagaaacagaagcaaaaacactgggagagcacactggctttgggccttagaacagcgtgtggccttgagcatggctctccaacactatgcatccttgtgtcccatgtctgaaaccgtccctacctcatacacttaccataagacttgaagaaaattaaaaatgccaaaaataccatactgagctgctgtcgaggttgtcgactgccttaaacaagagttcttaagcacagtgcaaacccctttttagggatgactatttccaccaaaaatgattgaggaaatccttccccatctcatcaacacaggatggaactcaaagtcatgcctaggcaaaggatatttggtcacagagcagagctgagctgcagcctcccacgagcattaatgattaagtgaccagctagttgctttttacacactcccctggagggcagtggggcatctctggacatggcactgatggaaaccaagccccaggtgaatgtagaggagtggatctcagtgttggcggcgcactgggatcactgcggggagcttcataaaaaaaggatgcccagagatccagatttaattggtcttagaggtgacgtggaggtgagattttgaaaagctcccccagtgattgtgaaatgcagcgaggttaagaaccactgccttagggcagttacagatatcaattctgaccatgcccttcaactaagaagaagagccgggatctgtatatttccttttttttgcaatttcttactgtaaaaatttttttaaaaggagaaaaagtagtgtcctaacacaagagtctcagaattgagaacgtgtgagacaaagatagcgtgagaccaagaggaacagtggcaatacttgaacgaaacagcagaagacaatggtgaaccatgccaggctaactgcctccattacacccttagtaaaaaggaaggggatgttgtagtttgctaggcataattatatgtgacaattttgaagtagggtttaatatttgactttaataattctcagtgaattccttgtgtgtcatcagagattagagttcaaggaggctgaggctactggaatttgcagggcagagaagcagaaaggagaaacatacaccaagaaaggattcctcaagtctgttgctgaacagtaaatttcacttttgcggaaaaaaaaaaaaaaaaaaaaaaactccataaaactaggcatagagtgaccagagaactataagtttgaccattcctagagctcactcagggctacagaaccttcaggctccaaccaggtggggtggagagtctttgttaatatccaaggcattcagttaagagcccagaaggattctgcagtagtggcagaaataagcttgcctggggaaaaggctgctgtaaacgcaagccagggtagcttcaccagtcccagaggaatccaagtaatccccagggagctcaagctcaggcacttgattgcctggactaagtcaaacaccctttgaagcaagacaactaaatccagcaatcaacaatgtagattcaccacatccagggtttcatgcagaaattactatacataggtagtagatatgtaaaatgacaaacatcataaaatgtgaattgcagaatcaaggtggtaggtatatgtcttaaatttttttttataataaaatgtaggactgggtgctgtggctcacacctgtaattccagcactttgggaggccgaggtgggcagatcatgaggtcaggagattgagacaatgctggctaacatagtgaaaccccatctctactaaaaatacaaaaaatgagctgggtgtggtggcaggcgcctgtaatgccagctactcatgaagctgaggcaggagaatcaattgaactggggaggcggaggttgcagtgagccaagatcgtaccactgcactccagcctaggtgacagagtgagactccatctcaaaaaataaaaagtaaaaaagtaggaaaaactactacataggcatataaaagagaaatataactaaaataactacaataaaagttattcaataaaaacagactcagcaatgacagagccaatagagacaagcacataaatcagctactatctgtgcacatgtccagaagccatgttaagcagaacttgttttaagttgtttataatttaaatttgtggatacatattttactttttttttttttttttgagatggagttttgctcttgttgcccaggctggagtgcagtgatgcaatctcagctcactgctgcctctgcctcccaggctcaagtgattctcctgcctcagcctcctgagtagctgggattataggtgtgcgccaccatgcctggctaatttttgtatttttagtagagaccgggtttcaccatgttgggcaggcttgtctcgaactcccgacctcagatgatctgccagtctcagcctcccagagtgctgggatttcagataagccaccacactcggcccatattttacttttcttagggacagggtcacccaggtgggaatgcagtggcacaatcatggctcactgcagcctcaacctcctgctcaagccatcctcttgcctcagcctcccaagtagctgggactacaggcgcaggccaccctacccagctaatttttaaaaaaaatctttcagagatgggatctcactgtgttgcccaggttggtcttgaactcctggggtcaagtgatccttttgccttggcttctcaaagttttgggattataggcatgagccaccatgcctggccaagaagaactttttaaatacttttttctaaaagaaaaaaaatgattacaaagcaaacagaaatactctaacattaccaattgcaggggagagagtcaaagtacaaaaatgattcacaaagcagaagaaaatgaaagtgataagcacatgaggaaaataatcaaccacactaacataaaacattgtaagtaggataatatcagattagtcaagattttaaaattctgtgttcagtgctggtgaccatgtaagaagacactgatccacagctagttgaaggtccattctgggttcctgtttcctggaaagcaatgcttagtgggacgggtaacttcctcatgtgacacagctggtagcagtgctggctggctgtgttccatgtctaaagtcgcagaggctacaccaggctggcaccgtggtctacaaacctgccactctctatcacctttttatttatagagatgagatgggtcactctcagacaaaaataagaggcacagttgtgggccacgacagagcagcaagcagggaaggtaggtccccagatagcggcctgagaggaaggacatacatgtgtagtggccctagcttcactcagacgctgtgtataagttgggggcagagaaaggtgtgtggcagaggaaggcccagctgcagtgtgttcccccaggcagctctgcgggttgaggacacagccaggtcagtcctttctgctcccacatctctccctaatcaaacctgttactggggaacctcagtgacaggctgggttctaggtgcatctggggactgccaaacataacatggcctaccacttgggaggaatgcaatatctgatagtccagtgtttccaaaggttggtaactgaaacagagaagttaaataatttgcccaaggccacacagctgagtcaaggaagtggggcttgttaggcatttcggccacctgcaatccaccttccaaattgcatccctatctttgtgtctcttctactattatttaccttaaacagttttaacttgactttaagtaaaactactttctaaagatttggctcaataaaaaggttataagttttatgaaaaaaaattaagttatagtgatagaggtaggaggcagccaaatgcctagacagatagagaagggtccccagtgaaacccaccttcaagtctaaaacaggctaaggactgaaagacgggaccgctggttttggatgaaacccgtgacccagaaggagaacttctgcctccgtttgcctgccctttcctgattgattctttctgaataatgcctttcaaccaatcaaatgttgccttttccgatactacctatggcttgcctgggcatgcccacctgtgttctaggagaatgggtggagccaccaggaattcacgtcttatgcaggggaggagcctgggcctcttcacctcctgtgcagcagccctggcattcaactgtgaagggaaaacctgcttggagagcccctgtctttgctgggagctttccttttgcttaataaattccaccctcctcacccttcaatgtgtctgtgtgactcatttttttctggtcatgagacaagaacctggatttagctgaatgagggagcaaaaatcctaaaaaaaaaaaaaatcatagatgtatattttgtatatatttaaattcactttaaagtaaatatataactattaaaatgtgtaaaaaaatcatcacacacacaaccagcagtaatttttgacacacttagggggcaagggctcccacgacctctgaactatcctgtgggtatagctgcagggctgtttgttcacacatgtgatgcgtggcctctacttgttcacaagaaacacagtgagaggcagacaatttgctcactgtcagcctcaactggaagaaggctcactgctggatgctcctgtgtggaagtttcccctctctccaggcaggcaggcaacagatcccagcccaacagacagcccccatgaggctccaatgcaccctcggccacagtattgaaggatgctgtttggaccagggcctctaatttccccttcatgagatgtgccgggtttatgatgtctctttcccagccccttgacttccaagcactgcccaaggaccccaacctccacctctctgttttctgcttttcagagtgagaactgttcgcccctgatggtgaagtctagtgactgatccagaggctgctttctgcaaccctgctgggtgctcagatgtcccttcagttgtgtccttgtctaagctggagactaaaaagcgggacgaagagagtcttcctctctctcctttttgtcctctctatcccctctgcttcctctctcccctccttctcctttctcttccctctgccctcttctctctcctctttctctcactccagtgtgtcttaggcctatttcccaaataagagtacctgaaagatggctgctagcatctcagggctgtctgcattattcattcttctactcccaaccctctatttataaccaagccttctggcatctgaaataatgaaaactatcctattagcagctttccgatggtctagactgctctttggaacatcccaaacacttttgtattcaagtttctcttctgactacaggtacttctcactctccaaaatctgactgtcagagctcaggaaccagcagtgccagggacacccctccttaggtgaacctcccactctctgaaccctcaggaaccaaacagactgaagcaagttgcttgcttttgttgcctgaactcaccgtccaaattctcactctctgaatttaggacctgaagagatgacagcaagggacactgtgtattaaactaactcagctgtaaccaaagcatctgtcgacatagttccactgcagcttcctcacagcagaacaacagggaccaaattctcacacagcaacccccaaaggcattctgggacaggcagcatccttcagaggctcacattctggtcagataagttcgataatgcgtccgtgttgaatgcagcagatgtaacccttccagcagattcacaaggcccaccagcccaagctgggcttcacaaatgcgaaggtctctttgctgcaagactttctagagctaaaatctatttgaacatacaccctttgttcaaatagcccttaatatccgatgtatcttgtatgcttccaaacacacccttggaaatccagatttggggtgcatatgcagattcgtgggttttaactagcactttgtcctaagacataagcctgcagtcaccacaaaccaggtctgcagaggggtccagttatctgaattttcaagatgtttccctggtgattctaaggtatagctctggttaagaagaaatgttatctgtgacattttgtgcacaacaaggacgtaaagaaaatgagtgcgtgtggaggccgtttgtgggacttcagacacgtaacatataacagtgatagagtgagatccagaatctcttgccctgaaaggcaaaggtcttttttaaaaacaagttggcccagcatggtggctcacccctgtaatcccagcactttgggaggctgaggtgggcggatcacctgaggtcaaagttcgagaccagcctgaccaacatggagaaaccccatctctattaaaaatacaaaattagcctggcgtggtggcgcatgcctataatcccagttactcgggaggttgaggcaggagaatcacttgaacctgggaagcggagattgcggtgagctgagatcacgccattgcactccagcctaggcaatgagaatgaaaccccgtctcgaaataaataaataaataaataaataaatgagtttttcttaaggtttgaacaaacttctgggtttttgggtaagggaggtgggttagggtttctgggtctcattgctaagctccgagattcattagaacgaaagcagcaaggctcacctacccacacagtccacaggagaccctcgcaggggaaaaccctgattctagacgtaggtggcactttccttagtaacgtgaccaagtgcacttgatagagtggtcctgttagcagcagtgaatccatatgatctgagacaactcaattcttgcctccttagaagaatttgactaaggggcataaggtagagggagagactgaggcaagttttatagcaggagccaaagtttattaaaaagttttaaggcaggggccaggtgcggtggctcacacctggaatcccagtactttggaaggccaaggcaggaggattgctttagatcaggagtttgaaaccagctaggacaacatagcaagacactgtctctattttttttttttttaagttttagagcaggaatggaaggaagtaacatacacttggaagagggccaagtgggcaactggaaagattcaagagcacagtttgacctttgactgaggttttacacgttggcatgcttccagggaactgcatctctcctcttctgcttcttcctttggggtgagctgtccgcatgcccagtggcctaagctcttgggaggggccgcatgcacggtgtgtttaccagagctgtggctgtgcgcatgctcacttgagtcgtttggtcaccgaccggttaaatgctatattgcttcttaatgcacatacttgagcccacctgccaactcctgagatcttatcgggaagctgctgatcaccagtttcaggtttttctatctattgggagactgccttttcttggtactgcctgcaatcaattattattttagagagagacagtgtaacaaccacctgaccctcacctgctggtcgcctgacattcctggtgggggctctcccgccctgctcctgtctgcctaactacctgctctaacagtccagtgggaggaggttggtcctaagcccactagctgctagggtaaataacacggtctctcttttttttttttttttttttgagatggagtctcactctgtcaccaggatggagtgcagtggtgtgatctctgctcctcactgcaacctccgcctcccaggttcaagagattctcctgccgtagcctcctgagtagctgggactacaggcacatgccaccatacctggctaatttttgtacttttagtagagatggggtttcacagtgttggccaggatggtctcgatctcctgacctcgtgatccacccgcctcggccttgcaaagtgctgggattacaggtgtgagccaccacgcccggccaacatggtctcttttggtctctgtgtcctcttctgtaaaatggtgacagttcctgccctgctcaccttgaataagaactttgaggataaatacattactgaaggtaaaaatgcattataaactctaaaaatactacatacatgagagctgattttgattgcttaaggtgcaaataagcccaggctgactgaagatgatgaggtgaccctgatggccgaacctttacgaatcctttccttattagcaagttgacttagtgggagctttgtttcctcagattctgtggctagaaagaccccttattttcctgctgccagggtcatctgtctagaacataaatctgaccgtgtcactcccgctccttcttgtcagatctcagaccaagtgtcagctccatagagaggctttctgctgtcctccatctgcaactgcagacctttcttatacccgagagacactgcagactccctcctgacaggcaccatgacatcagatggctttatttatttctttttcatctctcccctctcaagagaaggcaatctctctgaaagaaggtaaggagatgtttatgttattaaccactctttctaggaagggctagatcaatgctgtgcaggtacctgatgctgagagaaagagagagagagattgcaaggggaaccaggaaaccatcaatgttgaagagagagttatcctgatttccaggccctgattccaggttctcatgaggcctggctgcttatgggttcaataaaagcagcaggatcatgggttttttccaatacattctcacttttgcttaaagcaaattaaaatggtgtgttgttgccttaaccaaatacaccctaagccacatctgccactagagaagaggcctgtggctggcagggactgttttctgctcactcattgtgagtccccagggcctggcacagtgatgggcaaggaaacacctgtgaatgggtagagtttatctttatctctgcactgcacaaaagctcagttctcattttccatttacaatgttccaaagttttccaacataattccacaggtcagaggttacaaactgactacccagctgttgaattagcccataggcttttttttttttttttttttttttttttttaagactgggttttgctctcgttgcctaggctggagtgcaatggagtaatcttggttcactgcaacctctgcctcctgggttcaagcgattctcctgcctcagcctcctgagtagctgggattacaggcacacatgaccacgcccagctaatttttagtatttttagtagagacagggtttcaccatgttgggccaggctggtctcgaactcctgacctcaggtgatccacccgccttggcctcccaaagtgttgggattacaggcatgagccattgcacccggccttgttttgttttttaaaacattgtttttacctggacagtttttgaagaaagaaaagaaggaagcaaagaaagaagaagaaaaggagggaggaagaaaagaaggaagccaacattttaaaatggagtgagttcacatgaaaatcaacattaccagcccctctttaaaaactcgaatattttacagcactaagctctaaaagacctttctacttttacatcttatttttgatggttcagaagaaagcaatctgttcttgcatttaaggtaataaaatctgagaccccagattcctaaagggaaatgagtacaaacagaaagcttacaaatgtgttttccctttctctctctcctattatctgtcccaacaagaaaaccctgccccttccagggacagatgctgcaggattatagaacagtggctcagctgcggactctgccagcatccctgcaagaaatgcctctaagtccccacagttgcagccacatcttctgctgactggagtcacctgtgaagctgatctgcatatggcttctggccttgtttgttgagaaacctgctaaaacaaatgcaagtgtcgggagcggctcattaaagtttttgcgctgctctgcagcacggccctcacttcctgaaactctcatacctctcagagacttcgggtttttttctttctgaaagtctcaatcctggtgccccagggacagcagaaaagcccctcagagccccccaaacagggcatggcccaccaaaggccatggcagtatccacccattgttagaacacactttccttttttttgatgtggttttcactgggaaaagatgggatgtggtggcgaagagaccaataaacaaaaagttaaacacttaagtatacaatggttttctgaaaaataaggagagagagcatgcaaaaatgttactttcaacaactggaaaaaagctctgaaagtccatgcgtcgggcagtagccaaatccatgttccatcttaagtaggtttccctccctccctgcctccctcctatccttcctcctccctctcttccttccctttcttttctttctctctttcttctttccttccttctttgtaaaatcttgccaggtgcagtggttcatgcctctcccagcattttggaaggctgaggcaggaggattgcttgagtccaggagttcaaggtcaacctgggcaatatagtgagacctcatttccaccaaaaaaaataaaaaataaaaattagcttggtgtggtgacacatgaataggaggctgagtaggaggctgaggtgggaagatcatttgaccccaggaggttgaggctgcagtgagctaggattgtgccactgcactccagcctgggcaacagagcaagagaccctgtcttaaaaaaatacatcataaataaaatctgtcccgaaactatcctgactttcatcctccccagattgggctttgtcttcggagcctccatccccagatttctcggcccagagcttgcagatgttttctttgctgcaggctcaaagtgcattttgtgatacatggctgtctcaggccaggttcccccaggagcagacacagagacaggggactgagagcaacaactggctgggaggtggcccagcacctcatcgtagaagagtgtgggaatgagacagggacagaaggcagccagcggagggcaggctgtcacacaggtcaccactgtggcccctagagtccaagccctgaagaatcctgggagcctgtggagcagggggagctggggtctgtgttttccagccccatccaccagcagctgagggctgatgccacgccttttccctcccagcacttctggctggtcccaagcatgtgagcctgcagcagagtgaggtcaaaaggctcgcctagaaccccaatcagggcgccgcagcacctgctccaacttgtccagccccgggcccacctcagttaacagagcagtccctcttccagccaggaggcccttgtggcgaggagaatgtagaggtggagcacatggaggcaatgtacttgtctgggacaatcatttccttactcttatcacaacaaagccattccttcactgtactttagagacctctgtctcctcatgccccaaagatgttcagctggggttctcctcaaggagacagaaagcaatggaccttagattctgcgccagctgctctcttctccgccagggtttacttgggcactggcatgttgaaatgctgcggtttccaagccaaagggcttttctctcccggcaggcctttccagcttcctcggctgcgcggttcttcctttgtggcaggaaggctgggacttacggtggggttaattctgatcgtgtatcactggaacattctttcattcatgtgctagtgttcacagctcactgttgcttcaaagaagctcagtgcgtgagtatttgatattttctttatcgagatgctcagttctctgagtcgctagagcgtctccctttacatccaaattccagccccaccacagttctctccctcttcacagccactgccctctcatctgtcagtcactcagctctcatcagagtaaaagaacagccctggggctgccacaaaaagggctcttcactggagcccagccagcagatcccaactccaagtccctggaattagactcagctcagtggccaggctaagccccagcttgtgccggtgacaaatgagcgctgggcagagcaggccaggagggctccactgttgcttgaaagaaactccgatgaggtgagaatgatggaaaagcaaaagaatgccgtgcaatgcgtgtgtgcataacagccctctctgggaggaatcaacagggctgggttaccaattagatgtggagggcgagggagacctcagacccctggcttggatgaggggagtgtggggaagcaacaacaaaaacagggactggagggcaggcagcctgtgggggctggatggtgtgggaggggcaggggaaggctgctcaacagacccgtgccatctttcattccaccgatgccctccatgtgctctacggtgtgctggaaacacaacaggaagcctcacaaagtatttgtctttatggagctgacatgctgctgtaagaagtcacaaaataaacaagatgctaataagtcaacaagatactttcacagagtcccttggtttggttgtctttgtggcaataagacagagagagagaaagaaagaaagaagcgctggaaaagctgtagacacagctgcagatagcaggagttcacagccctggccttgtattagaatcacctgggaaggttttaaaaaatgtactcatatcggcagggcccggtggctcacacctgtaatcccagcactttgggaggccaaggcgggcggatcacttgaggtcaggagttcaagaccagcctggcccaacatggtgaaaccccgtctctactgaaaatacaaaattagctgggcgtggtggtgcatgcctgtaatcccagctacttgggaggccgaggcaggagaatcacttgaacctgggaggtggaggttgcagtgagccgagattgagccattgcactccagcctgggcaacaagaggaaaactccatctcaaaaaaaaaaaatacttatatctaatgatttattatatacaacacaaagaatacagtgataaaaaacttgataaattagattatatcaaaagtcacatcaaatagacattaataaaatcagaatatctggggttggggagtggtttggttaaaggccccaggtgcttctaaggtgcagccaagctggcgaaccactgggctaggcccctgcccaaaaagatctgacctgactggctggggagaagcttgggggctttgaatctccccaggtagctctgatgggaggtgtctgagaacccctggagagagatgctgaagctgctgcctccacatccatcccaccactccctctttgagtagcatcagggcagtgtgggtagctcaagtcagcttgggggctgtgcctcattgtgttaaaggtggtcccattatgtagacagtgaccaccccaggagtgagccagtgacataccagcagtgcattgccaaagactttggggaaagtttttttctcattcttaagaaagaacaagaagccatgtttgcttccctattaaacattatattaagtgaaataagccaggcacaaaaagacacagttcacatattctatataatttgtgggagctaaaaattaattcaattgaactcgtggagatagacgaaggatggttaccagaggctgggatggatagtgggaaaggtagggggtgggagatggggatggttaatgggtacaaaatatagttagataccacgaatgaggtctagtatttgatagcacgacagggtgactatagtcagcaataatttcttgtacattcagaataactaagagagcacaacgggaatgttcacaacacaaagaaatcatgaatgcttgaagggatggatggctgccccatttccctgtgatccgtgcacactgcacatctgtgtcagagtatctcatgtatcccacaaatatatgcacctcctaggtacccacaaatatcaaaaatagatgtgactgaaggagcttgtagcacaggtgacactgatgggaaaaataagtcttgggaagaagccaacactatggctgcagaaaacagagaacacaggggcccttgatgctgtaatcaagctgcctggtcctgaaactctcactgcctctgctgccacatatgtgagccactagatttgcatcctatttaagccagtttgagttgatttttctattactgccctcaagtgacacaggcagtcatggaaggtgcctgtgagaaagttcaacaccagaaccaagtaagaccaatggatggaaatgatccagccctgtgaaagcctcacagaagggatttgagcatgaggaatggaacccatccagaaataagaagacgcttggtgcattgatgaaacaggaaaaaatgtcatcgttaacaattccaagagctggcctggccagtcacagaatgcgactctgagcagggaaatatcagacacattaaagggcataaaggtcactcaagtgagtcacccagtattactgaggagcactccacatggcacaaaagagggcagaagtccagagagtagtcctgttcttgggatgcaaatggtgtcactggaagaagacgggcgtgctgcctataacaagggcgggtcagagctgtgatgacattcgacccctcaggttggtcccgggcagcacactctgatgattaaatcaggaacaggcaggcagaggggtgtgtgtgtttcagagaaagctggtgatttgctaaccaaaaatgacaaggagaaaaaaatcagaattcttatagcacataaaggacattaaacatggagagactttattcttctagagcattcatttaaagctcatgcctgcagtcctgagtgtttcccttcatcaaacaaggatcaagaagagaggaaatatggtcttcaaagtaaaaaaaaaaaaaaaaaaatgtaaagggtcgtttctgaaattagcctggaatgtttcattgctttacagggagagagcagcctccaagaagcttagcagcatctgcctcttgtctgagcttctatgtcagtttctcccagggcagattttattaaataaacagcaaagagtccgggctcctgagcggctcagaaactcttgcatctttgaggagcttgcatatgctcacgccactctggaaaaccaggtagagaggcacttttcagggagtccccagggtgctgaagcaagaagggcaataatttggttttctttaaaatatatatatatgagacatagtttcaccaggctggagtgcgatggcgtgatctcggctcactgcaacttctatctccaaggttcaagtgattctcctgcctcagcctcctgagtaactgggattacaggtgtgtgccactacacctggctaatttttgtatttttagtagagatggggtttcaccatgttgatcaggctggtcttgaactcctgacctccagtgatgcgcccgcctcagccttccaaagtgctgggattacaggtgtgaaccaccatgcccggccaaaaaattgaggtaaaatcttcctatataatttgccatctttatttttaagtgtacagtttagtgctcataaatatttataatgagggtaatgatttgaagagaaattcaggactcccaggccctctgtgttcctgctgactgagacaggatctgaagcaaggctcgaatctctctgcgatcagttttcttgttaatagagttgagatgcacttgtccctctgcttcctcccaggggcacaaaggaattactggcctggagagacttggaaacacacaaggagcggcgctgatgggaggagctggtttagaataaggcagagacggaacaaagaaggatctttcctggggtagagggagggtggtgggaggacaatggggagtgtggggttgggattctttccaaatgctcaaaagagactcaaaatagactcagtccattcatctcctttatgaaaaccctacaatatcaatgggatgattgctatgagtaaaaattaggaaaactaagagattcagtattggtcaaggcttatcagcagtcttaattgctttaattttagtcaatagacatcatcttcttgtataaggcaacgcttttgtcctggtgactggcaggcctggtacactaaatgccttagcaaagcaagctgggccccttggtcattaccattgcaaacatctgcacgttccctccaatgctcccttgcaaccctgctaaaaataaaatcgtcttttaataacctcaagagcccaccactgtctcctctctggaatgttcactgaggaccccagtaagaaatggaaattgcctcgaatgctctctcctctgccttgacagtgctgctgccggccacgcactctgttgggggaagggcagtgttgatcagaaagcgagctccttgactgacgttatctcctcctgggcagaaaccaatttcagcaagaactttgtaatttggaattcaaggatgtaagatgcattcagggaaccattttccccctacaaattacagtttgtcatttaagaggtttaatatcacaaaaagggcctgcttctgcctttttaaaaaaattttaaaaaatgccacaccgatgctctcagaacagaggcttaggaatgagaagaatggcctgtacttcaaacaaacccattgttccttactagaggcagaagaataatgtcagaaaaaatagttatttattcagcaagctcttgaagtgctcaggcagagtggtggaccccaatgcctggcatatagcacgtggatcccaatgcctggcaataaccacgtgaaggaaggaagaaggggagggaaggaggcagggaagaagaaatacgcagacactgtgtggtaggaattccaagacatagtacattattttatccaaacacaaacacagtatttaatcaagattttcccatgatgcactggggcaagacaatcatgtggggggaggagcccaggcagcaaatgtctagaatgagaagaactgggccacaggccaggctctcaagtcagagtcatgctgaaacctgctccctttctttctttcttttttttctattttttattatactttaagttctagggtacatgtgcacaacgtgcaggtttgttacatatgtatacatgtgccatgttggtgtgctgcacccattaatttgtcatttacattaggtatatctcctaatgctatccctcccccctcccccaaccccatgacaggccccagtgtgtgatgttccccatcctgtgtccgagtgttctattgttcaatttccacctatgagtgagaacacacggtgtttggttttctgtccttgtgatagtttgctgagaatgatggtttccagcttcatccatgtccctacaaaggacatgaactcatcctttttttatggctgcatagtattccatggtgtatatgtgccacattttcttaatccagtctatcattgatggaaatttggattggttccaagtctttgctattgtgaatagtgccgcaataaacatatgtgtgcatgtgtctttatagaagcatgatttataatcctttgagtatatacccagtacaaaaattaattcaagatggattaaagacttaaatgttagacctaaaaccataaaaccctagaagaaaacctaggcaataccattcaggacataggcatgggcaaggacttcatgtctaaaacaccaaaaacaatggcaacaaaagccaaaattgacaaatgggatctaattaaactaaaaagcttctgcacagcaaaagaaactatcatcagagtgaacaggcaacctacagaatgggagaaaatttttgcaacctactcatctgacaaagggctaatatccagaatctacaatgaactcaaacaaatttacaagaaaaaaaaataaccccatcaaaaagtgggcaaaggatatgaacagatacttctcaaaagaagacatttatgcagccaacagacacatgaaaaaatgctcatcatcactggacatcagagaaatgcaaatcaaaaccacaatgagataccatctcacaccagttagaatggcgatcattaaaaagtcaggaaacaacaggtgctggagaggatgtggagaaataggaacacttttacactgttggtgagactgtaaactagttcaaccattgtggaagacagtgtcatgattcctcaaggatctagaactagaaataccatttgacccagcaatcccattaccgggtatattccctttcttatcagttgtatgacaataggcaaactgctttatctctctgaacctcgttttcttcatttagaaaacagagcttatgcctattttggaagacattgttaattcactcaagacccagccaaatgcagtggctcacgcctgtaatcccagcgctatgggaggctgaggtgggaggattgcttgaggccaggagtctgagactcatctgggcaaaaaagtgagaccccaatgctacaaaaaattagccagttgtagtggagtgcacctgtggttccagcttctcaggaggctgaggcagaaatattgctggagcctgggaggttgaggctgcagtgagctgtgatagcaccactgctccccagcctgggagacagagtgagaccatctcaaaaaaaaaaaaaaagaaagaaaagccattcctagccctctttctttcttgtctttctcagctttaaagagcagaacactcagtgccccatttccaagtgtgatgatgagggcagtcggcaatggggcctacgagaaagccatcatgttcttggtaaagggaagatgttggtttggtctcctgaaaagcaaggcttctgagagcagaggccacgttttctcctgtgggaccccaacttgccaaacccagggctgaaagtgtggctggtgctcatggaaaacccaacttgaaatcaggaatggccggacctgccttgagctgtatatgttgcagtcacctttgaatacaaaggccaaaaaaattctctgtggttggctttggagaggttgtcaggaagagctgtaagaaagtgatgattcacagcaaagaaaacaatggatgaaataaaaaggcagcctgcaaatagggaaaaacacatctgcaaaatatcagataggaggttcatatgcaagatttgttaaaaactcatacaactctgccggtgcggtggctcatgcctataatgccagcctttgggaggctgaggcgggtgaatcacgaggtcaggagtttgagactagcctggccaacatggtgaaaccctgtctctactaaaaatacaaaaaattacctgggtgtagtcgcaggtgcctgtaatcccagctactcgggaggctgaggcagaattgcttgaacccaggaggcggaggttgcagtgagctgagatggcgccactgtactctagcctaggcaacagagtgagactccatctcaaaaacaaaaacaaacaaaaaaaaccccacaaaaaacctcatgcaactcaatagcaagaaaacgtgtaacccaattaacaaatgtgcaaaggacttgaataggcatttctccaaagatgaaatgaaaatgaccaacatcattaggaaaaagcaaatcaaaaccactatgagaaaacacctcccacctgtcagggtggctacaataaaaaaaccagtgataacaagtggtggtgagggtgtggagaatgggaacccttgtacactgttgataggagtgtcaattggcaaagcaactatggaaaacagtatgaaggctccagacaaaattaaaaatagcactaccatctgacccagcagtcccacttctgggtacatactcaaaggagatgaaatcaccatctcgtcaaggcatctgcactcccatgctcactgcggcacttcacagcagccaaggtacgtacacgccctaggggtctatcaatggacaaataaagaaaccatggtgtgtgtacaaaacaaaatgttactcagccttaaaaaagacggagatcctgccacttgccataacagggataggcttggaggacattatgataagtgaaataagtcagacacagaaagataaataatgcataacttcacttctatgtgaaatcttaaaaaaaaggttacatatatacacacgtatatacacacgtatatatacacacatgtatatatacacgtatatacacacatgtatatatacacgcatatacacacatgtatatatacacgtatatacacacatgtatatatatacacgtatacatatatgtacacgtgtgtatatatacacacatatatacacatatatacacacacacatatatactatatatacatatatatatacacatacacacagagagagagagagagagagaataaaacagtggttagcagggtcaggataggggagcaggaggaaacagagacatagctcaaaggctcccacatagcaaatatgcaggatgaacaagtctaaagatggaatgcacagcaggagggctgtggctgataacagtggatcctcttctttgctaaatgagaagattataactgcttttgccacagggggaggcagatgccttaaaaaaataaaatgattattgacaaagtgataaataataagagtgaaggaaatttgatgattaagtttgcaaaggggaaataaaacaatttgtccagcactacaccatagcaaaacaatgtgtttaaaatataaaacaaaataaaactgggtcagatgtatttattttttgttgttgctattgtttttaatttaaaattcagccactctctcaagggcctgctcatgatgaaaaatacattccagtttttacagctgccataagacctcataagagcagtggggtaatttcaagggacttctcttgaactacaggggggcccttggctctatgtttagtgaagtcttgcaggagacttgatgataaaaaccacacctgtggacaattccttctctaggtcccatgctaggacagagcttactcctccagcccctactggcggtccactctccaagctgccattcctttacccaggacactcacagatacaactccaacccacaccttgggtgagacatgtcttgggctaaagcgcgagctattattcagaaccccaggactgagaacccttcacagtacaaatgtgaggttgtttttttcttccttccttttttttttttttttttttttttttgagacagggtttcactctgtcacctaggctgagtgcagtgccatgctcatagctcactgcagcctcagccttctgggctgaagtgatcctcccaccttagcttcctaaacagctaggactacaggcatgcaccattatgcccagcaaatttttaaattattattattatttgtagagacagagtcttgctatgttgtccagcctggtctcaaactcctggcctcaagtgatcctcctgcctcagcctctcaaagtgctgggattacaggtgtgaggcaccacacctggcctgatttttttcttttagttagcatcaagtgttcattctggtccccaaagttcagcaaatgtataaatactgagcagcagtgtgcccatgcccctctccctggtcagcctttacaacactgaacacgtgtgttatgctcccaaaaacccctccttaagaatgggaatatgcaagggaaacacaacactaaacctcttttgttagcattcctgataaattcgcacttattactccagtgaaaattgtctgtatgcagagaaagtgctttaaacacagcagattggtcagcctctggtcccctctggctcctacaaactttccaatccttttactttgaagctgggtcactgcagtgaggtgcgtgttgttgttctgcagaatccagttgcatttcatcacagagctttcataagaatccatttatcaaattattccttcgaaaactggagtggcacagatcaaaccaactgaggagctgcgtgacactttaagtcccgatgtcagtgctgcccaaatacaagctagattatcaagtgcttttcaagaacactttaatgccttgttctcatgaactctgacagtctgacgattaggattaaaatgggtcatttgtaggaattgcataagggccggaagttacagccctttcagaaagcacttctgccagccctcccaccaggagtcaggggtggcccaggatggatgggtgtgtcagctgggctctggaagctcactgtggcaccctgtctgcagcagatgtctgtgggggccccacttgcacccccttggttcctggcatctgcatttctgctgaccagagggccaacagcctgaatgcacttcttttcctgcaggcttgcttctgtccctggaacccactctgcccatagatgtggcaggccagaaatgccagggaattcagctctccaggagtgacccttggccaatggctgacagaagctaacgaggtgtgccccagatctctcattcattcgtgggtaaccctgagtcctgagtgtaagttcccccagagtggctaactccagtggcccctggctgactgggtagttactcaccttctgctgctgtcttcccctccatgcctcgcttccacactcccctatctgtgcttcctgggttcacttcccaagtaaaccacttgcactcacatcctggcctcggggtcggcttccaggggaacccagactaagacactgctatccttgctgagatttaagacggagcgcacatctcccaggctagggagggaacacccaaagccaccgctttcccagagactctgacccagctgggaccattaccaatgtgcatcacttgaccctagatgtgaaatcaagagccggaagaagccatcacagcagacacagcagtggccaccccatgagtttccagaagctctcatgtgtgctccaaggactggagttgaacaaatgggaggaggaagaatgaattgttttcctgctgtatctccttctacaggcagctttccgctggctgttgtccctcttgtcatcttctgtaggcttagagagaaaatcacaaggcaagagagaggatcttgcaagcatagagctgtgaggtgtgatgaaattgtcaagttcctgtgagcccgcgtgtgagaataaaggaaacttgcatctttgtgggtgacagaaacaccagttctgttagcagaggcctccccaggaaattcagtgtctgtaattctcttattgtgagaagataaatagcattcttattttgtgaatttgaacccatcaaagttttgtagttgagaatgccacattcatgtccatccaaggagcattccctgactctccacagtagggctggcctgtgctgagagtgggacacagggaaagaacacatagtcccggcctcttcagtagcaaacagaagagagacatacaccaagaaaaaatggcatgaaatgacattcgccacagtgaaaaagcaatgggccatgaaatatggggcacagattcagtcactgaaatcggggaggttccagaagcgagtgacatcgaagctgagtgttgagggagaactgttagcagaagaaggggcatgagcagacaacattccaggcaccatcaaaaaggcagagaagcaagaagaagagctcaaagtttaaagaacatcatcttattccaaataattgagaaaatgttgctgttcacgcaagtgcaaatgatgtggctattttaatgtatgttcacatttaacagtgttttcttttttgtattaagtaaaatacaggactcagtagacaaccctgatgctccatccttaagcttcaagtgagcctccccagagctgagagctgcagggtacaggaagtgggggatgccatgtggaggtgagtaggggaggaggaagtgaagggcgggagcaggcaagggaagtcagagatgaggggcatggtgagttgcggagtgtgagaggtgatgcagggagcagcaagagatggaaataggagggtggggatgacctgtttatgttttcttaatgcaattggtttggggaccatcacaaaacatacaacttgtcaaactgcccaaggccctccagctctctccctctctctctcctctcttcctgtaacatgcacacagacattcaccacaaggagctgtattcctggatgatcaaccaaatggactgtctagggcctgtcattacatttccatgactgtctctaaatcactttgtcctgatttcagaaccaaggcggtaacctcccaacccaatttccttgaatcttaccaaggtgatggtgaattagtgttgatagtaaataaagtcagagctttgagacattattgaagaaaagacacaggaaaataaaaacaataacattaattagctccaagtcagtataatttcctatctaaaataataaagaggctttaaagaaaataaccactaaagcctatctttgtgccaaaaagtccacagagccttatcttctcacaaaggcccctccaaaggtcatcaaccttattcccattttggagagacctcagcctctggaattgctgcaagaaaagtatgactgccccgaaggactgaagcattcagatttcataaaaaacatctgtttgccttttatggctggttttacagaagatggagatgttagtaaatattccatttcttaaaaaatgtcagtaattttagtgactttgtccctcagtaacacatgaaaagtgaatggatgatgcaaatcttgaaaagataaacatcagtatttacataaggagcgttacccaacgaattgagtggagcacagaggggattctttctaagtaataagagactgtcctgaacctcaaaacacttccagtatttgtggagacaaaattcacaacaaagaacacagaatctcacatggcgtcttgtggggtgggctggaaaatggtgagagcccacgtgttctccaggaggagcaaggcatgtatacttagaggactttacagtttacagatgactttcatttttcacgatcgcatttaaccccccacaacaagcaggcaagcagtcttctgttctacacaaagctaagaggggcccaaggctgtgcagcactaggaacaattctggaacttgaaaccgaagtcttctaggtccagccctgagcgctttctccagaaactctgcaacagacctccaaggtaacaccacactgctctcaccactcggcacagtgaccatccttaaacgaatggatgagcactcagaagaatgaatgagtgaaccctgcccccacggccctctggctcactccactctcctcattctctaatccctaaaactccaggcttttcactattcagtggccgcaggaagactccgggtttttcatattttatgcatacagctcctcagagggtcgctttctaataaaagcactgagcattgcagagaaaaatctttctttctaatcaggagaaaagggctttcaaggtccgaggctgaaatctgcgttgtgaacgttcagaaatgaaatgcatgtttcatttgcaacttttgaaaaggtctgtgaggatgcatttggcctaggtttaaacggaaaatgccttcatactttaatatttacaacataaaattaattagtttttctttgatgaaacttgaatcattcagctttcagaagccaatttagcatttccattttgttctcttctacacacaaacatgcacacacacatatatgtgtgcttacatatacatgcatacacagtcacatctgtatgcatcacatatattcacgtgcacacctacacacctgcacatatgtacagtcacacttcattcttctcatgcacagactgatttagtcaacacagaagagtagaaggaatcagtattggactgcgccgcctgctgtgttttaatattcaactatttaattccaactcttaatgtacttcccccttgctattctgctgatgtttcacttttagagactccactctgctgaatcattgtaccacagaattctgagttggggcagcttaaggccacctgaggctacttcccctctaaagcatgaatcctctcccaacagtaaccagaccaagaagttcagactctttgggatgcatccaggaatagagaacttgcgccctgctgaagaagtctcattctttttctcatgtctcctgactgcaaaggtcttcaggtcataaaattcaagtcctgtttctgcttctgacccgtggattaccacagacacatcagattctgttctaagccctaggtttagcaagagggtattggaacaactgatctttaaggtccaactaagacgttttaataatgcagacacttaaaatatcctgccttatttggagccaaaaatctccttccttacagtgtccaccccctggtccaagctctgacctctgggattataccttcatccttgtgtaagtgagtgatagctgcaccatttcctccaggcgggactccccggctctctgcaaagctgtgtcctgggtacctcttgtgcctgcctcccatcattgtggtccacctttcactccagccgttgctgtggcaaccagcttgtgagggtggagcccaacagctcctcatctcagctgcactatattcctcccaccttctgctctagaggtagctcaccttctgatgctccattgtggagtctacaggccagcctggaccagagggaccaaacatctgggtgttttcaggattgaggggattttggggttgcagcagggcttttagtttgaaaatcaggacagtcccaggtcaagtgggacaagttggtcaccccagcatgggtttaggagggccttaacatccacggaatgaccctcagcaatggggggctccaggagctggcagctgaccgctcccctcctcctgccctggacagacttggtgggtgcattctatacatacagctcctcagagggtcatggaagcatgaggccccattgcccacagtggtgattaatttggtaactccccaattagaaaaggcttttccacctatcttgttttgtgctcctcagtccccccatgtctgttttctagaataggatctcacaatgaatgaactacacacaagttcagctttgggttcagctttgggaggggattccaggctctggcaggcacctgggaaatttggataatgaaaatgtcacagggttgcacgttttggatgctggacttctcatcctaaggtccagatggcattcttctagagtgaagatcatgagaaagggtcttggtttcttgacagcttctcagtattcttgcttgcacatcaagacagccaggttactgcagaaaatcatttctgtagttgttggttcattttctcaaaatacgggatttgggggttacgtctgagaaccacacaggggatcttgcctctgatcaaaatcaaatcaaaacacctcctgtggtgacagagcaggcattttatttcctgacaatatttctcccatctgattcaatttcagcaaaggaaatttaagtagatgcaggtgaaagaattgagaactgagagctacctgacttgtgttcctcagtaaaaaacaaacaaacaaactgaaatatgtttaacggaagagggggagaagcccactaccctcttacacatattctgagtcaagtcgagcttttctggggacaggatgaggaaaccaggtgactgagtatttctccagtactcatcatgtggcttctgcagcacattacacaaagcatcttactttattccttagaatgaccccaaggtgacctttgcccttgtgaccccattttatggctggagaaactgagagtcaggaagatgagggaatttcaccaacatcacataactagtcatctgcagactggggctcaaatctgggcagttccagctccaaagtctataaccctaaccagtgcactgtctggcctctctagagaagtagagttcagacagggtcagggggcccctttgtggtatcatcccccttcaccacatctgcccttctatgtcattacttgagctctttcctctaaggagaattcctttcctacccacccccaccacccctcaccccagccccctgccccacagctccggctgtgaaaaccctgccagtccttctcggcccagatcatgcccccccgaccaaagcttcttcagctacgtgctgggcagcatcccttccgccactgaattcccatagttgttcactatcgatgctatgtaaatgcacacatcaaatacttaatgaacacttactatgcaccaggccctgcactaagcattttacacagatgatctctacatcaactctatctcaagttactattatctttcctattttataactgaggaaaacaccacccagagaggttaagtatgatggggcccactctttcactcccttctagactccaggctagagaaaggagtgtccacagtgacacaggccaccaatgcagtttgttggccaaaggtgctgcagcacaataagttttcacatcagccttgatgtccaaagctttttactggccccttggtactgcaaactttcctcctggatcttcctcccactatgtctagcttcagccttcaatcaacagaaatgtattgagtgcctgctacattctaggtgctgtttcaggtgcccagaaggttctttttattgggagatagacatgatagataggtataaaagaacatagaaagataccaagacctaccaccagcttctgttttgtttgtttgtttttgcttaagataaattatccagaacttgataagagacatctgaatctttctttccacaatctattaggacccaggcattttaaaattttatttattaattatttttttagagatggagtcctctctgttgcccaagctagagtgcagtgacgtgatctcagctcactgcaacctccgcctcccaagttcgagtgattctcctgcctcagcctctgtagtagctgggattacaggtgtgtaccaccacgcccggctaatttttagtagagacagggttttgccacgttggccaaggtggtctcaaactcctgacctcaagtgatctgcctgccttggcctcccaaaatgttgggattacaggcgtgagccaccacgcctggacattttacgattttataaaactgttaaggtgcaacaaataattttctgtctagtagtgacaataacttccaagggtgggattttattgccctgcctggtattaaccagttttgatctaatttcatacttctatcttagcatttattttttccctgctgacattaaaatcccagttcctcatatttctcttgtgaacttggcttgtcattaatgaattaaataaaatgaagagatatttgaaagttgcagctaccaggataaagttgctcttgtcagacctggataaaatagagccaggaaggcataaaaaaggagggagggagggtatgctttcctgtctgagatgagaactgttccaaggactgtctgaaaaccccacaggaaatccctcatgtccttcacacatctccagctctgcacggcttgcatgtttctcacgtgtgcacgtatttctatgacaaggtttatcactagacagtctttaggaccatggcaattcagataagatgctctcaaagaacacctgctcaggaatggcatctccaccaacaaattcatgccaactcaggcattgagcctccggcacccatgaattctgtttctacacagtgtaggtaaacttcccccttctgccaataaagccgctctttacccttccctcagcagatatatccggggcttgccacagtgcaacctggattacaatcctcttctttactttttcttttggagatggggttttgctctgttgccctggcaatcatagctcactgtagcctcaaactcgtcagcttaagtgattctcctgcctcagcctccagagtatctaggactacaggcatgcaccactatacccagcaattttttaattttttttttcgtagagactgggtcttgctatgttgtccaggctggtctgaagctcttggcctcaagcaatctaccttggcctctcaaagtgctgggattacaggtgtgggctattgtgcccagacatcttttctaatcactgaataaattcaacatatttggacgtatttttctctgatgtctttttttaggttgacaaatgcatactacaaccatatgggaattatgtttttttaaatttttaatatcctatttgacaatcatattcagagaattaaaatgattgatgtaatcatgagtcaatgagtggtccctctagaatgtgtggtcaggaaagacttttcagaagaggggcatgtgagctaaaggccaaaaacaactgggcctgcgaaaatgaggacaaggttatttcaggtggagagaacagctaagcaaaggactaaagcagctggcatgttcagtggcaacctgataaatgcttagcagctggctgggtcaggggagccctgatctgtggtgtttgcccatttctgtggcgtaaatactcccaggattttgagcgatgatgcaaggtcactgagtttggagttggaaagcagtgaaaatgagccaatctgagctggttccagcacacctcttggtctgttccaagaaaagaaataaagccagaagagcagaggagacaaaggagacagttgcaggagatgaggtcaaagaagcaggcaggaggctgatcttggaaggagcctagactgcattccaattataacaagaagccacgcggaaggtgttaaagcacagagtgacactccctcttcctttctaccttcttggtgtttttctcaagaggaaacaaaggcagaataaggagtagcgcaaatcctctcctcgtcttacgcatcagcagtgaacacgtccttggcgtctcacctcctacctcctgaggcatagcaacaaacaccatgacacagcaacaaacatcatggcacatcattttccagtttttctcaatagtgagcactcaattgtttttgagagcaggtaagtaaattcattctcttaagactatacagaaaagtaactgttaagtaaaattgttttaaaatggcctttactgtttcaaactgttaaaaatggtcacagaggtaatttaatgccttttaaaaggcaattgctgtcagccacagctggttgactgcctgcacactgaagctgctggaagagaaagacgacagccgttgtggtaataacatgctgccaagagaggtgacttcgtccatctcaggcgcagagctgaaggtggatgctggggaagggagacctgttgctgaagctgttggagagcttcttgcctctgtggcttatcccatttaatctagtgggctattggctcaggcaccagggggcctaaggaatggctataacctttcttctgagtttcaccctaaattgggcgctagagcggcagccacagaaaatgccctttccagtgtgcctcgtactttcttctcccaactgcgatctcctcaagggaaatgttaaagaaaaagttagtcagtgctacttgtaaagcatggtaggtaagactttatttaggaccattgcaataggtatgggatgcatgggcaagtaagaatttatggccaaggagaagcataagggtcagcagatggaaaattacatcggggtgagggaggttctgggtaaactgacctaacagtttcttactgaggcatggtggggggtgatcctacatcacctgggggatggcagaggatgaggagcctgatcagatatcaagggcgatcagatattgatggtggtgggtgctaccctgacttagcagggatctttgctaaaactagatcttacaaggcagtgcatgagtgagcccagcagaatattcagaagccggactaaactggcacagcaaagaatctttgtcagaggagccacatatgatttattcctataccccccacagtgcccaatgcgtgcttggtcaataatggattttcattaaatgtccatccaccagcaagcaaatttcactggatattccatatgtgcctggcactagattaattgacagggacttggagataaacaagataccacaccaccatcaaatgaacagcaacagtcagaagacagagaaatgagggggcacacagagagaaatagaggcagagagagctagaggtaaaggaaataatacaccctaagggttctacaaaggatctaacagggttaacaggtttataaagacatcaacaatcagagaaagagagccaaagagatctatagaaacagtgggtgctgaaatatcagttaattaaaaggttatggccatggcaaggaaatagtaatggctgctttaaatttttccaggtaacactgtcttggctgtgcctaatagtatagaaattcagcagggctgggcacggtggcttatgcctgtaatcccagcactttgggaggctgaggcaggcagatcatgaggtcaggagattgagaccatcctggccaacatggtgaaaccgcatctctactaaaaatacaaaaattagctgggcatggtggtgcgcacctgtagtcccagctactctggaggctgaggcaggagaatcgcttgaacctggaaggcagaggttgcagtgagccaagatcgcgccactgcgctccagtctggtgacagagcaagactccatctcaaaaaaaatcagaaattcagcagcctaaatcacgtgtgggagcaatcccagaatggttttctgatgagtgttcagggtggctgtcaccctgtacagactctgaggacccaaagtgccatcagcccgcatgtgatgtgagtagggatgtacggggatcaggtgctaaatggagtcctggctcaaatatgtctcacagtggagtgggtccccatggcagtcattgctccagctcttgaatttatcattggaatggccaaacaatggctgcagaacccaagaatttgtttcttgacttacggaataaaagctatcacaataggaacaaccaaatggaagcctctgaagatgccccttatcctttaatcctgacctgaagaataaatcaaacacaccacatcctaaggagagtgaagacaggtgccacttccaaagacataagggatgcaggagcaatggtctccgtttaactcacaagtctaacctcttcaaaaataagataggccatagaagacaacagcaaactactacacatttgagcaagtagtacccctactcacagctacgctgggtgtttgtttttactagaacatatgaatgcatacacatgtggaatgcagctactgatttggcatatgcattattttaatacccaccacaaaagagattcagaaacagttagcattcttatggatggacaacagtagacatttacaggctgttaaccctgctctccattataatataaccagaagggacagtccaaagaacttcacactggtgcactatgttgatgacatcatgttaatcagacctatggacaagaagagcaaatattctatatgtttcattaagaaacacactagaaggtgggagagcaacctgcaaaaccttagggtcctgccattttggtgaagctgccttttgggaccagtagtctggggttttctcaaacatcacttaaaaagtaaaggacaagttattgcttagcggtagcaccttctaccattaagaacaaagcacattaactggaggtctctacaggttttagagtaacacaaaccacgcctggcaatactctgacccatttattaggtgacatggaaactattagttttgagtgggcccagagcagtaaaggccctgcagaaggtttagactgcagtggaaatagctctgcttggactataacctggaagaatccatgcgaccaaaggcatttgtgttaggaaaagtgtgtagtagatgagttgcagtgcagacccttgtagttccagaaaaaggctgtgccatccacagcaaagaactatgggccactcaaagcgaactcctgacatcctgctgggccctggcggaatgagtgtctgaccatgggacatcaagagcttcagggaagagctatgtagatggacacatgagggtgggcatggagtgtgaggatcttagtgttgtaagttaaccctcactagaaagcatccactgctgtgacaaggaaccaagtggatagaatgatccagctagtagatgtcagccagcctctggccctggctactgctgctcttgtgaagtgggttcatgagtgacacagtagtggaggcagagatggtggcaaagaatgaggctaacatgacccaacatcatggggtccctctccccaaggctgattcagccacagctactgattggtgtctaactacagccacagaaggtgggtgtctcactaaccagtcacttgcaggcaagttgattatattgaacctcttctacactgaagggactgtgagtcatcttcactagaaatggcatatatctatgaatatgggtttgttttttctgtccacaggccctcagccagtcctgcaatcctagggctcctagagtgtctgtagatctactctatgcattctgtgacaggattccacatagcatcacctcagaccaaagggtccactttacagcaagaaaaacatagaggcgggcacacagccatggcatccactggtcctaccatgtgccacaccacacaggaactgctgggggataagcaatgggatagcctattgaagacatagctgaagaaccagcttagagatgacactctgcaaagagagtggcaccctttaaaatgtggtatacactttgaacaaagggccattatatgatgctcggtccccaagaggcagaatgcttgggtcaggagagtggaggctagccactgaaaccaatggaagtgccagcctcaccaagagacagggagattctgaaagcctgatggagaaggtggatgatgagtatgaggcatggcttcaggagtggcaacagtggagggctatggtttgtccctatttctcttcttatgagtttccccagaaatggtgatcaaccagaagcctggagaagctgtgtgccaaggaggagtacttgaaatatatatacgctggtgattctgatctccaaggataaagttaaaattcccaagaacttttataaaagtaaaagttcaggttaccttaaaaagaataaaaatctgactgccatcaaactgctcatttgcaacatggtattctggaaataataaaactttgtcttccaactttttatggaaaattatttttactgattgattgattgagacagggtctccctctgttgcccaggctgccatgcagtggtgcaatcacagctcattacagcctttacctctcaggttcaagtggtcctcccacctcagcctcttgagtagctgggaccacaggtgcacagcactacacctggctcatttttttttgttttgtagagatgaaaatttttatgttgcccaggcttatctcaaacttggattcaagcaatccgtcctcctcagcctcccaaagtactgagattataggcatgagctactgtacctggctgggaaattatttttagcccagaattctatatccaatatcaagaataaggttaaaaataaacatattaaactcataaaaatatcataaattcaccttctatgggaaaataaattactgaaggatgttctctgcccctcaagttctgggacctcagcaaaagcagcaggaaaaggctggcatcatcgggacacaccttccctcaggtgtctgtggctcctaccagcccaggctggggcttctgcagggctgtcagccacaacctctactgtgggccctccatgtgacccctccacataagctagtttgattccatgggtgagcatcccaagataacaagcatataggcatggcctttcacggtctgggctcagaggtcacatagcatcacgtctgctgcactctgctgatcaaggcagtcaccaagacccagccagggtcagggagagaacatggtgtagctgtaaaagcatgggggttggcagacattgttgcagtcatttttagaaaatatgacctgccacggcagtgagcaagggcaccagtgacatccatggtcaaatccaagtaactctcagtggtgtgactgtgagacataatgcaattgacaagaatgagaatttttaaagctttggcctatataaaaaattaaaaaatgaatgaaatatagaactaagattccaggttatttcaaaataatgtggatgttaggagtagaggtggaaaggagagtataatgtgtgctaagtgtcttgttcatttgaagtagttacaggtagaaattaattctggactttaaattatgactatattcacatggattagtaaaatgtttaaaactcttgtataatactttggcattaaaaataataactttaaggccaaccattagaagactagacataagatgtaatttctaaaacagtaaaataatggaagtgacaaaaaacaataaaacaagaagaagatattttaaggccaaaacatgaaataagatggtagtaattatgtaaacacatcattagtcacaaatgtgaatttaatctcctttttaaagagagaaatttttaaattggaatgttttaaattcagctgtatgttatttacaaaaaagcatgcctaaatttggaaaaaaaaaaaaaaagagagagaggaaaatttgaaaataaaaaaataaatgaagatataccagggaaatgctaactaaaagaaagcagaaatgtcaatagcaatagtagtcaaaatggacttcaaagtgagaggcattaaatgcattaaataggaatgagacatatttatattataaaaattacagttgcctccaaaatataacaatcattaacctttatgaacagagcaatattatattggtatttatagagttaaaactcctggaaacataagagaaactgacaaaccacaatcttggcgagagattttaaaacctctccaagaaattaagataccaactagatgaaaaaaaattaagccatagaggacataaatagttattgtactttcatataaacttccagtttctaatttaattaactatatagttgcattgctaatatgaattgttctcagtaaaaaggctgcacaatgttttcaaatacctgttggattttttttgtttgtttgtttatttaccaaaccagggtatttagcatatacattacctcctacagttattatttatttgttgtgagaacattcagaattgtctcttcttgcctttttagagtatacaacagagaaatgttaaccacagtcaccctcctgtgtaatagaacgccagaacttattcctcctatctaactgtaacttcgtactcactgaccaacctctccctgtttccagtggaacaacctttaactacccttttattagtcaaaataaataaataaataagttgccaaaagtcaaaaatcacacaggtcacattcagtgatccaataaaaataagtttcgcaaacacctcgtttcgaaattaaagcaactctaaatatatcttagtttaatgtgaatatcaaaactgaaattacatctcttgcctgagacctaaaatagtaaaacacatggaagaacacagcaggatggtggctaccatggcattgaaggaatgtgatgtggggagttgttgttcaacaaggataaaatcaggtttttttgttttgttttgctttgttttgagacagagtcttgttctgtcccccaggctggagtgcagtggcatgatcttggctcactgcaacctctgctttccgggttcaagcgattctcctgcctcagcctcctgagttgctgggattacagacacatgccaccatgcccggctaatatttgtatttttagtagagatgggcttctgccatgttggccaggctggctcctgacctcaggtgaccctcccacctcggcctcccaaagtgctgggattacaggtgtgagccactgcacccagccaagatcagttttaagatgagtaagctccagagatctgctatacaatgcagcccctgtggttaaaaataatttaaagggtagatttcatattaagcgttcttaccacaaaagtgggtggaaacacaaggcaactctgagaagtgatggagatgtttattaccttgactgtggtgagggtagcatgatatagacacatgtccaaactcactgaagtgtatgcattaattatgtgcagttttttgatacaccaattatacctcaataaagctgggacaaaaaatttgcttacactaaaattacaaagtaaatagaaataaatgtcagtgagagtactaaaggtagttactttttttggtcacttttattcttttagtattttagaaattacatcttatgtctagtcttctaatggttggccttaaaattatttctttaaatgacgaagtatatggatgtcaccaaagccatatttgatgccaattttggtcacatttgcatttattagcacacatgaaagaccaaaaatagaataagaattatactcaagaaggtaaatgtaaatacatccttaaaaagtagaaatttaataaaaatacagcagaaatcagaaaattcttttaaatgaatactaactcataaccaaatgtgtcatcctgagaatgtaagaacatggcaacattaggaaatttatgcaaaaaaaaatacactatatagaaaaggggatgccacgtggtcagctcaagaggcagaaacacattctgttccccccctcccccaatattttattatccaggaaaaaatttaaactttcttaacttgataaaaggtagctttcaaaacctacaataaataacatacttagagtggcagcattagaaatctattaaacccaatatacagtaactatcatcttaactatccagcattattccagaggtcctggaaaactccagaaaatgaaaacaagaaattctattaatattcaaaaggaaggcaggctgggcgcggtggctcatgcctgtaattctagcattttgggaggctgaggcaggcggatcacttgcggtcaggagtttgagaccagcctggccaacatggtgaaacctcatttctactaaaaaaaaaatacaaaaaaacttagccgggcatggtggcacgcacctgtaatcccagctactcaggaggctgaggcaggagaattgcttgaacccgagaggtggaggttgcagtgagccaagattgtcccactgcactccagcctgggtgacagagcgagacgctgtctcaaaaaaaaaaaaaaaaaaaaaaagaaaaaaaatatgtattcaataggaagaaataaaacctaatctactgattataaacatgattgtttatacaaaaaataatcagctaaaaattgttagaatctatgagtttagtaaggtggccaaataaaacaacattcccaaaccaataggtttcctgcacaccagtagtaatcaattagaaaaagttgaatttcagtatttatagttttctaggaattagtctatttcttctaagttgtagacattatgaatatagcatcatccttttcatgactgaaggatctgtagagatatttcctgctttatctggacattggtgatctgtgtctttttttctattgtgtcagccttgaaaaagataaaaagaaattgaccaggagatttgtcaattttactgattttttttaaaaagaactgccttttaaattttattgatgttctctcattgttcacctgttttcaattttataattgaaaacatctttaaaaagcagaaatgtatggtatctttctcatttctatctgtttgctttgagtttacgttgttcttctttttctaggtttttcgtggaaagcctctgaaacgtctacctggagctctctgtgtagttgtatggatacctccccaggtgtgcctctctgagaggacaggtctgccttgagctataaacatggcatttgtcggccaggcgcagtggctcaagcctgtaatcccagcactttgggaggccaaggcgggtggatcacaaggtcagcagtttgagaccagcctgaccaacatggtgaaaccccatctctactaaaaatacaaaaaaattagctgggcgtggtggcgggcacctgtagtcccagctactcgggaggctgaggcaggaagaatggcgtgaaccccagaggtggagcttgcagtgagctgagattgcaccaccgcactccagcctgggcaacagagcgagactccgtctcagagaaaaaaaaaaaaaaggaaaaacaaccctggcatttgtcagcatgcatgctgttgaaagctgtgggattagatgaggtgataaggtgcaattgtgtaggcagggcccaggacaaagctgcagtgttttaaggtctggagaagaaaatccagcaaaggggactgagggatggcaggagcgaggaggaagagaatcagtcagaaataatgtcactttgggaggcaaggcgggcagatcacctgaagtcaggagtttgagaccagcctcgccaacatgatgaaaccccatctctactaaaaatacaaaaattagccaggtgtggtggcaggtgcctataatcccagctactcgtgaggctgaggtgggagaatcacttgaacctgggaggcggaggttgcagcgagccaagtttgcaccattgcactccagcctgggcgacagagtgagactccatctcaaaaaaagagaggaaaaaaaaaggtcaaaagagcagcacttttcagaaggaaaacatggacaactgtgccatgctgatgagagatcaaacaagatgaagtcctaaatggttcactggaagcagcaacgtggaagcccctggtgactttgacatgagcagtttcactggagtgtggcagacagaatctgactgaggagctgggggtcagggcgggagggggtgctcagcaggcaagggtgtcacatttgttaatgaagacggtgtcacatttgttaatgaagatgttctctcctttgaatgagatgatgcatttagtgtgtaacagtgtccggctcacagtcgggccttgctaacactttgctttcactcacttccttatctttcattcactgaccagaaaggttaatggtggctgttcctcttttgaaaagcggattgggaacaccagcatagctattttgacactgggatttctgttagaaaagtagatgtgacttattccctttgggtggaactccttttctagaaagggaggcaacacacatgttgggtaaatctcagtttctagagtcaggctgccataagttaaatctcagttccgcccccgagacatgtagctatggggattttacatgaactcccgagtctcagttttctcaccatcaaccattcatcagaatagtgcctacctcaccaatgcacaccttaagcacctggcgcctctgttagctaccatttaagttgagaatttccctgtgaggttttttcagaggaggttccttctacaataaaccaccaagtacttggtccccttttgcagaaatccatccacaccatgtgtaaacacaggggctgggaacttgcatggtaaaccaggtcagccaaacacggattaacaatgccaggcccatttcacctgcaaagtatcagcgactcttcaatcggcaggtccccagctgccttgcagcacagccagggcctagcatagcgctgcctccttccctttcacttgtcctcaggaatccccggagatccagggtgaggctcctttagtctaatgagaaggaggcattctgactttttaggttattttctcttcccagcccctggcagatggaaaaagaaaacaaaacaaaacaaaacaaaaaaacaaacaaaaaaaaccccgccacaataattgctgcttgcatgaatgacctcaatacgggaagagtgctgagcgcctaagtccttgcactgctgccaggcctggcgtcatcatgattaacacagcaatcaccggccagggagccgggccgctctgcctaccagacaccctgactgggtgacttacggctttatatttttaaattggcctctctagcaccgtctgataaatcaacacacaagtcattaaatggttcattatcccagtaatatgattcattctttgtgccaagaaatgcaggagatgtcaggaaacttaaaaatatctcatttgaagccatgagtgcccatctacataacagattaactggatgagagagagtggttggacatggaggtcaaagagaagactcagcaggtggtggtcttacctgcagcagtcctttacctcctgctgaaaaatgtaagtcacactctcactaggcaggctctgtgctggccacactttctccctcataggctcagaaggcggtcatgctggctgcaggcacctgctagagaattcacagccgagggcactcagctagggtcattcctataggaagaacaccaagtccagaagatgacggggccatgtgctatggaagaaagagcactcggtcccagttctgccaccaggtctgaaactctgggtacattgcttgaaatgaaatcacaatactttgttgtcatcatctgtcaaacaagaaagtcattctccacattttttcaagttctttctagctctaagattctatgactctagtgtgttggaggagaagagaggaaggcagagttgagagcttggtcagagctgagttccaatgtatctgatatgtggattatgtaggagactcttccaccaaatctacatacactattttgcatgaaggttgctaatttatgttgattgtgtcagtgatggctcctttagtagaaagaagaaaaaaaatctaaatgaaactggcttaagcactaaggacatttatttgtttgtgtattctgcaacctctgaatgtttgctttggtctccattacaacacctgggactagaagagtccctagactcatggaacttaattctagttggggaaatagataataaacaaaacatatgtaactatattatctaatgtcaggtaatgacaaatgcaatgaagacaaacaaacaggacaggtgaatagagagatccttttttacacagaatggtgatggaaggtctctttaaggcaattaatagctgatacaatgttggtaaataaaggtatgacaagaagactatgagaccttcagagaagattcctgccaggaagcacgactaccaagagcacagatatgtggttaagcataccaggcgaacccagtgaactagatttctgtggaggatggaaggaaccagcatggtccaccctgttggggagctcagaatggagctgacagtgttggctgagaagtttggaagggttcctatgacagggccacatgttgctgtaaccaagagctcagcatctgccaaggactcaagtgaatcttcaggcagatttctacagcccccacttgctcagctccctcttctccagtggcctccctcacaaactccaacagtccacaaccctgatctctaaatactcggcttagtgagatcaatgcttttgttgagtttctacctctctgcatttcagaaaaaaaccccaaaaaaacaaacaaaaaaaacggcccaagaaagaaagctgggaccccctttttagaggcacgtgaaccagaacaactccatcttgaataggagctgggtaaaataaggctgaaacctactgggcttcattcccagatggttacggcattctaagtcacaggatgagataagaggtcggcacaagatacaggtaataaagaccttgctgataaaacaggtttcagtaaggaagccggctaaatcctcccaaaaccaagatggccacaagagtgactctggccatcctcactgctacactcccaccagcaacatgacagtttacaaataccatggcaacgttgggaagttaccttatatggtctaaaaaggggatgcaggaataatccaccccttctttagcatatcatcaagaaataaccataaacatgggcaaccagcagccctcagggctgctctgtctatggagtagccattcttttattgctttactttcttaataaacttgctttcactttgcactgcagactcaacctaaattctttcttgcgtgagatccaagaaccctctcttggggtctggattgggacccgtttcctgtaacatatttctccgtcctgcaacatatttctggccaccatgaacgtatgatactgagaaaacccccccgacttggaggaaatggactgcggcactgattggatgacttcgggtaagtgggtggggcacccaagtaaagaatgggattgggttagaggcccaacttaggggagttagtctctcctaagacagagtgggttagaagcccctcttaataaaaggcagaatgcttgacggaccttgggttagaggcccaacttaggagggttagagtcccttctaagatgtatggggttagaggcccctctcagtaaagtccctcttggctaaaaccaggtttggcaccgcaggttatgctctttgtattaatctgcctcgtactgtttgctgacggctgtgtgtgggtgacagggttaggcatgtacaggattgtgggacatggggagctttttcctccctaaaaggggaaacttgagcactaataggattgctggaaaagatccattggctactgacaagcagccgcctgaacttttcagtgtcgctgcaatgggtgggtctttctctggcctccccaagcatttctcgccttccccaccctgccccaggcaatgcttttctctctctcctttccctttcccatctgttctgttactcagggtgaccatcttgcccagagaccacgtgttgaaactccaatttggaggctggattaaaggtgacggggtccacccatctgggggcaaatttaagccctgccagtttgacattgcatgctaagcagagtggctaatgtctatgttttatcacatgtattttgctctggccagaacgaaaacaataattttcctttatgatgcagcttggcccccagggcgatggtgccgcaagctggattactaggggcgctcagggaaagggaatccagaagcctggcacgccagcaaaagggcaagaatttcttaccagtcagatttctggcttctctctgtgcaaacagttgatgtatggaaaaaaaacaaaatcagtatttatctcctctgtaaagttttgattaatgcgaaaaagaattctaaggctagtcttaacctagtgtgtttggtgctatgaatttgtttttctgtgtcaaggggtacttcaggataaaacacaggcttagaacacctgtcagtccgcttttcaagatgacccagcagctggtcataacaaacttggctgcaggtccctgaaacaaacaaacagacaaaaaaactggatgaagtctccaccttgttttatgtccttgggagcttgacgttttaatcacgtggtgataccttttcttggtctcttccttgtcccttccagggacaggaattttagggttcatgtaatagctctaaaaaatcatactgaataaaatcatattaaataaaagtctttgcaaactcaaaattaactactctagactccttctgggaaagaaaatggagactgccccttgctgtagctcagtagctagggttttgcactttcgcagtggtggtccgggttcaatttttcatgtaggaagttatttctggtttagtatctgtgtgaccttgtctattctcttgtgcttcgcagactgtcttaaattttcctttctctaaggacatgggaggttacctgtggtaaagttcaaaagctagaaatatcagctatttggcattagaaattttaaaaggacattattaaagagtgctacggttaaaatcaatttaattaaaagcagatagattcctctcaaaatcaaaggctattttgttttgcattgttatcgacagttttgagttttgggggtatcagaaattactttacattatgagagagctttggtgtgtaataactatgtaggaaatatactttaagggatggctaatagtagttatggaaggatacttgactctttgcacacttggatcagagaagcatgctcttggccacctgaaagatgattaaacatccccaccccacactgggggacgagactcccataagggatagtctaattacaaaataggctgattggctttgggttgccttgcaatgaaatgcaggagagaagcactgcattgtcttctcccgaaatatttccctccttttggggatccaggaaccggtataaaatgacactcttaatttgggggatctgtctttgccttcagctgcttatttggccctagaaatgcatgctttcctggccctgttcctccaagggctccaccctgaagccagtaatccagttaagaaaggtggttcacacctgtaatcctagtactttgggaggcccaggcaggttgatcacgaggtcaggagttcgagatcagactggccaatatgcttaaacctgtctctactaaaaatacaaaatttagccgggcatggtggtgggtgtctgtaatcccagctactcaggaggctgaggcaggagaatcacttgaacctgggaggcggaggttgcagtgtgatgagattgccccattgcaccacagcctgggcaatagcgtgagactccatctcaaaaaaagaaggaaggaaggaaggaaggaaggaaggaaggaaggaaggaaagaaggaaggatggaagggagaaaatggcaaatgaaaaatcttacaagtgctgaatcttctgtctgtggatttatatatgttgcatgtttatagataaaagagctctaattaactggcttagaaaaataggcacttaaatattttgtcagaaaaacaggaactttaatgcctttttgttcatgtgactttagtaatcttttggaaataatgacagttctaaaaattattagtaaaataaaatgtctttaaaaatgtagacatttggtctaaattaacgtcaaatatcagatttgctaaatgctttaaggtcaaattgtttttctgacttttgaaaattgttcaatttggctgggcccagtggctcacgcctgtaatcccagcactttgggaggctgaggcaggtggatcatctgaggtcaggagttcgagaccagcctgaccaacatggtgaaaccctgtctctactaagaatacaaaaattagctgggcctggtggcaggtgcctgtaatctcagctacttgggaggctgaggcaggagaatcgcttgaacccgggaggtggaggttgtggtgagtggagattgcaccattgcatttcagcctgggtgacagagcaaggttccaactcaaaaaaaatataaataaataaataaaagaaaaaagaaaaatgttcaatttacctactttaaagtcattagcttctagataagggctgggacatgtggaattagccatactccctagctatacaaacaagattataaagaaagagattttacataagaagggatctcacatggtaaattcttgtcctaaagtaaaataactggttgtttaaaaggagggatgtttaaggcaagtcagaaagtccaagaatgactcagatggtctgtgtaagtcgtgaaaggaactgtgaaagggaatttatgcaagaaatgtacaatccaaaggttcttaggcctcctaaatccttcataaaatgccactatgactcttacttaagtaagagtaaggcctggggacatttggaattagccacactccctagctgtgctagagagtcagctcttatctgcacttttgcctggtgtgtcctaggcaggctacacactagtacacaattaaaatctcgaatttaccaaggttttcaccaaaaataaaagttgctaagagttaacattataacatgtaattaagactactgaagaaacagttttacatgcaaggtgtgtaagaaaagcaaaatgtgtttttggttaaaaaaaaaaaaagattataagaagtcatgggaatgtggttttttttctgcctaaaatgttaaaggattgttttaagtaagaaaaaaaaatttttttaaactagttgtggaaggtttataaaaattaattgtaagagattctgtgtttgaacatattggctaaagttaaaggaatattattcactaaacattggaataaaagcacaatgggtttttctgctctttcacaaaaaatgtaaagagttataaaaggtttataagaatctttccttatggttaaacattaaaattgggtaaatatgtctataaggttttatataaaaattggatttaacattaatagtacattaaaataaaggtaaaatttggcttaattgatgtaaaattcatacaggaagcattatcaaatgtaaaatggtgtttttctttctttagatatttgcataaatgtgttattggcatatgttccaaagttatggaaaacttctataattctaatataacttagtgtatgttattaataattataattgttatgtaaaattctgtgtaccacataggtaaccaaatttcctgatcaattatggctttaatggtggctgtcctcaaactttttatcatccacaggcaattgctgtcttgttttaatcccctttaaaagatggtttgtaatcaactataaaaccctggcaggtgttaaatacaagtttttctaataactttggaaattgtaatattaaaataaagaaaacaacattcaaaactctcataaaaagctaaaatgtttacaaatatcaaatacaacagaaattaacagaaccaataggaaactgaagtaatcttttcaactttgcttaaaacactgctaatcctttgttttgtttttcagagtcaaaaaaaaaacttttttaagctatttacagcttataacaattgagtaaagtatactgctgtgaaaaaaaaatggaaacatatttttctctacctaatttttccaaaatttaggaactagttgtaagtatgcttaacttatggcaatataattatttgtataagtgcaataaaaatctgttttcttttgtaacaagacacaattgaagaaactggtcattttaccaaggctttaactggaatggtgtgttttcccttaagaaattaaacttaacttgtagagccaataaaagcctcatgggaaactggcctcataccttgcctacaacagtgcctgtacagggtttctgacctgtggtaagtaaagaatgccactttctaacaggtccagaagccacaagttatcttgggacctcaagaggaaagaaatttaccaaactcataggtatttgatggtacaaacccatggataagcttggccttaaaagccttatctaaaattccttctatggaacagaattccatcaaagccaatttaaaaagaacctatgtgaaaaataattattcttgctgcactttatacaaataatcaggccaagtataataaagcaaattggtcttaccataatttgcatttagcaaaaatgggaaactggagagagaaatattttgtttcaaaaactatggtatacttgttattaaattctagtctcatcagtcattttgaagtttgtttctgcaataagcaggctaactcttcttcttccggtgaaccaaccagtgatgtctgactgttgctcagaagaaacaagagggatgggcaatgtaaaaatctggattagtattctaattctgggcacattacaatcagctagcaaccccataccagcttagttccaacagttgcccaattcatgaaaagccttctaatttagtttacttggaataactttacttattttgcttcactcttgtggaatatattgctgttatactctgtgtaggaatataaaaaaagcttactaaatgttttcttaaacacttattaatcttccagatatcacctcttgtcaaaactcaagagtcataaatggccctcaccatactgatgttttctaactgagctcctctctaccctgaacacaatagaccctaacaggcagaaatatcatcacccctattcagcctgaagaagttacagaaaatgaatcttcatacctctgcgacccttaggattaagggttctcttataaaagggaagggggaaatgtcagaggtttgtgaaccagaacaactccatcttgaataggagctgggtaaaatgagactgaaacctactgggctgcattcccagatggttaaggcattctaagtcacaggatgagacaggaggtcggcacaaagtacaggtcataaagaccttgcctataaaacagattgcagtaaagaagacggctaaatcctaccaaaaccaagatggccacaagagtgacctctggtcgtcctcactactacactcccatcagcgctaagacagcttacaaatgccatggcaacatcaggaagttaccctatgtggtctaaaaagggaaggcatgaataatccaccccttatttagcataccatcaagaaataaccataaaaatgggcagctagcagccctcagggctgctctgtctatgtactcgtaacccattcttttattccttcactttcttaataaacctgctttcactctgcactgcggacttgccctaaattctttcttgtgcgagatccaagaaccctctcttggggtctggattgggagtcctttcctgtatatctctgttctgtaacaccttgaggctcattttgtgtgtttcctttctctcaacaatcacagttctgcactgtgtaatgttcagtgtctgaaaacacctgcttcatgtttgtctaatttaatagtagttttctgtgggaatgaaagtctagtactagttacactgtcatggccaaaactgagggccttttgggtgtcttctaatacccttgattcttattggcagctgcctactctgagtaaatgcccaacaaaatacgaaacagctcagcttcatgtcttccaaccaacctcagaaaaaagataaagtctgatttaaatttcatatcaaaagcaatatttcaactatttaaagctacaataaatatacaaccatacggaaatctgtaaccaaatataaaaccctctaaactaaaacatttaacacagcagagaccaccaatgtaacactgggttaattcatttttgtgtaaaacctgtaataaagtgtaccaccacatttatgtttaatttaagagcctctttactccagaagtataaggggcccaaatcagaaaacctattgatataatttaccacattaacaaaccaggaaattatatggttatttcaataggaaaagaaacagtattcaataaaattcaatctatacacataataaaacatatattacaataagaaaagtaaaaatgaaaagcttaatgaaagatatttaatttaaaagccacagaaaacatcatatgtaacagtgaaatttaaaaatcattctcattaaagtcatgctcaacactaaggtgtcaagtgtctctgcttgtattcaacatgtcattcaccattttttttttccctgtggtatctcttgacctggtctcaaggcagccagaactccagaaacacaataagcattgataaaaagatctcgaagagaagccctctagttcaggctcaagaagaggaaaaggggtctcctgttaatacaagttgtggcagccagaacccacagcgctgggaactcaaagaaagaagagccttcctcttcagtgaaaagagctactgtccaaagggggtgaggcaagttcctgttgatttttcctctctgccccctactctctccagatacacactggttggccttggatatagacatagttccagaaagaaagtgcaaaagcaaagtaaataaaacttcaggtttttggctagaggactaaaaaaggagaatcccagtaccaagactgcagaaaaggaggagcttgggaaacaataccattaaggtgtttatgaactcctgaaatcaacctcaagtttagcattcaggttctgattcaaagcagcctacaaagacattgagaactaaactaagagaccatgacccatgtcccagattgaccaccagagggtacacatgtaggacaaatttaaataggactgcaaaggctgttaaaagtaaactaatatagagactttatcccagagaaggccactcagaatttacaatctaagcccaatcaggtcaattggctgctaaaacaaaaatgtcaatattctccacagggtatatacaagacccagtcctgtagtacacaatattgaaaatgtccagaatataataccaaattacatggcacatgaagaaccaatgaaattacaaattgcatgagaaaagacaaccaacggatgacaacagtcagatattggaactcatccaacagtaaacctttccaactgatgctaaatttgtctgacaaaggctttgataattatcccactagtaagggtaaacgtatttatttttatttttaattttttgagacagagtctggctctgttgcctaggctggagtggagtgcatgatctctgctcacagcaacctctgtcttctgggctcaagccatcctctcacttcagcctcatgagtagctgggactgtagacagataccaccatgcccagctaactttggttctatgtatgtatgtatgtatgtatgtatgtatgtatgtatgtatgtatgtatctatctatctatctatctatctagtagaaatggggtttcaccacattgcctgggttggtcttaaactcctggctcaggcaatccacttgcctaggcctcccaaagtgcacggaataaaggcatgagccacagcacctggcctaagcatctttaaaataaatcaggtaatagaaagtctcagcccaaaatagagccaaacatacataaatgtatatacaatacacaaaagaaccaaatataaaatccagaactaaaacatacaatgaataaaatgttaaaactcattaggtgtactcaatagcataattgagatgacagagtgaaaagttcactggaacttgaggatagatcaatagaaatattcaaccttaaaaactaagaaaagattgattaaaaattaatctgggctgggtgcgatggctcatgcctataatccagcactttggcaggctgaggcaggaggatcacctgagttcaggagttcgagaccagcctggccaacatggtgaaacactgtctctactaaaaatacaaaaattagctgggtgtggtggtgggcacctgtaatcccagctactcaggaggctgaggaatgagaatcgcttgaacctggaaggcagaggttgcagtgagctgagattgtgccactgcattccagcctggacaacagagcaagactctgtctcaaaacaaaacaaaacaaattaatctgtgggataaaatagaaatgcctagcatttgtttcatctgagtcgtagaaagaaataataaagactgcagtggagacataatatttaaagaaataatgtatagaaactcttcaagtttgggggaaaaaataaacctacagattcaagaagctcagaaaattgcaaacagcgaaaacacaaataaatcaatgcaaagacatattacaatcaaactttgaaaataaagacaaagaaaaaatcttaaaagcagccagacaaaaaaagatgcattgcttaaaaaaggaaaacagtacacaagacagtggatttctcatcaaaaatttctgataccaaaataataataataaaaaaatttcaaccaagaattctaggtccaagaaaaatactcttcagaaatgtacatcaaaaccacaataagataccacttcacatctactaggatggctataataaaaaagagacaataacaaatgtttgcgagcaggtgaagaaattgaaacccttacacattgctcataggaatataaaatgatgcagctgctttggaaaacagtttggcagctcctaaaaaaattaaatatagagttccatatgccccaacaattctacttctaggtatagacccaagataattgaaaacacatatttacacaaaaacttatacatgaatattcatagcagcactattcataatagccaaaagatacaaacactccaactatcaatcaattgatgagtagataaatataatatgttatatccatacaatgaaatgctattctgctgtaaaaaatacttaagttctgatacatgctaatatggataaaactcaaagaaattgtgcaaagtgaaagaagccagaaagaaaccgccacatattctatgatttcagttgtaggcaatgtccagaatagacagattcatagagacagaaagattattgatggctaggggctaggtagaaaagaagaatgaactgctaatgtatacagggattttacgggtggtggtggtgatataaaggttctagctttaggtaatggtgatagttgcacaactttgagaatatgcaaaaaaaaaaaaataaaaaacaaattgtgtactttaaaaaggtacattttatggtatgtgaagtatgtttccaaaaaaaaggagaataaagaagttctcatttaaagtaaaaccaagagaattcattgtcagtggacctgctctaagagaattgctaaagtagtcactagacacaaaggaaatggtaccagaaagaaacttcagagcagaaattttaaaaaagcaaaagaaatttaaaatatacgaaaaaattgagtaaactattcttctgttgaattctttaaaatatgttatgtttcaaagtaaaacaatatttttaaatgaaatttcaaagtatgtagatgcaatacgtaataaacatataggccgggcgcggtggctcacgcctgtaatcccagcactttgggaggccgaggtgggcggatcatgaggtcaggagatcgagaccatcctggctaacacggtgaaaccccatctctactgaaaatacaaaaaattagccgggcgtggtggtgggcacctgtagtcccagctactcgggaggctgaggcaggagaatggcgtgaacccgggaggtggagcttgcagcgagccgagatggcaccgctgcactccagcctgggtgacagagtgagactccgtttcaaaaaaaaaaaaaaaaatcatataagaaattacaacataaagggggaagaaggaacctatagagaggtaagatttcaaaacacatgatacagtaaaatactgattctgtgtagatagtgaacatttaaatgaaaatattgtaattactagggctaccactttttttaatttaaaaaaagtacgtacacaatgagatgtattcaaaaacacaagatatagaattgaattaaaaattattaaataagccgggcacagtggctcgcacctgtaatcccagcactttggaaggcagaggcgggctgaggtcaagaactcaagaccagcctggccaacatggtgaaaccccgtctctactaaaaatacaaaaattagctgggcgtgttggcgcccacctgtagtgccagctactcaggaagctgaggcaggagaatcgcttgagccagggagacggaggttgcagtgagccaagattgcaccactgcactccagcctggccgacagagcaagactctgtctaaaaaaaaaaaaaaaaattattaaataacccaaaagaaggcaggaatgggaacacacagggatgataaacagaggaacaaggagatacaaagaataaaatgatagaactacattcaaacacatcaacaattacattacaggtaaatgatctaaatgcaccaaataaagagattgtcagaacaagtttttaaaaatacataatccaattatatactctctataaaaattctgcttcaagcataaagatatcagtacattaaaattaggagaaaagatacaaaatgcaaacactaaccaaaagaaagctcaagtggttatattaatatcagacaaagtagacttcagagcaaacaaatttagcaggatatcatacaataataaaagagttcatttataagaattacataaaaaccctaaatgtatatggaagctaaaaacaaaccttcaaaatataaaaactgaaaattaatttttggacaaattggactacatcaaaattaaaaactttaactctgaaacaacactgctaagagagtaaaaagaaaggctacagattgggagaaaatatgcgcaaatcacatatccaacataagacttgcattcagaatctaaaaggaaattttttaattcaacaataagtaagcaaacaaccaaattaaaaaatgggcaaaagaggtgaacagacactttaccaaacagtatttaaggagagcaaatgagcacatgaaaagatatttaacatcgttagtcattatgaaaatgcaaattaaaaccttgttgaaatgcaattacacacataaataaaaataacgacaatgtcaagtgagagtgaccatgcagaacagttggaactgcaaacattgctgtgggaatgcaaaatggttcagccactctgggaaacagcaagtttcttataaagtgaaacacacacttaccatatgacagaacgtcaattctactcctgagtacttagagaaatataaatttatgttcattctaaaactggtacaggaatgttgatagaggctctgtttataattgcccactggaaacaacccagatgttcttcaagggatgaatggttacataaatgagccaaagatggcctctgtgttttggcccctatgtttattgtaggttgagaccagttagctcaaaatcctgcccaaaccaaactcaaatttgtacataccgagttatttataaaattgcctgaacaagcaaatttttagctatttagagctttcctgctttgcatactccaagaaacctcacccaacagctgttacctactgataaatagggccttgcagttataaaacccaaaattcctgctgcctttggtttgcctgacccaagacttcctgctgtgctgctgtgagacacccttgagatacatacataagccccatattcaaccctccctccagagttctcttgccttattccctttctcattggtggtctcattagactgtctcatgcaaccctgtcttactgccactcaataaagttgtgtgttactgcctctcattgtcatatgtttttcctagctcagtccccaaatccctaaaacccttaggtgaatacataagcaaactttagtacatccacacaatgaaacactacttagcactaaaaagcaacaaactattgatacacgtagcaatctgaatgctcagtaaatgaggccagaatcaaagttgatactacagatttcatttatataacagtttccaaaagactacagtgatagaaaacagataactgattgtcagggattcggaatggaggtgagtgtgacttacaatggaacagaatcaggaaagttttggggatgatagaactattctgaattctgactatggtggtgtttacacatgtgttaatatgcatgtatctgtataccaatataccaaaagggccaatcatgcatattaacaacatacatatgttaatataacagttaatataacagtatatatataacagtattactataacagttaatataacagtaacaacatacgtgtgttaatatgcatgcatctgtataccaataccaaaagggccaattctactgtatgctaattttgttttgttttttttttgagatagagtctctctctgtcgcccaggctgggaatttataaaattgactgattaaaccagaaagaataacattgtattatatcatttattatgtggatagataacaaaatatatacaatgatagcataaaggactgtaagaggagagtagttttactgttagaagtttcttgcattgtataagtagtggcacagtatgtactctaagtagactatggtaagtatatgtgtatataaatacttagaaaaatctctaaaatatacaatgaagttaagctaaatatcagtggataaattaaaatgaaacactaaaaatatctgattaatccatgtgacggcaagaaaggaagaacaaaggaaaaaaatagttgggatgactaaaaaaacaaatagcaatatgatagatatacttaaacccagccataccaataattacattaaatgtaaatgtactaaacattcctattaagatgcagtaatagtcacactagatattaaaagcaatatccaaccatatgctacctataagaggcatactttatatataaaactgcagattgtttgagagtactaagatgcaaataaatattccacacaaagagcaagcctaagaaaaacaactatttgtttgaataacattattagccaattttactgggttaacaataaacattgcatccatacactataaatatgtaacttgtttatgtgcacatgaaacatatattttagatacaatatgctgggacacaaaataagtctcaatgtttttaaaggattgagatcttacatagtaggttctctgaccacaacagaattaaattagaaatcaataaaaataacatgcctggaattatgcaaaatatttagaaattaaacaactactacctaatgcataggtcaaaaaaaaaatctcaaaggaaattgtcaagaaccatgaagggtctgagttcgtattctgtttgcaagctaacaagtttgcctgccacaatttcacagatggtggcagaggacacaaaactcctgagtcagaggtaaagaaattaattgtccatagcacagcaagcagcatgagtttcgtatttacccaagtccctcttacccctccagtcccagtgagagatgtggagctgcccagataaatgctatacacacagtagttttgtatcacatttaaagaaccctaagctaggaaattcagtaggcaaatctgtccaacattttctccagagggagatattatctttattacgttaggcagcaaacaagtcttctctctactccagagaagtgctgtctctattttctaatgatatttgttattcaacctccttgaaatgtagcctaaaactaaagttgccagtgccaatatgtgtaagacaaagaagaattctgtctaaatggaaataataaaatattttgaactgaatgctaaaaaattaggcatataaaaatctgtgagatgcaggtaaagcagttttttgaggaaaatgtatagctttaaatgtttaaaagcaaagtagacttaaaaacaattatctaagcttccactttaaaaagctagagaaagaaaagcaaagtatgcccaaaataagtagaacacttttttaatattttacctgaagtgatatacatttagaaaaaaatagtacgttgaaggacgaaaataataaaaatatggcaaaaatcaataaatagaaaacaagcagtaaagtcaataaaactaagagctggatcttttcaaagatgaataaaattgataaacccaagtgaaacaaataaagaaaaagagagagaaaacacaaataccaacattgtcagtgaaagaaggggatatcattaacacaacttaccaaaactaaaacaaaagagataaaaaatctaatagcccaatatctattaaagaagcagaatacattatcaaaataacttatcataaagaaaactccaggctcacattgttttattaatgaaatctatcaagcatttaaagaagaaatagtgctaatcttacccaaacactttgaaaaatagtaaaggagggaatatgttatatggaccagcataagttttgacataaaacttgacaaggtaattacaaaacaaaacaaaacaaaacaaaacaaaacaaaacaaaacaacaaaaactacagaccaatggtctctcatgactatagttaaaaaagtcttttttttcttttaaacaacaaagaagcctatttattgagggggaaaaaagagacagataggttatagatgttgttatacattatatcttataatttacattttgctttcataggtcacagaaagatgtataaaaacaccaaaagcaatggcaacaaaagccaaaattgacaaatgggatctaattaaactaaagagcttctgcacagcaaaagaaactaccatcagagtgaacaggcaacttacagaatgggagaacatttttgcaatctactcatctgacaaagggctaatatccagaatctacaatgaactcaaacaaatttacaagaaaaaaacaaacaaccccatcaaaaagtgggcgaaggatatgaacagacacttctcaaaagaagacatttatgcagccaaaaaacacaagaacaaatgctcatcatcactggccatcagagaaatgcaaatcaaaaccacaatgagataccaccatctcacaccagttagaatggcgatcattaaaaagtcaggaaacaacaggtgctggagaggatgtggagaaataggaacacttttacactgttggtgggactgtaaactagttcagccattgtggaagtcagtgtggcgattcctcagggatctagaactagaaataccatttgacccagccatcccattactgggtatatacccaaaggattataaatcatgctgctataaagacacatgcacacgtatgtttatacaggcactattcacaatagcaaagacttggaaccaacttaaatgtccaacaacgatagactggattaagaaaatgtggcacatatacaccatggaatactatgcagccataaaaatgatgagttcatgtcctttgtagggacatggatgaaactggaaatcgtcattctcaggaaactatcgcaaggacaaaaaaccaaacgccgtgtgttctcactcataggtgggaattgaacaatgagaacacatggacacaagaaggggaacatcacacactggggactgttgtggggtggggggaggggggagggatagcattaggagatatacctaatgctaaatgaccagttaatgggtgcagtacaccaacatggcacatgtatacatatgtaacaaacctgcacgttgtgcacatgtaccctaaaacttaaagtataataataataataacaaaaagagtaatctatagagcaatgaacattacagattgtgtgctgaatcaggaaagagtttgctttggactatagttaaaaaagtcttaagcaaaatattagaaaataaaatctagtgatattttaaaaagtataatgaccaactatgattactccagaaatacaagattggtttaacatttaaaaatcaaccaatgtcaaaattcaacacatttttaaaaagctttcagaaaactgggactagaatgcaactttcttaaccttataaagagtatctgagaaaaacctacagctaagtcatttttaaaggtgaaacattaaatactgcccctttaagaataaaaaagtcaagatatccactctcattattcttattcaacattgtcttgaaaatcctatctacttcagtaaggcaaataaataaaacaaaaatgcataaaaattgaaaagaacaaagtaaaactgtttttattcatagacttgattgtttccatagaaaatttaaataatctacacaaatatttagcatgatcacatgatacaaggtcgatataaaaaatgtatttctgtgtactagcagcaaacaattaaacatttcatttataaaatttataaaatgaacacttcatttataaaaatttcatttataataacatcataaaatataaatatatgagagtaaatttaacaaaagacatgcaagaccactgaaaacggaaaacattgatgagagaaagtaagaaaaatttaaagagatatgaaatagtcattgattagaagactcaatattttattttttttatttttttgagatggagtcttgctctgttgctcaggttggagtgcagtggcatgatctccactcactgcaacctccgcctcccaggttcaagcaattctcctgcctcagcctctggagtagctaggattacaggtgcgcaccaccatgctgggctaatttttctatttttagtagagatggtgtttcaccatgttggccagattggtctcaaactcccgacctcaggtgatccgtctgcatcggcctcccaaagtgctgggattacaggcttgagccaccacgcccagccagaagactcaatattatgaatatgtcagtttcctataaattgatctatatagttcatacaatacaaatcagaatttcaataagaactttaatagaaattacaagttaggcctaaaatttatatcgaaataaaaataaccgacaatcatcagaacaacttttaatgaggaggaaaaaattggagaagtctcactaactgatttcaacatttaccataaaacatatagtaaataagacaatgtgatactggcataagaatagacaaatagataacagaaaagaggagggaatccagaaggagttctacacatgtttgattcattcggttttcaacaagctgccaaggtaattcaataggcagggagttgatggcagccctccttggagaccaccgaccacagctcttctgcagtgagcagagtgggagacaccctggtcttggaggccagtgcacaagcccctggggctgcttccacttgagaagaggagaccagttctaggccttagggagaaaagctctctctgccttgcctacttctctgccttgcttttctctgaaacagtatgtctccatctttgagtggttactgggcctgagtccataaagagggaaaagacaggctcaggctacatttggtaatagaagccctcccagcagtcctgcctcgatcaccagaggatgactttcgggttggggcctaatgctactacagaactcacatttggtgtatcttccaagctcccaagaacccaaagcttccaagaacacaaagcaggggctgtgctggagcagggttctagcattaggaggtcctaggtctcagctagatgctactaggacctcaacatatctgggcttctgaaaatggatgtgtttgcagggaccgtttctgttctgcaaggtggtttgatggggtgagatggaatatggctgcactgcgttggcaggggaaagcaaagggaagcctggctttcctcctcctgacccagagcaaaggctaggggctgggccacctcaaacactgtgtgcatagcagcctccctggatctcagctaggggtattctgcaccccccaggggactctggcaatgtgcacagatcgttctaattgttacaaccgggagaatgctactgcatctagtggataggggccagggacactgcttaacatcctctagtacacagcatggttcctcacaacaaagaattgttcagttcaaaatgccagtagtgctgaggtggaaatgtgccctgaataaccttcaatttccccttttggaaaatgtgatacatgtatgcgacagaatactagtcagacataaaaaagaatgaaataatatcttttgcagctacttggatggaaatgggggttattatcctgagtaactcaggaatacaaaaccaaaccaaatcctgcatgtcctcacttataagcgggagctaagctatgggtacacaaaggcagatgggtatgatggacatgggagactcagaagggggagggtgggagaggtcagagataaaaactacctatggggtatgctacattatttgggtgacagtgcactaaaagaacacactttactgctatacaatttatccatgtaaccataaaacacctgtacccctaaaagctattgaaataaaatttaaaaaagaaaaatgttttaaaaattccccttttgcccttacatagctacagggaagctacttagaagcggaggaaaggaccctacattagaagtgtgtttacacgtttagctaaatgaccaggaaggctcatgaaggcagcctgattactacttcatctcaatgcaaggctcttttgcttgtttccattttactattccctcggtctttgaacgttgtttctgctctcccatgacaggcagcacacgattgcagtaggttttcatctttgtttattaccatttcccctacaccctcaccgatttccctcccctattaaaagatctggttctctatgagaagcacaagccaggctagggctgcattaataattgattttctacttctctctcagcaagctatggtgtttgactttgaggagtggctttttataaagccacagtgtccttccagcacaattttgagttgcaatgatctttggtaggtgatttcttttttctcttattgtttagctattagcagagtaataatgatcataacattttcatcctttcagatctcgtacaggggatgacacctgtgaaagggccttgagcttctctgatgacatctttgtaatttttttgagctccaccacagcagctccagctgctcattaacccgccactggtaatgaggtttcactgatgcctctggggagtctgatttgtcagggggcagcaaactgtggcctggacgacatgagctacgccccgtccttcccctgatgtgacaatgctgacattttcatggctgagatggcttgcggctctctccccaagcctgcactggattcttgtcactcacctgcatcattccaaaccatgccccatgcccagcactgattaaacacattaggctacattcattcctgagaataccatacagacattagatatgacaaagcatatctacactagtaaggcagtaaaataaccaaggtctatgaagtgcaacagaaaattgcctaacaacatgcacagatgatctcactgaaccatattacctaccattcatatattaccacaggcacagagagcacctggagaaacacagtagcaactgctcacagtgactaccccggggttgggaaggaaggggggaaagttacaaggaactttcctcttctgggttttgtggggtttttttgttttttgctttttttttttttttttgagatggaggttttctttgagatggtgcaacctcggctcactgcaacctctgcttcctgggttcaagtgattcttctccctcagcctcccaagtagctgggattacaggcgcccaccaccatgcccagctaattttctgtatttttagtacagacggcgttttaccatgttggccaggctggtcttgaactcctgacctcagttgatccacccgcgtgagcctcccaaagtgctgggatgacaggcgggaaccactgcacccggccttctactgggttttgtaatgagcatgtttgtggtggaaatgtgtcaactgcctgtccagagacagttgtggtggctcacgcctgtaatcccagtaacttgggagggtgaggtgagagatcgtttgagctcaggagtttgagaccagcctgagcaatgtagtaagacactgtctctacagctaaaagaataaatgagtacataaataaagaaataagctgaattctgaggaggcttttactctccataagaccacctgaagtcaaccctagccctcaagctgttcagctacagcagccaatactttctgttccctgaatccactttggctgggatttctttcattggtggtcactggtttcactaggattccttatatcctgtttctttgttccaggctcagaacaaggagcacctcctcctggaagcttttccccaaggatcactcctaacgactatgcctatgcccctcaatttggccccacaagatgagcggcttcatgttagcctcagtttcattcacacagatatggtttgtctggaagaaaccaaatctttaaggataagaggtaataattagcataacagagaacatctattagaagcttcctaagggtcaagcaatgaactaaatgttttacatggataattttatttcatttttataacatccttaggaggtagatatcattagtttccttgtctgtaaataagatagtaagtccgagagatggtaaatggcacaattaccttttttatcgtgctgctcagcaatgaccattcctttcagaaggaccaccatgcccctcctctgtaagctgttgctggaactgactgccccacaagtttagaggcagagcttacaaccctagcctggccaatcaatgacccccttcccccagtgacatatgattggctcaggtggacatagaattgaagtcagtccattcagagtggatctcagaacattgctagaaaggctagatttgtgcccagaagtaaatgctgcaaaaaaaaaaaaaaatgctaatggccattttgcattttgcatgacaaatgtcaggaattggacagttctttaagaagcaaagtcatcaaatggagagagattccattctgtcataccatttgagccatggatcaagctatatcttaaaccacatctagccctaaactgttcagttgcctgagaccctctgataggcaccagcccccttggaggcctttcttttatttgaccttttgtggatggaagctgggatgggggtgggcaggagcccagtgactatgtaagcacaggactggctatagaaatggaatgaaatagccctaaaggattctttatgaagattatggaagagaagtatataaaagaattaggaagcagaacaacaaaaccgtaaacaaagatagaaatacagctgggcgcggtggctcacacctgtaatcccaacactttgggaggccgaggcgggcggatcatgaggtcaggagatcgagacaagcctggccaacatggtgaaaccccgtctctactaaaatacaaaaataaaataaaataaaatcaaaataagccaggcgtggtggcgccacctgtagtctcagctactcaggaggctgaggcaggggaatcacttgaacccgggaggtggaggctgcagtgagctgagatcgtgccactgcactccagcctggcaacagagcgagatcagtctaaaaaaaaaaaagatagaaaaacaatcctccccatggaccttaaacacaggccacatgctcatgcttcacacacatgactgtgtgcacacacatatcacacagttctcactctatccctcctccctcccttctcccctctctttgtttgaaagtacccaaaggccttctaaccatttccttcatttcacacgcagatgattttataatctcatctaaaaactgttgatatgaaacataacaacagaaatacaaacagtgaatcttgatgaggtgaaaacaaggtgagaacaataaaatagccaaactggagaagactttgattccagcacaaacccttgatgcagaagatcttacagccttcagttaaataacctgtgtggttctgaggacacagagtaccatgaggacgtggacaatgatctagccagtctgtgaagggctcagctgtcacccacccagagacgccattaagagacctgctttcaggcggctgcagggagctctggactgggctccagcctgtgccccaacaggctttagccacgcaaacttaaacacaccttagagcgtgtctacaaaggaaacctgaggtgactgttcatataattctctcctggaagatgaacacgctccaagcacactgacctgaatcacccccaggcccctttcacctcattaggccttgaaggaaactgcaatcctcagctgctcccacctcacagaagcctgttacagggactggtacaaaaacagagaagcggcttggtccggagagctcctctgcacagggctgataaagggaatccaggaggccacacatgacctttcccccaggtcctgcaacaagaatagtttttgaatctgatcgttgcagccaaagtcaggacacagcagaacagcatccctcccttcccactccctggctttgctatgagctacaatatcgcacctttccaaagaaaaggatattggtcatccaggggaagaaaaatggaaatctcaaggaaagtatttctccagaattatcatttcctctctatctagtaagcatcttctgtcctgcacgcacgtgtaccagcggccacgctcttctcctcaacacatattctcttggcttctgggccctgtgctcttccttccagctctctggtcaggctttctcagtccatccctggctcctcttcccctccctgaccctcacacctgctgtggtcagggcctcgttctgagccttcctctcacggcacacaccctcctccattgccctccaagtcatctccttctataaggcctctcttctaagcttattatgttcaaataagtggtctccctcagcactggcatgtcgtgggaaaaccactgggctggaactcaaaagacgtgcatgtgagcccagatcccctgatatacactgtgaaacccagagaaaactcacctgccctgtgatgatccaaactgtcttctgtaaactgatgccaggccacaggattgtgtgaggatagtgacatcacatggctgggtccttcgtaaaagaaaaaggccagccctgtgggggctactctttgcggtgccaggtagtgggccagcagcccctgatgagggaggtcagctgcggccctgtcctgggcaggggacattctgtgaaccaagtgttacaagttaccgtcactactgaaagactccccaccctcctcttccaaataattctgaaaacattttgaaacaaatgattttggaagataaaatatttatgcaaagaagatattttaaaacccctttcaggccaattttctaaaatatttctcacgggaaaaaatgccttttgagaaagtttcaggcaagatagagcttggacataggctgtctgtgctagaaggttcttcatagaaaccctgtgagctgcagaagtctcgatgttaaacaaataattttccagaaaaccccataacgttaaatgggttaatgtgagcactaaaggtatgccagggtccctggacccctcctgcttgcccacttcctcactcctttagttctgggaatccctggggaattcttggtttgggcaaatgaagtttgcaaacattgctctaacttactctctcctttgttgagttaagaaaggagagacgaccagccaggaactgtggctcacgcctgtaatcccagcactttgggaggccaaggtgggaggatcacgaggtcaggaccagcctgaccaatatgatgaaaccccatctctgctaaaaatacaaaaattagctgggtgtggtggcgtgtgcctgtagtcccagctacacgggaggctgaggcagaagaatcgcttgaacccaggaggcgaagtttgcagtgagcagggatcgtgccactgcactccagcctgggtgacagagtgagactctgtctcaaaaaaaaaaaaaaaaaaaaaaaagaaagaaaggagagacgagaaggaaggtgtgtccgtggccatatcgacagtggctcagaacagatcagctgcatcctgggccaccaagctcacatgctacctgctggggcagctgtaggacctctagcatgacagtcacctatggacttctggcaggagtgatgcccatctgtgaccccaaatgcttctcagtcctcaagggacagtgtttgtttaatggcacaggacactcatggatagagggcagaacccaagatttttgctcagaagcaacagaaagagaggctagagatttatatggaagatgaggaccaactaaaacaacaggaaccccaaagaaccagactcagaaaaaggccacagccttgtcagggtgccagagatgcagggaatgacctccaactccttcttctatcctctaatgacccctactcaaatgcaaagttcttgagtcataagttcgtctctatgcagagagaaaaccttgactgaccatcccaccaagaaggaaacctttaaatgtattatggagttgatgtatttttcttttcttttttttttttttttttttgagttggagtcttactctgtcacctaggctggagtgtggtggcatgatctcggctcactgcgacctgcaacctccacctcccaggttcaagtgacttgactgtctcagcctcctgagtggctgggactacaggtgtgcaccaccacgccccactaatttttatattttctagtagagatggggtgtcaccatgttggccaggctggtctcaaactcctgacctcaactgatctgcctgccttggcctcccaaagtgctggaattaagatgtgagccactgcacctggccattatttttcacacttacatattaaaaagtgcaatggggctaggaatggaggctcacaactgtattctctgcactttgggaggccaaggtgggaaggtcacttgagctcaggagttcgaatccaggctaagcaacaaaaggagaccacgtctctacaagaaaaaaaaaaaatcagctagatgtggtagcatgtgcctgcaatcccagttacttttgcctcctttatcagaatgtttcaggcaaacatgcacttggccatcggaaatattccaataattttctggtagttaactttcttaaatttcttaacagccaggaaacttctttactttattctaataattttcccgttgctacaacctgatagttaaggaagttcaaataccttctggaatctaggaatccatttttgcctcagtagatgtaatgactgcatgaaactgttggcgaatgacattctctgagtgtggactccacgtcaatgctgttccaggtgctttgcccatgttgactccatgaatccactcaacatgctggtttcttatcctcattttgcagatgagggaactgaggcacagagtgtaagtcacttgcccacagtcccagaggatgtaaatggcagaggcaggattcaagcctgacagtcttggctctggagccttcgtgcttagccactctttatccccaaatcgctgtcaaccaaggtgagcagcgaccaaaatttgacaagcctgaaaccactgcttgttgcccccgacctaggaccagctagaccacagttactgctgctctgaagacaacactgtcacttcacacctgctcagggcccttcttggcactgatgaataaacccagcctggggtccgagaaatgggcagtgcagctctgaagacacgcccgaagttctctgtcccgagggaggacctggagccgctgtcccagaagcgtgttcctgatggaaggcactcataggctctctgcaggggagacctgccagttctgtttttattgattttcactttgcaaaaaagcctcttaaatcaaatcaaactcactaggaaatgtgggaggttgcaggcgcactgccctttgtttgtctctagtgctttaaaggtgtgtcctttcttctaagtggctcaggaggccaaaagctgtcctgaaagcatacctcaacttcctgccttcacctctgtcaaccttaaggcaattcttgatgcatttgatgttgttgtttcctgccagccacaagtccatgaactcctaggactctaagacaaacagtgctgctgctgcatttctttccttggctgtctgccctctctgctgcagtctaacctgagggggaaagggatttgtggttccaaagacagggtccaactgaaggaaaaggcatcccaagcagaggggtcagcatggtcgcctgagatgcatgcctgggttcctggccctctccttggcatcctaagcagaggggtcagcatggtcacctaagatgcgtgcccaggttcctggccctctcctcggcatggtcgcctgagatgcatgcccgggttcctggccctctcctcggcatcctaagcagaggggtcagcatggtcgcctaagatgcgtgcccagattcctggccctctccttggcatggtcgcctgagatgtgtgcccgggtccctggccctctcctcggcgtcccaagcagaggggtcagcatggtcgcctgagatgtgtgcccgggtccctggccctctcctcggcgtcccaagcagaggggtcagcatggtcgcctgagatgtgtgcccgggttcctggccctctccccggtgtcctttagtgctgaaatgtcacttactcagaaaggtcttttctagatttccactgtaagccaaaaataaaattctgagcccctcaaatgaccgaatgtatctcccttttgaccaagggaatcccagagaaatctggaaaactagtccaggccatgatggaaaaagggcatcagacatgcctagctttggagtttaggtataaccgacaagcatgaacactgaaacagagatattaagactgacaaaatagactgcagcaataagacactgaattccgacctgactgtggcagagcatcgcatgacagataacagatatcaaagtttcttacccccaaaaatgtttctctgacatagtctgaaatgttcctgaaaagctgtctcttgtgggggaaatttgcattctgtagagaatctccttcccttagtaggttttttttttttttggagagtctgacacctttttttttttagacagtgtctcactcttgttgcccaggctggagtgcaatggcacaatctctgctcactgcaacctctgcctcctgggttcaagtgattctcctgcctcagtcttccaagtagcttcaattacaggtgcccgccaccacgtccagctaattttttatatttttagtagagacggggtttcatcatgttggccaggctggtctcaaactcctacctcaggtgatccagccgcctcagcctcccaaactgctgggattacaggcgtgagccaccgtgcccggcccaagtctgatatcttttaatgtccaataagagaaatttaccatctattctctgtgatggctgctacctggaggcttaatccacatgacaagaacctgggctttcacaacccccttatttatatttgagcatttatttctgctgacctcaaactcttcaggcaaggcttaattctttcaaccaattgccaaccaggaatctttgactccacctatgacctggaagcccctggcttccaaaagtccacctttccaggccaaacaatgtgtatcttccatgtattgacttatgtctttgcctgtaacttctatctccctaaaacgtataaaaccaagctgtaacacagccatcttgtgcacatgttctcaggacctcctgaggctgtgtccaaagcccctgggccttaaccttttggtaaaataaacctctaaattgattgagacctgtctcagttactttctggttttcacactcaaaaaatgccgtatctttatgatcttaaggtaagtaaaaatatttaaacagggcacacacatgaaacatataagacaaactcgacaaactggtctatattaaaaataagaacttctgtttatcgaaagagatcattaggagagtgcaaacagcaagcatgagagcagagtgtatactcattatacacatggcaacaaaggcctcagggccagaatgtgtcaaccagaaataataacatcctccccatgtacctcaaattccatgatgaatgtggacagattttgaaacctacaaaatgcttcatcagtataaggaatgacatgcttggtcttcttggtgggtcactgcaacagtcccagatggagccgaggcagtctctccctttcgcatggcaaaaccagggatcgccaccctcccacctatgcccattacctacaagatgccacccagggtccttggcatgtcttttacagaccttcatcctttagtccttgctgtcatctctccccttatcctcaccattggccccatccatgctgagctccagcccccctgagttgctttgccccgattacaccacactcattaacatccctgggccttccgcaagctctttcctcttcccaagatactctttcctccctgcactggcaagccaccacactcagctgaggatttcaggggttcaacaccacagctgctttgtggcctgctttagagaaccatacagacagggactgtataccaaacacgtcagccccactccttggtcttgggaatggatacaaagaaagcagagatgccaccgaaagaaaggaaaaaaaaaataaaaaaagcctggcagggaagttccagatgatgttgtgtgagagggtggtctctcagaataatcccagcagacgcacatgcacttcctgcctttcctatgagacttccctgtgagactgtgacacagccccgaatcctggctttggcagctgacagacatgggtccaagtccaagctctgccagttactagataaatgaccttgagcaaattactccagctccctcagtttccccatcgatcacttggggtaacaaagccaaccctgccactacagacatcagactaagccactcttgtggtttgaagatggtgaggggaatctgttggattctagttgagcacgctgatgactcatcagttcaaatatcacgtggctttcctatttcccgtgtcagttgcagggcctctaaaatggctgtgacttccatcatatgccccattcgtggctgtccccaggcactggaaacaccctaccttcatctgctgtgccaggcatgccggcctcccccaggcttttcagagactctgaagatttcccaggcatgaacaccttgcacatcccagacacagcccattgcttgcagcagatgtagcatcaaacaccctttgtgattctgaggatcataaaaaacattacccaaaaagtttccttttaaataccaatggttttctctgccatgccacccagatttcaaccgtatgcagcttcatgctaagagcttcactgaaagtaaatgaaagggacagctttagagttggctgaagactgtttgtttgaagggagactgtataagctggtataatgtttaattctggatgtctggtggagagatctcttagtagctatgggaagaaaaaatagataggtatttaagggttttgaacttgggaacagagtggagataaacgggcaaatgtgctttggataagtccaaagtgacatgtttgaatacacacacacacacacacaaacacacacacacacacaaagttatactgaagattatagctgaagattcctaaacaagtctaaagcaagcctttcttaaagaagtgtacagttgggatatataactgctataacaaaactcaagatttcaacagcttaacacaataaaaaatggtatccctcctcagatcacagtggttgagccactctcctggacagccctcctccatgtgatgacacaagtgcccaagttccttctgtcttgcagttctgccttgcttggaccttccacatctaccccatgaacccactggaaagggaaggcaaatgagagtttgggaggttccatatgcagggcctacgggagcccatgacacttctgcccacatttcacagaccccatctcacggcagcagtcagacatgagtcccctgtgtacctgggcttggtgaacacataaccgtctccgtcactagaatcactagaagcattcaagctaccaaaaatatttcccttatcatttgatgtctaaccttcactgaccttttaacaaacctgttgaacatctgccctgggccaagcatgttagggcaggagaccagagaaacacatgtgcatgtgagaaggggcggcacaggagtttggggcccaggctctgaagttggaatccacaggctcaaattctgcctccatccctttttaagcaaaataataccatgggcaatcaatctaatctctctgtgtctctattttctcatgggtttagtggagacaatagtgtttatatcacagatgatggtgagaaccaaacaggaaaatacaaacagggtgtaagccctgcccagaactccacagtcctacctcctcctcctgagaccaagggatccccgcaggtggtgaggggtttgcatgtttgttttacctttaaaggtggggaagaaaagcttcctccaggatgctgggctatcctagagacagctgggccaggccctcctaaggccagcatgcaaaggccacagtgaggggccctgtgtaagtcacatatatccaactggttaccagttaccaaccagttattatacccccaatccacaggcttagaagccctgctaccattacctggagaagactgccctaccctgctcctctccacatgggtgtcagccaggatgccctggccctgcctctcctacagcttctctccccatgccagaagcaggcagcctgtaaatgttaaggctcatcttaggatagagctgcccaggtgggcaaccggcaggacaggctttcccctcaaggacgaagacagcctgggaggaaggaatggcagccattctcctgcctgcctggcccaggaagccctgtggtaggaacccacatagacaaactgagttctcctgtggtttttctctgtccatcagggaaaatgccattttagttattgttgttatccacgctattagcataggaaaaggataacatttttaacaataacaaccacatgtaaagcactttataattttcaaatgatttatgccagcatagcggcttcattccttgaagcaagatgtaacaggctgggaatttatgcaccagacattttaagtttcctcagcagaggtgtcagtgacttgcccaggggccctggacagaactgcaaataagggctgctgactcttctgaccaagggcggaatcagggccagaagggatatttggcctcagtatggactacttcatcagacaaattttttctggtccttatatcctttccactctcagcacagctgtccctcaagatcacagataaaaggcactgtcaacgcactattagacaccaggggagaagtcagtgcaagaaggtcaggaatgaggctctggggtcaaagtaaatcaggccaaaggacaatagacattgaacctaccaccctacccgcttcccatcccaaacggataatgagaaagttgaattaggataaccctgggttcctgattccagccaaacctcgatcccttaactcagccaagtgctacactgagtgccagggacaggggcataagaggactgggggaggcctcagccctgcccccagggaacttgcagtctagcaccgactttctattcctgtgtctatcatcaacgttcctccccaaatttccacaaacatccaatcaaaatgtgctaagctgtaaaaccttaagtagaaatttgctcctaatagagtctggaaattttgatattgccctcagcgcagtcaggcaggaaataggaggctacatggagatggaaggtggcttgtgcgagttaactaaggagccgacttggcgcttctgattttctgcagggacaaaacatcaggtatcagggacctttagatacacatgagagaaaccctaccccaaggtgggccttgctgcctcctacaacggaggagcctggaggcatgccggcttcaggcacagtgggatggaagagcatgtgtgtgtttcagggaagcctcctctgtctctcctccccattggctcccctctgaagcagaccctcctcagtggtggcagcaactccagggcacccaacctgtgctgttccagcaaagtagaaaaaaaacaagagtttctctcctagaattcccagcaaaacctggtggcatcttattggtcataactgggtcatgtgctaactccagaatcaatcaaggagggcaagggagtgggatgtgaggactgcctcacacccaccagccaggctcccacttcccagaacctgagaaggggtcacatgatccagacacaaggaacagtgtggtctcccagggacctcagaggtgcctgagcagaggccacatgtcagatatgtggtgcttacccaaggggcagggtcttcacccattctaatgtgtaatcctctgagtgcaaggactctctgaaagtcttggcacacatccaaaacctttcagggttgttgtaaagaaccattacagctgcaggcagcaaaacccctgaaagagggcacatggcaggttggcagctcccctcctattcctctccagagcaggaaccccatttcatcttccaatggaagagaatgctgcaggacccccatctccccccacagccttccctgcttatcaaacacatcatacagccatctctaaaaagtccacaaaacccaatacacatccaagaaaataataattagatatctgaatgctgggctgagtctaaatgagtcacataggtcttgtttgcatcacacaaaataaagttaactgtctcaaaatagagaggaagaaaaaaaaaagtttgtgacatcttttcttctggcagcagccaaatatgatgagcaagtaataaaacaattccatttaaattgcacctgctctcaactccctcgccctctgtgcaaagcagattacattgtcttgttttttttttctaaatcaatgccctgactataatgatgttatggagtattaattaatcctgatgatcactgggagcctaatccttaaggctgctggagttggaccatttcctcctatcctgaaggccaagtccttgcaagaagtcaaagcccattgaaaggattaaatcaattgttgaagcagtgagatggtggggttcaccaattttcttttcatggaggaagattctggagagaggtagtgaaacagatgagtcctggccagaaggcccccaattgctaaacgttagcatgcaactttctttggaactcagaacaaacaatctctctcaacagttctctgcaatatatctctgcacggcccttcagcaatatatcaagtgatttctcagtgtgttttaaaaataattgaatccaggcatattttcacttcagtctcaaagtctcatggtaatctcaacacaaatgccagatcaagtctaacatgaatgattgctgaatctattttttgtcattatttaaaataatatttgacagcaccttgctgggtgaggaaaggcatacatagatatttggctacctctggtaagtacacattagatatacaggtgctcaatcattttgctgggagtttcaactggcataatgcttttgacggccacttggcaaatgccagcattttaaaatgcattaaccctttgacctggtacctttgtttcaagaaatttataccccagatattcttgtaggtatgcagaaaaatagtctatacaaggatatttactgtaacatcaatgtctgcagaggcaaaagacaaagcatcctaaatacccattactgggggaggtgttaaataaatcatagtgcatctaaacaataatatattttacagacattagaaacaaacagtctgctttgtatgtatggatttagaacaaattctaagatgtgcaactaaataaaacagcagggtaaataactgtgtataggatgctatcatttgtcatggggaaaagaaggtaactcatatacatttatgcttgtcaatatagagacagtctctgaaaagattcactaggaactatttacttgtgaaatctttgtcttctgatggagaaagtaaagagacccggggacttgatccaggaagatttgcttttcactctataccctcatgtgcagtgtgagctacctgttgaaaagcctaatttaaacaaagtaaaacaaacataaaaattactgttttattgaaaaatatcaatacatgttcactatagagaaataataaaatagagataaacaaaagaaaagaaaaattggccaaagagaatcctttcatatccttccaggcatgattccaaaaattctgaaaatggtttcatactcttccaaaactatttctatgcacttttaaacaaaaaggggattatactggtaataacatgtttacattatagttttattaagagaattaaacaagtgagtaaagatataaacatgctattatctgctccacactgtcctaagtgacataaatataaacatacatatttataagtataaatgtataacagtaattggctttgtaaatttttttcgcttaaaacattgcaaacaacttttaatgttagtaaatattcatctaaaacatcatttttaagcgaataaactttatttttcagaggagtttcaggtttataggaaaatcaagaggaaaatacagtcttcatataccccctgtctccacacacacaacctcctcactatcaaaattccccaccataggggtgcatctgtgttaattgatggacctacactgacacatcattatcacctaaagtccatgtttacattagggtttctcttggtggtgtacattctgtgggttttgacaaaagtatgatgacatgtatccaccactgtagtatcacacagaatagttacactgccctaaaaatcctgggttcgtctattcattcttccctccctcctaactcctggatatcactgatctttttactgactccagagttttttctttttcagaatatcatatagttaagtgatgcagtatgttgccttttcagatttgcctttttcatttagtaatgtgcattctcttagtaatattcacttagtaatatccacgccttttcatggtctgatagctcatttcattttggcaccgaataatattccattttctgaatgtaccacacagtttatttgtccattcacctactgaaggacattcttgattgcttccatgtttcagcgattatgaataaagctgctataaacatccatgtacaattttttgtttgaatgtaagtttctatctcccttgggcaaataccaagcagtatgattgctgaattataggttttgttttataagaaactgtcaatctgtcttccaaagtagctgtacactttgcattccaaccagcaatgaatgagaattctggttgttccatgtaatcaccagaatttgttgatgtcagtgttttcaattttggccctcctaacaggtgggcagtggtatctcaatgttttagcttgaaattctctagtaacatataatattgaacatctttttatatgattacttgccatctgtaaatattactgggtgagatgtctattcaggtcattttcctaggtttaaattggctgttactttttttattattgaattttaagagttttttgtatattttggataaaagtcctttatgagatatgtcttttgataatattttctatctatggcttggcttctcattctctttacattgtcttccatagagcagaagtttttaattttaatcaagctcaagttatcaattatttctttcatggatcataccttcagtgtcatatctaaaaagccatcaccatacccaagcttacctagatattctcctatgttattttctatgagttttataattttgtgttttacatttaggtttataatccattttaatttttgtgaagggtgtaagcagatagtgtccagattcatttcttttgcatgtggatgtataattgttccagcaccaattgttgaaaagactatcttgactccactgtattgtctttgcttcgtcaaagatcaattgattctatttatgtgggtctatttctgggctattttttctgttgatctacttgtctattcttttaccaaaccatactgtcttaattactgtagctttacactaagtcttgaatccagagagatggcctccatattactttaaaatcagtttgttgatatccagagaataacttgttgagatttttatccaaatttcatttaatctatatatgagttgggaagaactgacatcttgacaatgttgactcttttcattcataaatatggaatatctctccatttatttagctctttgatatctttcatgagtcttgtaatttttcttgtatagatcttatacatattttgttggatttttcctaagtattttcaattttcagggtactaatgtaaatggcactgtgtttttaatttcaaattttacttgttcattgctggtatatagaaatgcaattgacttttgcatattaaccttgaatcctgaaaccttactataattgcttattccaagagtattcttgccaaatcttttagatttttctacggagaggattatactctgcaaacaaagacagctgtatttttttttcttaccaatgtgtattgtatactttttgtgtttttttttcctgtcttatgtttagctgcactttcagtacaatgttaaaaaaaaggtggtaacattctttgccttgttcctgatcctacaggaaaaattttgagtttctcaccactaggtgggctgtatttcttttactcgtttagtggttgtcctagagttttcgatatacatttacgactactccaagcctactttctgataactctgtagcacttcacaaagtgcaggtgctttataataacaaaatattcttaattcctccctctaccccttgatacacattttgtagttgtctcacagtttttagacactctgttctgttttttttttttttcctcagtcttttttttctgtttgcttttgagttttggcagtttctactgttatatactcaaactcaaagaatctttcctcagcttatattatccatctgttcttgcatgttatgtactttttcattaatacccttagcatattacttatgtacatatttgtaaagttcctgggctgataattccaacactcttgccataccagactctgattctggtgcttgctcagtttcttcaaaccgtgtttttgccttgtcgtatgccctgtaatttttgttgcaaggtggacatggtatacttggtacaggaactgaggtgcacagatgtttagtactgcaatggcaaggtgtgtggagagaaaaacatcctgtgataaagtcagcttttcacttgttattagaacaaagtggagacttctgagctccaacctgccagacaataaaccagaagtctgaaaagcagcattttaaatttacatactatactttatccccttcttttatgtgtaatgtaattcttttttcttttaaacaaatttaaagaccaactaaagatttcaagctgacctacttgaatttgcttcacctcttattttccgctcttgtttttcttaggtatagctgatttgattttgcttctgaagtctgactttagagctggagacttaatttggatactgggctaacaagctttacaaaggagttagaggattcagctagcagccattgaaattcaatatatcttgtctttctgaattcccataaaatactttaatgttccattgattgccaactcaactgttttaaccagtacctaggacctacttggcagacagtcagttttgcaagatattatgccatttaattgcatgataatattacattcatgatggtaatataaatgaggcagtaaaaagcagttgtgaataattaaatgtcaaggactaagaaaatacattggatgacactgaagcatggtataactttagaaagacacccttcaatttcgaacacaggcaggcagcgtatttaatgagcagaacctatattcttgttaagtttcactgctagaaccaaacctattttttcataaaggttcaccagtctttagattctgctaaaactcagttggagaatttcttttcacagcttctactgtctaaggtttcacaatataagaaatataaagtttctcctcttctaaagttggaaagttttatataagaattttcttgcgtctccattttcctcctctactgatcacaactccctcctgctacctcatgtcctttggttcccgggcaggggaattcttcagaaaataatccttccaatcactctctgtccttttcccctcaggtctagataagacaagccccctcaggaagccaggacaaagacgtgggagaaaggcaggtagagtggtcaagaaatgttcttttcaggcaggaattggggtcctcagcctatcttggcagagactccagcaagaaaaatatctaattcattcatccaattaagtggctcttaagcacctgcataggttaagagctggaacagaagtggaagggcaaagataaataccttccatccgatttagcagagaggaaaagcaaggatccagggagtgaggcaataaaaaggaggaatctctaattgccaggactcctctttgagcagtcagagccctgttttttgtggggatatgctctgatgtgctgcttgaggttggtgtaggaatgagggtgactctgaaggatcacaagactgacttccagtggggtcagggtgagcaagatggaggcagaagctcaagtgaggataactgtaacctccagtatagaagagagaggagtcagccaaggtagtgcctgctgggaaagagaagagagaaaaacaagcccactcacctccaggaggctggcctagcagggattcagagcacagagacccaagacatggctgcattggtaggccctcctatgtgacaaccctcctcttagtttccacaaaatatctttgtatgagtgttttcttttaggaaaccacaaaatagaattagatataaactcaaacaactgcaagttttagtcaacttgggttgctctaacaaaatgccacagactgggtggcttataaataacaggaatttatttttcacagttctgggggctgggaagttcaagatcacggcgccagccgacccagtgtgtggtgagggctgcttcctggttggcagcttcctgtcttcattgtgctcccacatggtagagagcagaaggagcagctctctggcttcttctcataagggcactcatcccatgcatgggggctttgcccttgtgacctaattacttcccagaggcaccacctccaaataccatcacactgggggttgggatttcaacgtataaagtttgggggaaacataaacattcagtccgcaacacaatacaaagagaatcataagagtcacgagaaacaggcagataaagagacaggctacaagaattcagggggcaaagtggtcatttccagatggaagttaaagacagccttcacagaagtggcattgaagaacagaggagtttcgaggctaggcaaggggagggtgtcagcactaggaagggaatgccaggcatggggaagggtgtcagcaaaggcatcgaggtaggaaagtgcagacctgggcaggtaccagctaggggtcaggtggttttgcaccagctccttctgccccttcccgcaatttctgtggaacaaggtaatggtctattggctttgcacagctaaggcagattctcaggttattcagatatatcctccagaaggaatgtaattaggggacagaaaggcactgggtaactttaatctttctaaagagctgcccgtccctccctggagccaacagctcatttttattcctcaactacttggctcccagaactgattgctgattccggctgtttggcagagggcgattgtgcatgtcctgggagtgctggccagcttccatttattaatggagactaaacttacccctgtctacctcctctcccacttcacagagaaaagttttctcagtctctgccacacacgccactgctttcagagcccaagacagggctgcaccttaagatgaattggattctcactaaaccaccacactctgtgatcacctgtggagatctttgttgaggaatcctgggttcctgcagcagccaaagaaccagcaccgatacctaaatgtgcatagtcattgacatgcttcattttttatcaaatgagactagcgggtctcacacctctcccactttctcagcagcctctcctctttcctaatccagtgcccttccacactctgcagtggcacctacccagttccactgatagccccagacgcagcatacttgagaataaagagcaggcctaaaagaactgcgatctggtcgctgtttctttccttgctgtatgaccttgggtggggcaactaacctttccgagcctccgttagttcatctgtaaaatgtaaatagaatgcaaagttattatttcatacctcccttacaagaagctttttcaaccgtgacactttcagcatttggggccagataattcttcatcatgcgtggctgtcctgtgcatgggctatttagcagcactgctggccagcagcaccccctgaattgcagccattaaagatgttctcaggcattgccaaatgtcccctagggggtaaagtcacccccagttgagaaccactgtcttacaaccaccttgtgagccaggtagaataaagggtagaacatgtccaggtttggcaggacagacatttgggaatcaaagagaatgctctggcagtggtgacatcctaccccacatggcccagggaggggggttctactgataaaaagcagatccaggaaagagatacatgtgagagatgacaagggttttgaaaccagttaagattttctttagcagaaaagacaaaggtctttgtcttttcacctaagggcaaaccctcttcattactgtgaatattaaccttcttccaaagactctgtcagtcgagtctcaccagaggagtagacatttctcttattaacaagaccttggccctgtttcctgcaaaataataactgtagcaccatttgcctaaggaaagaaaagatggtcttgccttgaaggagcttcccataataaactattgaagctaaaatttctactaatactatattgttgtgttatagtataatttcaaaaagataaaaatttgacttttatgcaaatatatgataaatatgtgtcaaagattttacttaactcattaagaggcaaccagcaagacatcaaaactctatcaaatgagaatctgaggaagagggtattttaggcaacttaaaagaacattaggatgagtgctacatgagatgcaaaactaggtaatgctctcagggccagtacccataaccattggggttatctgttctttatttttttcttagggacagggtctctctccattagccaggctgcagtgcagtggtgtcatcatagtttactgcagcctcaaactcctgggctcaagcgatccttctgcctcagcctcccaaatagcaggcacacaacaccacacccagctaatttttaattgttatttttgtagaaatgagctctcaccatcttgcccaggctggtctctaactcctgggctcaagtgatcctcctgccttggcctcctaaagtgctgggattacaggcgcgagccactgtacctggccagggtcatcctttctaccatttagaaattatttgtatctcaaccagaccaaaatctataggttcacttctgccctgtggaactgtaaagtagccctgtcagtagaaaatcaatgagaggtgtcaatccagcaccccccagaaagaacgcccagcaatcccttatttctaagtttgggctaattcttctaatagttacatgaatattgaatgctgccctcccaggccctgggcgaatcacctctgcctctgccttcaataattaaagtctaggagagcaacagacacacaaaagttaatcacaattatgttgccagataaaaatatacattatcccatctggaatttttacacattcctggtgaaaatctacgttggtacaactctttagcagaacaagatatatatatatatatatatatatatatatatgaatgacagggtcttgctctgttacccagggtggagtgcagtggtgcaatcatagctcattgcagcctcaaacttaaattttttctgtagagatggggtcttgctatgttgtgtaggctggttttgaactcccgggctcaagcaatcctcccacctcagtgttctaaactgctgggattacaggcatgggccaccatgcttggccatacttctttttttttaatagtatttttttgtaatgtttaatttttgtggctacatagtaggtgtatatttttatgagatacgtgagatattttgatacaagcatgcagtgcatcacaatcccatcagggtaaatggggtatccatctcctcagcatttatcattgctttgtgttataaacattccaattacactcttctagttatgtttaaatataaaacaaattatttttgattatagtccccctgttgtgctgtcaaatactagctgctattcattttatctgaccatatttctgtacctattaaccatcctcacttgccccgccaagtaataattattaatggagggcagggccctggccctcacctcatgagctgtgaaaacaacataagtcactgtcagagttgatgcaacaagaaatgtagaggcttaaatatataaaagtagtcaaatataaaaactaaacataataataggaatagcacacagaaaggaggagagaggtacttaaaatgccatctgttgatacactggggtaccaagacatgtctaagaaaattatattttatgttgtattttggaggtaacctccagcaatcagaatagaaatggctagaaaggctgtctgcagggtgggcttgtgaatagcaaggaggggatgccctggctatagcaggacacacaggaagcatgctcatgtttggctgcaggagtgtgggaggctccagtgagcagctgcatctcaggtaaggcccagagactgatgggagattgctagtttgtcaactggacagttggaggaaaagctttcaaggtagaaggaacagaatgtgcagcagcccagagcaagaaagagtaagatgttcaaggctgggagatggggccaggcaggtatgggctggaccacagaggccttatgtgatgtacaacaaagtgtacaaagtgtaattttaccctgtaggcatgggacaccaaacaaatgtaattatttttgttgtatatcttattttgcaggaatggatataacgtcaggaaactgagacacaagaatacccagtctcatggaggagacagagcagagatgtttatatatcttctgtcctcacttgccatttctcaggacttatcaccctatatgctagatactaggaccacaatctgaataaaatacagtccttgcttctcagagactcacattctagcaaaaaaataatttttaacaggagagttaatagcagtaccagtgatttaaaacaaacaaacaaataaacagacaaataaaaacaccaccaggcagttcacaatgagaagcagaatgaagcagcaagagcccaagacacaagacatgggtgggactgacagcaggcccctagatgcagggtgggcttcctggaagaggaaggccttgcaagatagtcaaatacagtctagtgcagacaggaccagggcttccaagccagaggcatggcatgggcaatggcattggtctataggactcaacttccatccctcatccccaatttctccttcccgctttccagagcttctataaccaggcttgatgggatgacattgtaagacttaatggaggcttcttccaggccttcaactttcttgaattttctgtctggatcatgtctaccctgagggcagtgcaaagagtcagttcctgacctctgagcttctagaacaccttttttgtttctaaaacagagatctttcagagaaacggctgcttgagaatcaagaactaaggcagcagaacgagcacaggtctgaggagcatatgctttccagatcctcctgcacagagacaggtggttcgaaaataataaaatgaaacggaaattagaaagaaacacctcttgagtggaagaagggcagatattttatctagaattaaaataggtaagctttagggtgagtgtctgagggtaaaaagagccagaacccttcttattctgagatcaaaaccctgggtgaagccgggcacaggggctcatgcctgtcatcacagccgatctgggaggctgaggtgggcagatcacctgaggtgaagagttcgagaccagtctggccaacatggtgaaacctcatatctactaaaaaacaaaaatattagctgggtgtagtggtgggtgcctgtaatcccagctacttgggaggctgaggcaggagaattgcttgaattactcccaggaggcagaggttgcagtgagctgagattgcgccactgcactccagccggggtgacagagtgagactccgtctcaaaacaaacaaacaaacaaacaccctccccccaaaaaaaccctgggtgataagggaagtccataggaccccccagaagtttaggaaacctgacagcataggcgacctgagcttccacttttggggttgcagatgccagagcctgcaggccccccatagaggcttcatgaagctggctgggcagagggggctgtctaggcaggtaccccttgctaaggccccctggagaaagagagagatggggaacaggccagggaaacttgagaagttctgaagttatggagaggacacagaagttctgttgggcggacccaacagaaaccgaggcccatacaggagatgccagcccaagtgtcagacccactctcatctcaggtgacagtgccacttgctcgttcctgacctccctcccttactcctgccccaccctgcagcctgcaccatccacacctgagctgctcacagtgattccctgggggagccacagaattctaaacaagttgagggatcagaaggaaggaagtttaagcttcaagattccctgagtctacctcactgggtacaattaaattttaggtaaaatgtgaggatggaaaacgaattctggttataaagaaaattcctttttttttttttgcatgcccaacttccaggcccatgaaatcttcacctgttaggtacgaaggtctcttaaattgtgctttcacaattcagcctccagcccggggccaaaatcaattgcactttggaaactcctggggtggcttttataagataaaccaatgccaggacccattccagatcaattaagtcaagatttctgggaaaggggctcaggaaatgtgtactttttaattaaaaactccccagtttattataatgaactatcaaaattgataaccagtctccaaccccaaatccaaaaccaatgctccgctgaagtccgtaaactgggcaggctgccctggaggcccactgcccagtgctgctgtttgcaggatttacggctccatcctccaggagtctctggagcacagggtagctctggtgtcactgctctcccatttacagctgtccgtcattgcttctccgccttcccaggtgcagccgtgatcacagcagggccctcacaacctgccccttcctctatgcaatgtctctcatggaagctttcaaattcttgtagcattctgacccctgaatttattgtctattgattgcatgggattcattactttctattgactgctcatgctgctggtattgtggataaatgctaattcctcaataatttataccatatgtggatcatccaaggcaaaaaacactctttttctcccttttatagattttgttcatttccttctggggaacatcatgatccacatgaaatccggaaaatgaatatgtcaaattattttgatttgcagccaggctgacaatgcagcctcggcttcccattgacaccattattggatggtaactcaaggaaaattggggcctttaaggagatgagccaagaagtggggtgctgtccccaagataggggcatcaggcagggttgagatagccttgagtctcccagcaagcccccagccctctaggcagtttctgttctcaccccacaggcccagctttctctgtgctggaaattagaaaggcagtgaacagaaaagttttctttgccctaataataaagaccccccaaaacctgtgttctcatgtccaaaatcctttcccacaaaccaagcttaaagaataccttttttaaaaaaatggtaataaacagaaagtcacggtttagagtacaggctccaaaaaagtctacctgggtctaaatcctggcttctatgtgagctgggacacattacttcacctttccacctttatttcctcaactttaagtcgaggatgctatggaaacgagaaatgacccaccttagcacagcttacctaggagatagtgaacctgaattctatcctccccagcttgagctgcggaagggccatgaactctgagcatcctggagttctagactctgtactgcacttgtctacagttgctctcctgggcaatgcccatggattttgtttaaaccaatgatgttcagacatatggacttattccatctaattcagagtgctggtttccaatccctaatcaacagaactgccatgaactatatgcccttctctcccagcatttcaaaaccacagcttttccctcttagcaaactgcttggtaaatttcttcattggtttgtatttccttcctaactcccagagttcagaaatcaagctgctttgtttctgggtggtctttgttttcatcattgacaatagcagcagtacttctgcaaaggaggttgaaagaattaaataatgcatacgaaatgcttagcacagtacctgaaataaggtagggctcctctcagtgttactcatgagcctggcataaagtagtgtctcatgtctcaacaaatatttattgaataaataaaaatagtcgtctttctttctttctttctctttctttctttctttctttctttctttctttctttctttctttctttctttcctttctttctctctctctctctctctctctgtctctccttctctctttctctctttctctctttctttctttctttcttttctctttctttttttgagacagagtttcgctcttgtctcccaggctggagtgcaacggcatgatcttggctcactgaaacctctgcctcctgggttcaagtgattctcctgcctcagcctaggagtagctagtattaccggcgtgcatcaccatgcctggctaatttttgtatttctagtacagacagggtttcattatgttggccaggctggtctggcactcctgacctcaggtgatccacctgcttcggcctcccaaagtgctgggattacaggcgtgagccaccgtgcctggcctttgttttttttcttttttgagacagggtcttgctctgtgacccagactaaagtgcagtggtgcaaccatggctcactgcagtcttgacctcccgtgcttaagcaattctcccacctcagcttcctgagcagctggaactacaggcacacatcaccacacctggctaaattttcaattaattaatttagttttcgtagagattggatctcacaaggttgctgaagtttatctcaaattcctgagctcaagcaatagtccagcctcagcttcccaaagtgctgggattacaggagagagccactgtgcctggataatgaaggtagtcttttatgcatttcacatccattatctcattcgaatctcctccaaaacttaatgaaacaggttatatagataagaaaaatggaggctcagaggccgaagtggcttgcccataattgcatatgtaactggggttgatttagaactcaagtgtgcaccccaagctccagatgtaaggtgctctctccttcacagagcactatgacttcaggtgggggcaagtatgggagcaagatcacggtgctcacatggcacttccacactctgctttccctccatcccttcccttcctttccttttcctctcatctgtcaaaatctcccttatctaccttcccctctcccattttccctctgataccagtttcaccatggggaaaatgggggactggacagataatttccaaagggaccatcaccctctttgacaggacataagttcttgaggtgtgggtggctgatacccaggtgcctttcctggaagcagacaaagtaggtgacctgggaacacaaaagaccctgaatcctcaaaggtgatgctagaaggtgcattgggctgaggaaaaagaaaagagagactgagggcaagaaagaggaaagctaagcagcaggaggtgcagaggttaagagcaagggctttagaccagacaacacaggttcaaaacccagccctgccacttatttgcagtgtgaccttgaacaagtcactaaacctctctgtgccttaaggtttttattggtaaaatggaaatgatgatgataacagtacccagctcataaggctatcgtggaggtaaaaggaggtcatacaggtaaaggacagaatagtgtctggcactcaactgacgtctatttttattatttcaagtttgctcatggcagtgctttcctgtcaatgatgcaattcactgcttttatctgcaaaaagaaaagactgccaggcatgcccacacattcaagcccccaagaatccaacccttgaccatctctccagcttccatatcttcaccttatacagccccctctctgcttcctcgagccctcaaacctggctcttgttctctctggagctcaagccagttccccgatgttagttcctgtctcccttcaggtctcaacttctcagacaggctttgcctgactcccatagcaccttgactcccatggcatcagactaaatggcatcttcctgcatgaaaatgcaaactccagaaggacagacaacctgcgaggcatggtaacctatgcaatagtttggggctgagttgtttttgtatgtttcttcttaaggaacacacattgacatgcttgcacacccatagggcatgtctgaaggatgcacaaggaccggaagcagaaactgcactaggaatcacctacttttcaccataagccctaggtgccatttaaattacatgtcatggagaattagtacttaatcaaagcaaatccacaaatccacattaaaaaaaattaaatttggaaggccagggttggtggctcatgcctgtaatcccagcactttgggaggccgaggcgggaggatcacctgaggtcaggaattcaagaccagcctggccaacatggtgaaatcccatctctactaaacatacaaatattagtcgggcgtggtggtgggcacctgtaatcccagctactggggaggctgaggcaggagaatcacttgaacccaggagggggagtttggagtatgccaatattgcaccattgcactccagcctgggtgacagagcaagactccatgtcgaaataaaataaaataaaataaaataaaataaaataaaataaaataaaacaaaacaaagtaaaatttggaaactatgatccttcaaacaggataacagtggcaaaggaatttttacacaattggtcaataaagaacagaacaaagagaccagaaaaagacgtagcaagagttgccttggtgttcacactgcagcagtcacccagatccttgcaagcaggctgttcccaacttcctgacaactagcattgctcaggcgatgcttctgtgcctaacctgcagcagccacgggacacactagtacacacttggccaggcacaaaatggcctcaaagtctccaaccacaacactagaaccttaagacaaagcagtgttgatacagtttcagtctgcatccccactcaaacctcatattgagttgtaatctctagtgttggaggtggaggctggtgggaggtgattggatcttgggggtggtagctagtggtttagcaccattcccctactgctgtctcatgatagagttctcatgaaatctggttgtccaaagcatgtggaaccttccccttcgctctctcccttcctcctgctccttccatgtaagacgggccggcttcccctttgcctttcaccttgactgtaagtctcctgaggcctcctcagccatgcttcctatacagcatgcataactatgagccaattaaatacctttttttttaaataaattacccagtccccggtcgttctttatggcagtgtgagaataaactaatatatatctttaaaattccaaaagacaattctagaattctatatacaaccaacctatcaaacaaatattagggtagacttaagattctttcagaaattaaatgcctccaaatatgcacaaatgagacacgcctcctgagcaagctagcagagcttgtgctccccagaatgagggggtaatctatgaaaaggtaagacataaggttcaggaaacatagaatctagcaaaggagacaggtgaaagaaattttagacgcccgtcttttgtcttagcttagagtcccccaaagcagactctgagacaagaactcatgggcaggcagttaaatttagaggcaatcccaagaatctcaatgaaggcatgcggacgtaagatgagcaagcaagaacggccagtgagtggctgacagtgcacaggttcccactgtggggagtgagtgggtgacagtgaacaggttcccactgtggtgaatgagtgggtgacagtgaacaggttcctactgtggggagtgagtgggtgacagtgaacaggttctcactgtggtgagggggtgacagtgaacaggttcccactgtggggagtgagcgggtgacagtgaacaggttcccactgtggtgaatgagtgggtgacagtgaacaggttcccactgtggtgaatgagtgggtgacagtgaacaggttctcactgtggtgagtgggtgacagtgaacaggttcccactgtggggagtgagtgggtgacagtgaacaggttctcactgtggtgaatgagtgggtgacagtgaacaggttctcactgtggtgagtgggtgacaatgaacaggttcccactgtggtgagtgggtgacagtgaacaggttcccactgtggggagtgagtgggtgacagtgaacaggttcccactgtggtgagtgggtgacagtgaacaggttcccactgtggggagtgagtgggtgacagtgaacaggttcccactgtggtgaatgagtggatgacagtgaacaggttcccactgtgttgagtgggtgacagtgaacaggttcccactgtgatgaatgagtgggtgacagtgaacaggttctcactgtggtgagggggtgacagtgaacaggtttccactgtggggagtgagtgggtgacagtgaacaggttcccactgtggtgagtgggtgacagtgaacatgttcccactgtggtgaatgagtgggtgacagtgaacaggttctcactctggtgaatgaatggttgacagtgaacaggttataactgtgatgaatgagtgggtgacagtgaacagattaccactgtggtgactggctaagtcctgctgggaacctgctatatgaggccatttctgcattgctataaagcaatacctgaagctgggtcatttataaggtgagaggtttatttggctcatggttctgcagtctgtgctggaaacatggtgccaggatttgcttctggtgaggccccaggaagcttccactcatggtggaaagcaaaaggggagcaggtgtcccacctggtgggagtggaatcatgagggtggggaggtgtcacacacttttaaacagcgagatctcatgagcactcactcattattgcgaggagggcaccaagaggatggtgctaaaccattcatgagaaatccatccccatgatccaatcacctcccaccaggcctcacctccaatactgggggttacatttcaacatgagatctgggggaacaaatactcaaactactgaacatttaagaactccgtagaacacacttcagaattatcctgacaaggtaccaagggccaaggaatctggattcaaaccctcacaatatgtctgggggctatcgccacccattcccatcctttattgactgaggattactctcttaacctcccagcctttttgggctgagccccatgggccacaggccataagcattaatggcagaaaaagtgctctgacagacacaagtgttcaagataggatggcatcagtaagcatggaaactgctggtggcctctggtgtgtgccaaggggatatgggtggtgcactggcagcatctgctgcatctgataaaatgcaagctcctgaggatgggcctacactactccagcatccagcacaatgcagtcacttagtcctgggtggatgcttggatggatggatggatggatggatggatggacagttggatggatggacggatggatggatggatggatggatggacaaataagcaaaagaacatagttgaaaataggatgaacagtaggtgcctgggaaagaaggaagttgaaaatggagtttgaccttcaggcacaccaaactaattgtctttataattttgagacaattttgctaaacacgtgccgccccaccccacccctcacacacagcttcaaaggtgatggggacactaagccccaagccatgccacaagcttcactcactgttggcctctgtccactcactttaaggccatattttggttagaaactttctgtggcaatgcttgcataaatcatattaaatatattctttgctcaatggtactgtgcaccagggtagctagctgtgccaagacagctgctaaattagaatgctcttaaatcagccgcagatgcctaaatgtttatagctttgaagttcccccagccatgactcctccttctcctcccaccagcctgatctttatgatgctttttaaagccagctgcagggtaagcaatgtttgaaactcagcacagggacagagggcagctgtgcacatgtggggtcaaccacaaccccaaggtgagtccagccccggcctgtgaaggatggcaggaaaatgagggaaaggattctttctcacagcagagtcatggagagtcacagcagaataggccccaggggatatccaggtctagaattctccagctttttctcacccaaggccctgagctcaaacacaaccttaagtagaaaacataaacaaatgtaccaacagggtggaatgaaaagtgattttgtttattttcaaaaaaagcgccagcagcttctcaggctgggtggaagaatgtcaccttagagcaggtctctctgagaagtgtcatgtgagcggccccctctggcatgcagtggaaggtgggggcaccagcaaaagtgggataggacatttggtggcatcgtgcccccggagcggaaggggaggagtgggggaggaggacacatttgcaaaggagccaaggaacctccaggaaggaaaagcatcaagaccaactcttccttctggagctctgacatgacgagaaactctggggggtttggatggtcctcactgagcctcagggccccagaagagaaccgcaaatgagctgagtccagattagcggtggggtgggaggatcagttctaggacatcaggaaaagaaggccacctgggcccagtgttttctctctgagaggaggaagcatggcagtgactgacaggagactcctgctgccgccttagactctaaatgatgctgggttaggccatcgggaagcactgggcttccctgccaggctagacaggtaaatgctcagaaatgaagaggaaagaactgcacctgcacctcaggctgatgggttacgctaaacagatgcaagagaccaggtgggatggctcacgcctgcaatcccagcactttgggaggttgaagtgggaggatcgcttgaggccaggagtttaagagcagccgggacaacatagcaagaccccatatctacaaatttttttttttaaaaagagatgggtgtgagggcaggcacctgtagtcccagctattcagaagactaaggttggacgactgctcgaacccaaggctgagactgcagtgaagtgtaatcgtgccccactacacccctgcctgggcaacaaagacagaacccagctctaaaaacaaatagcaagcaaacaaacaaacaaacaaaaaacccaacagaggcgaggctgagtgtagaagaagcagactttgccaagttagctttaagttggaacccgaagtctaaaggcagaggttgctcactggcactggtcatgtcactgttagatgcccacaaagtatagacacttggaagaaaataggttttactactggagaccctccccatgcacgtggtggaatgcataagggttccagttcttcccctttcctgtgtccacatttttgcatcaaatctgcctaggggcaaaaggaaattccctgatgttggatgcagtcacatgacttgttctggccaatgagacactggcaagcatggcccacatgctacacttgtatggtgcggcttctcagcctgtgcctctaccatcacctgggaagggagagacttagagaagagctgccctgccagaactcagtgccagccacgtgaactgcaggaaccagtggctggggtttcgagccagtggcttttgggttgctttgctatgtagcatttctgtggcaatagctaatacaaaaattcaagaagaaatgggcagaccagtcggcactccagggagcactgtcgcctctctcagctgaaacaatgggctgtcctggagcagctggcagccctctcctgagggcagaaccattaggatggtgtctcccaggccctgcccttaaccctgctcctcatctctgccccctctcccccaaccccagccccagaatccctgtgggccacaccatctgtgcaccctcttctggatattgatccatccccaaggtccctgttattccagagactaggctggaattgcagctgcttcctcagggtattctagcagaagataatggaaaaaacccaacttgattctctaggatatgggtgttattaatgttctcctgaaagcagaactgagctgaggacttgggtatagttggtttctttagaatttgatcccaggaagctggaataagaagtgcagagggtgaggaaggaaagggagagaagctacggtgggtctgctgggttcgttgccactgtgggaaactgaggctccatcctgccggggactgtctggggagctgtagagaaaacacctcagactcatccctctaagatatgggaggctggggcatttacccacaggtcctatccccatggagagctgctgtccctggtatatcaattacctcccaccaaccacagccattcccaccctgcacctgcccttgagggctgagtaagtacacagtttggagaaatccctgagaaccactgagagcctggatggcctgaggtgagaagcttgcagcctgcaaatgaaggcagagacagggcaggaggcagcatgggcaccaactggggctgctacactgagggcccataagacaagtatgttaactttgcactgtgatcttgctagaccttcacagcaaaccctgtcttacgggtaaagaaacaggctccaagcagtgagtgacttcaccaaggccagctagcaagtgatgacttttgtccccaaagccctggcagccagattctgaatccattgttcttacccttggcctcagggctttcccattaactaattaatttactcaacaaatattaattatgatgtagacactgtggtaggtgatatggaggattgccgagtacagttgtacaatttgtgcactgtgaaaaaataccatatctaggtcacaccacaacagcataaaatgctgtatttattattctaattttctagcagatggtaataatgtgccttgttctaaaaaaagtgtactaaaacaatgttccagtagatatatgaagagtcctgaggaagggcccttgtccactttgcagaaaggcaccatctgggctcctggcagccctgtgatcaggggagtacagtgtaagagtgaaacagacacagttcctgctctcatcaaaactgtggattagccagagagccccatgtccgactaaacatgccgcaatttgtatttatgcatatatttatatataccgtggatgaaaagaacctagtagtctttgctcagaaagcctttcctggcctatctccctggaagaaagaagaatgagaagaaactactcaggcaaaaagtgagagagagtgtttcatcaggaagagggaacagcaggggttcaggcaggagggagctagatatgtctagggagcttttggaaggagccaggaaaggagtgagttcaagcgggggcgagggaagaggcagacagggcaggacacgcagggcccttagaacaaggtacgtgactgagggcatgggaagccacaggagggttagaagcagcctcatggcactagcatctgtaccaccattttttttttttttttgagacagggtctcattctgtcgcccagattggagtgcagtggcacgatcttggctcaccgcaacctccgcctcccaggctcaagtgattctcctgcctcagcttcctgagtagctggcactacaggtgggcgccaacacgcccagctaatttttgtatttttagtagagacggggtttcaccatgttggccaggttggtgttgaactcctgacctcaaatgatccaaagtgctgggattacaagcgtcagtcaccacacctggccatgcaccagctttttttcaaagcagcctgacctgctaatttgcaggataagagggaagctgaaacaaggcaaattagcaaatagaagagactttttttttcccctggggtaagaaagggccctgttcttgagttccatgcattccaccagctctgtggagagtcagcagtggtgggcaaagtagcaggcgtgacaggtaagcagtcagtctgggagaaaattggagggaaagcggcggtggtgttgactattgtgtatgggagaagagatagagaaagctaactaggtgatgggagatctcaccaactgcaatttcagctgtccacagcaccctgaaggctgcaaaaccactgaattatgccgagaaactgaaggaaggagaccacagggggttcacaccctcaggtgatgaatctacttctagccctgaatttttttgttttctaactgctattcagagtggagtctggaaaactcccatttgcaatactgagatgcaccgcacacccaaataatacctggagcaggcacagagcaagagctgagttgttagtgcccagctcccctcacctcacttggtctcagaagaactctgggaggtggcgattctctaccaacgatggaactgaggcgtgggggtagggtcattttctaggatgacacagccagtgagtgttccagttgggatctgtgtcagtccagcaggtaagctcttgggtaaacactatatgaccccccgccctcaccacccccaggcctcccccttagtcttctccgaattccagcttaagtcattcctattgtcttctactggagctttttcatctcatcgcaggtacataaaatcgccttccctcttctgtcacaatttgccctcctctcttggattcaaaggtctcccctaggaaaccttccctgatcctgtgtgatggggctgtccgcatagttccacatgtgactgtgtgtacacgcatgtgcatctgaagtaacatgcccatttttcatgaactgagactcaaggaagtcaaatgcaaaacaagtggctggcatggtggctcgcacatgtgatcccagcactttgggaggctgaggggagcggatcacttgaggccaggagttctagattagactggccaacatggcaaaaaccctctctacttaaaacacaaaagattggctgggccatggtcgtgcgcatctgtagccctagctatttgggtggctgagatacaaaaatcacttgaacccgggaggcagaggttgcaatgaactgagatcctgccaccgcactccagcctgggcaacacagcaagacactgactccaacaaaacaaaacaaaataaaacaaaaaaaccaagtaagaatccacaaagaaacatccatgaaattaaaaacaaaatgcaattctcattgagatggagtgtttctaagacagtaggaccttatgtcttgtggaaaaaaaaagactcaggaccccaatgcattctgccataaggaaaaaattaaggtgaaagctgagacaggcaataagttgcctctgcatttgttcctgagcagagctacagaaaaaaggttaaagatgagcttttcttatgtaaactgctgatttactgagcgagagaggacttgtgactgactactccctgcactactcctccttttcccttgccacatgtagattcagtaacgtgaccatgctcttccttttggctctccagcctgctcttcccctttaaatagtgaagccctcagggttatctttggagaaggcacagagcacagactgtttttgggattctgtattcctttcttccaggcatgtccttaaccttggcaaaataaacttctaaattgattgagaactgcctcagatacttttgtttgtctgccctccactctcccaccgtatggacatttgagaaatcaatcccaatgaaataaatacaggctgctgtaattgtggcagttcattaggaatatagaatttttttaaggcttcaaggccaaatacctgctgatatagtcaatagcaaatactaataactgcatgcagagaacagcagtgacagaccaggcaactgcgatatacatgaaggcatattcctcatgaatattcaaggccttcttctaggaagaattaggcacatggttgcctgactgggtaaacaggtgatcagcgtttgcagcagatccgatgtaaaaatatggcagctgatgtcagcattgaggccatatgccagaaaacagtatggggaagtcttcctggtaaaaaagcacctctgaagatcaaaatggccccctaagtgacagccctgagcagtcattttgatatttgtccataacaaagtggggaatgtcaaccaaatggcctgaaggtaatggcaaacaggcataaaggacgcagcttccaggcctggcaggagccaggaggcccaggtctgagtcttgcttctgtcaaaacccttttcatctcctgccctccttctaaggccactgccacctctgatgttccatgattcatgcgtggaggaaatgcacactcctcttccgtaatgctaatgcggcttctggctgtgtggaccgtgcaccagatgttgtgctaagcgcttcacagtggagcacactgctctgacctcgggctccagctcggtgtggaagatgcggttccactctcttatttgatcttcacatcaagaaacaagtctattattcaaattaacattcaagatgcttatagtaaaatggaatggcataaactctgcaaggataaacagccatctccttgctctcttggagcaattcaacgggcctcacaggggaagaggccaccagctgcttactgactttgcttggctcagcaccatgtgcacaggtattgccctatagcactgcacaaacaaagcctgtatgctatactggtggtgactgaagggatttttcgaggcctgatttagcaaccggcattataccactaggcctggcatttcattccaggtcggggtctgcaaacaccttcaggggcagttaaggcatgactggctaatccacctggagggtcacagctatgactgcctcaccttttctaaacaggccaacagtggtgtgtatgaggacaacactcccccaaagctgtacccttacacacacacacacacacacacacacacacacacacacttatacacacacgcacacagtaatacacacactcatacacacatgcacacacaagctcatatggtacataccttgagagaaactgttcttgacaaatcactactacctcctaccatcaatgaacttgagtcctcacaactaggaggaatggaaccccagcccactgggaaaggtagaaactgaatattagagcagcaagtaatttggaataatcttatgactcattaaaccttcaaaacttaaagagatgtttattttacactccacctaaaattcagcagttagcacaccttccatccccttcctcgtgggcaggacagcacagctaatcagcactcggctcttgcctctgggtgaactaaatctgtcttcagtcacaacggacctaagcttaatgagttccatctggtcttcgtggaaagccacctgcaccacacaaaaaggcagggaagtttccctgggaaggcattgggacctgaggctggggggacctctggggctggcaccaaccctcaggtggccttgatctggaggagacagcactgtctcagggcttgtaggggcaccacgtgggctcctgaccatgccatccctcacgtgagctccattctgttccattagaagcctctctagatgcccagctctccagtagccatcttgactttcccctctcctcagctcctagactggtagcccattggagaattagcttgtgtttctagctggtgccaggaagatatctgggtcacctttgggggaagtgattgcagggtggtgcaggatattcctggggggactcgttgcaagggtactgcctgaggaagcatctctgctcctttgcagaccaccttaggtgcagccaggcgccaccctagaggagagaagcattatcatagtttcattggaagaagaagtttccagtgacgttggttgccccttatcccacatcagtccttttgtgtctggaaggcttggacccattgcaggaacatgctctcctatatatggagggtgtggaatgcccaaggggctttgggagtggtccatggtggacctgggactgggtagtgggtggggaacaaggttctgaggtaactgaagcccagacctctaggcagagaggctgctcaggggaacggctgtgggcatgatgagacccatcactatctcatgttctcagcctccatcaccgctgtcaaccctgtccccagctccagactgcttctctgtttccaacactcagctccctccataacctcctgttaacttatgcctcagtctctctctaaaactcagagtactctccctaaaacatctttccctttagcactgccaggctggaaacttcaggggctgctcactgatgcccagacgaactccacatgccttggtcctctgcaatccaggtgccctctgctcccaccgccctgccagtgcctctgccctgccccttcctatgcagaacttgtcacagcccagccctgggcccaccacctccatgaagccttcctggcctcaccactccagcctacaccacttctccctccctagggcctgtcccctgcacccttcccttgttcctgcctcttgataacacttccgggagcatgtcattatcacatgtctttgattctaagactcacatttttttacacgtcaacctctctgaaacagggatgcagcagtaaaaaggaggcccaccatgactagctccatgtatgccaagctcactctgggacaaattttgtttctggtttaaagcaaggatgaccacagcaggggtcagtgatgtctcctggcctgaagcagctttaggctgcaactctcctaaatggctctgagggggaccctgcacaagccaccagcccctcaaagggacagcagggagacattgatgtgtctcctcttctcatcctctattgtttctggagacaaaagaagcccttgaaatatttattggagtaataaaatgtcatttaattccttgagcctaaggaagagtggatgaagacctgttcccaggggttgtccctgagcctccccccgggacatgccaaagctgcctcagataaattctcttaaaagtggaaaatgtctctgcctgaggctgcagagtgatcgctaatggaagaggcctcacctgcttcctgtcaccaccaaaaggttcgtgattttgacagctcagccctggggaggagctggattcaggccgggctgccagtccctcgcatgctagatgtgctcagatgtgtccctggcgattagtgtcacagcaggcaggggcatgagtgtctccaggaaagggcccttccccctgcatgtatcaggagaagtaggactggacgccagatacagcaaaacaagccaagaagccaggcctgggagcaccatggccgttagatgcgggctcttccagctggacagaccggcagttctggatcttaacttcaggcgagtgaggcttaggggagcaggctggctccaggtcatgcaggagcagggccactggccctttaccctgtggggttaggaaagctcaatattggaaacggggcccagaggagacagcatccaggggctgttcatggagaccacaaatccggcctcgggtaacaacaccctctctgcgaagaacagaacccacctacccaggagccctacagccaattccaatagcaaatagaaaccagcatcatcagaaagggccaaagggtgaggaaacagccactttcacttgaggtagtcaggaaggcttcaaggaggattttcagtgcacagagtacaggatgaggagagtgagttttccaggaggagcacgtggcaagagccagggccccatgatacgatgtccccagccctgtgatatgatgtccccaggggtccccaccagcccagcagccactggggaaatatctgcaggtgcatcagggccttggggaggcagcaaggtgggaaagatcaaatggagaccatgcttgtttggcacccacagcccatctcaaagtccttgctggaatgcttcccaagacacccatcagtcttccagaaagttctccctcatgtctatcagcaaaaatcttacactttgtcctcataggttttcaggggcctgaggccactttctagaataaaaactgaatagatgcaaaacacagtggtgtatttattttatgttcaccttttataagtattttcaaatacatgtaagtatcagagtataatgaacccttttatacccattactcaatgtcaataattaccaacattttgacagccctgtttcatctgttattcccacctccatcgccttgaggtatatttaaaattcagcaaataaagacagtttttaagaccaaaaataggaaaaaaatgatctatatagctgatgcttacatgctagttacagaatttgtaaaaatgggtatgcattcatggtgtgcctgaggcagtgcacgccgagaatggaacgtcaatctgagctgctgggtaaacatcttcttactctccatcagagcatccgtgaaactgccgcagagagatgtgcatcatctgagtgtggagccctgcagggatgggaccctcatggctgggacagaccctgccccagccagcccccaagtgcagccaggaccacagctggggtgggaggacaggggctgaaagggaagtggcagtgcttgtgacattagaaccctcctgggctgtcactgaaaaactcctccttccagctctccctgcccctgccagctcacttgcatggtacagaacttggctattagagtcaacgcaccaatcgagcctttcatccagtggcctgcagacactggcatggcaacagaagaaaaaactgtgaaagtctcattcgacttgtcttccttctgttttgaagggaaaaagaaaatgtgtcctggcagtcatcattactgacttggtgaaatatcgtctttaatcttaagatctgaacaacccctgtaggtgggcatttttgttttctgtcttcccacaagcaattagaagtttctgctaagatagttaattccctttttattttcactcaaatactcttaacagaatcatgcagactccacattgtctaattagagagcatttacaatggtatcatgagattataaaacaaatgtgtgatgaaatgtgtgtgaaaatcagagcacggtgaggcctcagagtggtgtgtgtatagacagtgccagcttagatgcgtatttccaaggggtcgttgccacctagcccctcctggaagaagccaatgcaaaagaaagctaacccccaaaatgtagggggttagtggtcctgaggaccctggagccagggagaacaatggcttccgtctcattacatcttggcccttcctgcacatcccatgcaacccaaaaagttaccaagacaggtctcagtaaattcagaggtttattttgccaaggttgaggacgcacctgggaagaagaaacacaagtcccagtaggatttgtgacctgtgctttttcaggatggttttgaggacttcaatatttaaaggggaaagagcgatagaagagagggagggatgaaaaaaggggggagggtaggcagtgaggccagtggttgtgtgctcatgaggctttgcttagtgctcagtgaatctacattttacatgtgaaaagatgggtagagaaacagtcaattatccacattttacataagataaagtaagcatgtaggccgtgcctcacacctgtaatcccagcgctttgggaagccaaggagggagagtctcctgggggcagaggatcacttgatgtcaggagtttgagaccagctggggcaacatagtgagactccaactctatttatttaaaaaaaatcattaataaataattttaaacatttaaaaataataggaagagaaagtaagcatgtgaaattacagctgtctgcctgggaacataaaaaagaaggcagaataggtgactcagctcccaagcttaacttgtcctttggcatagtgaatttggagtccccaaaatctactttctttcacatccacataccccttcctgaagacccagccccaggctcagacacacccgctgggaccctgatcgtggagtaagcacatgtgcccctggactcccagcctgcctggcgccgcctgcctctccatcctcctttcctgctgctcttgtctcgcttatgctctaggtttgcactgcactgggcccatctctctccctttcaacagccaagccctctcccatggagggggagctccagatcttcaggacacactcccctgttttggggctgacttcttgtctttctgtatttggctgaaatgttgcctcctcagacaggccacctgtcagcttttgtcattctctgccccattctgagttacctccacagcgctccccatcatctctgttttctctgctttcacacattctgtattccacactaaaatggaggctgtgtggagaagggaccatgctcatcttactcaggctttgagccctagcaccgggaaaccacagggcccggtacacaggagacacaaggtgaaaacatgaaatgaacgagcaaatgaatgaaagcacaaacagagtggaggcccctttgggagactgccacagccccacaggggagcacgctgcaggtgggaaagcccctttgggagactgccacagccccgcaggggagcacgctgcaggtgggaaagcccctttgggagactgccacagccccgcaggggagcacgctgcaggtggcaaagcccctttgggagactgccacagccccgcaggggagcacgctgcaggtgggaaaggctgcccaacacttgatgtgatcctgtctggcgctagaattagtgaataaaattcaattcaattcagaaaacctttactgaggcttattggggcctgggtggttagaacttgtgcaagctgttatggatccaagatctcctctacgtaggaactggagcttcgtaaggcccctgaccaagccacagagaagattctatcttggctctctccctccccttggctattctttctctgattcttttacagcagtttctcaaccttggcaggattgaggcttggggccagataattctttgtggtggggtctgttgcactgtaccttgtaggatggtcaccagcatctgtggtctccactcactaaatggcaatagcactcccatctccagtggtgacaaccaaagatgtctccaactattgccaaatatcccctggggcaaaactctcttgagaacctctgcattacagacttttcaactcctgatttctaaacatcagaatgaacaagactcatgcagatgggttttaaaaccttgaaattggatgagattcaccgggcagtgagcgtagacaaagaagagtgtgaggagaggtgactcctgtatacatatctccattctgggcctcttcccttgtcacaaccaaactgaggcccacttgcctgatgtggtgcccacagcgaggtttttgccgtgatagaaaaaaaggtgcttacttgcagggtgccaggtgaagacaaccaggcagctattgctcaaatcctggcctccctgacggcttgcaggcgagggtttttaaaggcagggtaaatttcaggaaagaagctacaggcaaaataaaaaatcaaatacaccatggaggttttacattggttaaagcttaaaaaggtaatgtaccttgaagtagggggcttataggttgtaggtagagtcaaagattttctgattttgtaattggctaaggaagagaagctttgttgacaaattttgggttactggaaacatgttaactggctaagagtgattttctttaagccccccaggaacaaacaaagcaatgaagcttagttctcacttcccccttgtgtgcatctggactcgttaggtggggtcggcacctctgaaggacaactcagggatacaggttaaggagcagcctttagtttctatagtgaaaccaaacatctctggagctttaacttcctgggctaccgttttaggctacgatatacttttattttaacaagttgcttatttactcctggggcttctttcacatccacataccccttcctgaagacccagccccaggctaggtgtctgaaatttctcttgaaataactcaggattttcctttatttccatgcttagggtctgcaggcccctaaaagaaggggtccctgcttcatctcaccctgaactccaagatcacatatccgacatccaagctggcatccccacttgatttgcatctcaagctcagcgctcccactgctgagctcctaatcctcctctgctctcctcgccatctctcctggtctcagtcaacagcaacttcatccccaactgctcaggccaagagccctgtggtcacacttgactcctctttctactctcaacacaactatcccatcaccaagtaacccatgggctctggctgcaaaacttcatttattccccccagagttgccaccctgggtcaggcccagtgatggctcatcaatgtcatttcacggccacctaacaggttcccagactttgaagtggctgggtctccaggcggcagctgcaagggaactcctaaaacacagaggaaaccatgccactcccgcctgtcaaccctctatcagcttccctttacacctacaaggacatgcacactcctggccagggcccggaggccctgtgtgatcttcaccctgcctgctgcctgacacactggccctgtgctctcccactttgctcctcagtgtccagtacctgctgctcctcctgccaggctccatccttccaaagatagccaggtgcttgctctcttccttccagtgtctgctcaaatggcagctcatcaggaaggccttccctggctacgttacataaaaagcaacttgctgggctccctcacccccagctgacttaaccagcctaactgttcaccatcggactatcctgaactcactggtgtatgtgtgatgcctcttgcaataggatgtgagctccatgagggcagggactgtattgtgttcactcccgtatctccagcacttggaaaacagtaggcactcggtcaggatttgttgatgagatggtcttttgctttacataccttgacggaatacaaccttcacaaggcactggtcaacaccattacaatgcctccagcctgtctcagagactcacccacagttatgctatcctctccaataccatatgaattctgtctccacctgtccaggaggggcttctggggaatattgtctagaatctgatctgtttttttgatattcttgattgataatactgctaattaattctggatatgtccaattattccagattttccagtactcaccataacttatacccaacattatgccttgaagattccaaatttccccaattttatatgtcatacaggggagacggggttgtttgaggcacagccataaatcactatcgataaggaaatgcaagatgagtagaacaagtgtttttaaactctcgttaggctccatggtcaggcaggactaggcggtgttgcatgcaactaacaaacatcccttagcacaggggtgctttggtctcctatactcatatccaaaacccacccacatgttgacttcactgctggaatctgtaaaaggttggttcgtatctctgtaagatactgatggccaggtggccagcacaggtgggatggccctaacctgcccacctttgtggccatagttgcttgttattatatcaagttccaatggacagatttaacccataaaggttgaccaaaggcaagcaggtcatgaggtgcaaaatatgttaaatacaagtctttccagtgtttcagggctttaaggagatggttaattcaacagaatatcagtcagcagaaaatcagtcctttcctttcagggagagtcacaaaaggatactgtaatggatgacctggaaggcccatgggagaaactatggccatagcctcccaactcttcagagaatttggaaaggaattttaaaaaggaatagcacatgagtcaaagtcatctccttagggactggtctataatgtccctaatgatggttggtttctttagagttcacctttcaagaaacctttcccccaccactatcaccatcaccaccagtaaaaggggttcacctgcacatccccaacttgcaatccacagaatgcacctaccaccccttgacagtgaagcctcttcaccttacttgaagaaggattctccttttgtagaagccccgctattaacctctcacataaggaacccagagactgttcaaaacaggggttggcaaactacagcccatgcatcaaacccaaggctctgcctgtttccatgcataagttctactggatcacagccacacccattcttctacccactgcccatggctgcttcctgctaggacagcaaagacctggggcccacaccatctaagacacttactacccgatcctttatgaaaaaaatgtaccaatccttgtcttagagcagtcagccaaatcaacagacacaagaatgccattgtaaaaacacacagccacgcaggactgctgtcctgtcacccacttccacagttagcacacagaggagagtaggcaaagaagttttgcccatcagcattgtggcagatgctgtgtgccccacagcgtcccctgactcccacctctagaattgaaagttgctttctgcaaacaccctagactctgcctgaaatttttttctggccaaacgaggcaagctgaaagctgccccacaaggctgatcttcatcatagatacatgggtagttggtggataaataccttagctccttcactcttcagttgggctaacacaggtacctccaaaaaaattccttttttgtttaaactaattcaaactggctttgtagcccttgtaatttaagagtcccaactaatctcagtgagcttttccacagcatcttctccaggaattgatcagggaccaagatgcccaacacagagtcactgggcgctcagggctctgctgggacagaaaccccaggtaggcccgttgagcaccatgacagtcaatacgccttggctcaagagaacaatgctggcctccctactcccaccattcaaccagaggctcacacttgatggcaagtctctgtggcttctggggctacgatgagaaatgacttctgtcctccaggagcctgcatgacctgcctctgcctctctccatgcttgaggctgccccagcctccccactcataactctgcagactcactgcctttcttccatttctttcaccaggccaggactttgctctcctgggggactttgcagttgctcttccttctgcctggaacatagtccctaagatttttaaattgctggctcattatggtcattcagtactcagcaaaaatgtcacttcctcagaaaggtcttccttgactaccctgtctaaagtggggctgtcactcctgcccccacactctaacacatcactctgttttaccttccaattagcacttgctactgtgagttcatcctgcttatatgtgtgcttatattatcggcctctaacacagctcatgctcccgaagagcagggacttgtctcttatttactactgttgcccccagcaccaagagagcacattataggtgctacatcaatgtgtgttgggtagatgagtgagtaaatgagtggatagaaggaaagagggaggaagaaaggaaggaaaaaagaaaggaagggagggagggaggaagggagaatagaaataagattgattcctctccagaactgcccagatcttacagcttggggctgggttggtcaccacttgagccagaaatgttttcccataaaatacgtatcaatgagaaatgtattaagctgcaaaagtcaactacaatagctaaaatatatgagattctttttctttttttttctttttgagacagagttttgctctttttgcccaggctggagtgcaatggtgtgatctcagctccctgcaacctctgcctcccagattcaagcaattctcctgcctcagcctcccgagtcgctgggattacagctgcctgccaccacatccggctaattttgtatttttagtagagatgggtttcaccatgttggccaggctggtctcgactcctgacctcagatgatccatccaccgcagcctcccaaagtgctgggattacaggcttgggtcaccgtgcccagcctatttttcttacataataagtgtcatgttaggcagttgctagcatcagtttagctgtttaatggtgtcatcagagacccaagctcctttccacttcattatctttagtgtggtggctctcccagatgtgtcttgcctcatggtcacaggatggctgctgcagctcaaacatcacatttacacacaagcagaaagaagaggaagaggtgatgacagctttacctatctaattcctttcaggaaagcaaaagcttttgctgaaaccttccaccaaccacattatatcacattagaaccagatcccatgacatagctacaaggaattctgggaaactgactatatatccctttcagccccgatagcagagaagcaggtgagaaacagggggttggaaacaggtgttctgttgaaccaaattctagtttgtcactgagcatatccccagcagccatgacaactgaaagagggaggacaggaaacatccagtactgaccaaggagggttaacaaggccaccagagagaaatgtttctcacaccgattccagccacatcgacaacttacaatgcagtgagagtgtgctgaacacaatgatttgggaaaacacaccccaggagtactgaaaccaagttgttcttatttcagtaatctgtgggcttcataattaaatgagatgaaataataatggtgggaaaatgtgtcagttttttttttttttttttttagaaaggctaaataactcactacatttagttaggaagttgttacaagctgttaattattttcagactaggtaaaagaaacaaacctgggagatgtgtctggtgtgttaacacatattatttaccccgaggtgacattttaatagcagggaaaacacgggcggtctcccagccctgtgcacattttgccacaagccgctgtgagcgcataaatcctagctctgtcaacagtaatgaggcccagagagcaggcacctgctggggccctgaaattttttctgaggaaaatgtacataattaaggaattgtgagcactcacctctgatttattattaaaacaacacacctagggccacatttgctccctgactcgtcggtgctaaacagacaagtgattaaacatcagcctcacagggggtcccccacactctccctgcaagctttccacatccgggcccctgttcccagagaaggaaaagaaggtgcgtagcagcacggcagtgagggtgggaagtgcgtgctgggaggcctctgctggcccagctctcagaagagcagggctcacggttaacaacactgactgagatgggccacactggattcagagtccatctctaccatctaattcctgtgtgctgttctacttccgaatctcagtttcctcactggtaaaatagagtggacaatggctcctgctttataaggttgcagtaaggattagatatagccctgggcagagtttccagcaaacagtcattgctcctggtcacaggatggctgccaaaacagctaacatatccacattcaaggcaggaagggcgagaagtgggtgacactagccgtatctgtgctattaaatctacccaaccccttgccaacagcagtaggaactgctatgagcttttctgtgctccctaaggcctaggcagtttcttcatggtttcttctatatcctccacctatgaagattctgttcctaaacccactgtctcctgcaggaagccatccctgaccaaatgggagctcggtactatgtcaacctcagtgagagctaccacagtgtatcttcaaatcacagtctctgtggacacatagtgggaggagatggcaagcacccaccaggggggcctttccccagtactttgttatgatgcctaatagatgccatgaaaagacaccagagcgccagtgtaaaagcaagcccacgtgccaggtggaggaggtcatcatggactgctctatcgccagagccagctccccacgaaggaaggagggtgccccaccctgcccgacactgaagccaggctgctcctcacagtgtgtggctggcaagtgggagctggggagattggcaatgcatcagaaagagtctagacgagggcactgcttctgacagaaatcgctcccaggatgctctagacaagggcactgcttctgatgggaatggttccctggatgttcacctgggtaagggctcacaaaggcttctccatctctacctggggctcagggttggtgtgagacagagaaaaacgcatgaggcctgatcctcagggtattgctccgtggtagctgcgtggctcatctcacactgggtagcccaggaggtgagtgctctctgagctggcaggacacaaaggtggcccttcaaaggctgggaagtgagggagggctgctagggacaggagggactggagggacagtgattccaaaaggcaggaggagggctagggaacggaggtaaacatgggcaggctgggtccataacactggatttcctcaactctaagacatcaatttggggatgatctttcaaaactcatgcaaactctcccttaaatgacacaagggtaaagtgcatcttaattccagaatctcctgatgtgggggtggagtcgagagtggccacacctgcatcaggcacttcttgtccccatctctggtgcacgtgtgccctcatctcatcttcacagccaccctatgagggacaccattgccagttctattttacacgaggaagctggaaattggggcttggtgatttggtcaaggccttctgtagccctcgctagctggagttcctgcaaggctcatgggaggcaggggctgtggatggggcaggtccagttgagggaagaagaaaggtagttgcccaggccctggccatcatcatcacccacctgtctcctcctccactcagcaatcagggcaacctgccttccctttgcacttgaagtgaaatccaagcaccttgcacaactgaaaagttcttatcccacacggcctgggccgctccccaccatgtcctttctctcttgaaaagaaaggactcagcctctagtcattcagcccatggcctgctgaccttccaattacagtaacattagtctcctctatttccttcttagctctctgaaattgcctgtttcatttttgtttgcttgttggctccctctggccacacacacactggaatgtgagccccaccacagcaggggcttttgtctttttctcactgttgtacaccttgtgttctccaaatgcaaaagtccaccccacccccagggggtagcatgccttaactttgaaaacgtcacccaaaccagggggcccagtgggacctaagtcagaagcaaacagagctgagcagtgtcccagaggctcgtcctggcctgtgcagatgacccatctctaagcccttcttccctgagaatgagacgcttcctaagtgctcctttcctccctctgctctgcaacttcagacccagttcttctctgtcttgtcctgttaggagtggagctcaggtgcctctccatgtccatttgtcttaccacatcagaggcagcctcttcatcagcgatggcatcccaaggccgctcagcattcccagagtgatagaaactactagaaaagtagttccagaaccttctttcagtggaaagccattggaagcttgtgaccctttcaggacatcagttaacatgtgcttagagaggcctggcctggctcaccttggggtttatgagagaagatgtagtcctgcctttggagaagtcggtctccttagaaaaccaagactggtgcttgcacagctactaaagatgcattcagaattatgttgcctttaaggctaaattgtgaaataaaaacagcaggtggctgaagagttcacaagccacggcgggctggaattgccaggaagggcttctcggaggaggtgggagagcacacagcctcagccctcacagacttacaaggatgaattctctgggagaggaaggtgcttctgagagcataattgaagtcttgatgatgttgaggtttttccaactcgcccataggttttttgttgttgttgttttattttctaatacattttacaactgctacacatgtcgaagtcagagatgaaaacttacatttcccaattaatgccactaaaacgtcattctgacagttccatcaggcatctacagtttcaagcccctcccagcttcggggagctgggagagaagggcaggagcatagcccactcccatgccttaactggccccaaggatgggtggggtttgcaaaccataatcagaagtggagagacaggagtgcttcccgggagaaggaactcaatgggtaaggaaggttccacagatggaaatgcataaggaattcacgggaatcttactgaacatacatggaagcagcaattcctattcaccaagagccctgttgcaggtgctgggggagaagcccccactgctgcagctgtgtcaccgcacagcgtttttctctaattcctctgcaaatgcagaggctccgtcctaagattactactcactgtgattacagacaaaaactctaatgtgcattcgacacttgaaaccctttatttcatcagatcttcaaaacagccccataaggagcagaatctataagctgaagagactgaggctcagagaaattgggtggtttgccctgggtcacacagccagcaaaagcactggactctgcctggcattcttctcttccagccccctcactacgctccccgcagaggcctcatcccgctattctacctgcagtcctcaccagtgtacacactgaatccaagtatcagactgaggaagtaatctttttttatgcagtgtttccccattacaaagtgatattgccttgtcttttcatattccattttccctcaaagctctatcattaaggaatatgttctgacttatccagtaaagtgtttaaccttttttaatgttttattgattcttaaagcttcggttcccccagaagatcctgattgctacattaacaatgtcattgatattcttttaacaggccctctgcaacataaaatgcagcatgggaaagatgagccccaacgacctgttaatcaatgagctagtcttgcatccacctgctgcacgtagcaggagaatgggtggtgagaagatcgactctcaggttccggcaggggctgtgacatccaaggccagacagctgggctgcccgagtgtggagcaaatgccccctttggaggcagttggtggaagaggaaagcatttttctccaggctgctccctccaaccccttacaaccaacctggttttcacaaagccaaattcagcttcaagggcagccatgcattaccctttcagcagagttgagatataaagtcccaatacttttttttcctgagacagggtctcacttgtcacccaggctgtagtgcagtggcacaatcacagccctctgaggtgcaagcgatcctcccacctcagcctcctgagcatctggagctataggtgtgtgccaccatgcctggcttttttattttttgtagagacagggtttcaccatgttgcccagaccagtctcaatctcctggctcaagtgatcctcctgatttagcctcccaaagtgctgggactacagacatgagccaccacacccagtcaagtccaaaatctttagcaaggcatgcaggccctcatgtcctggcttccactccacctggcagcctcatctttcttcactcacccttctctgacatctatgctgcaaccacacccacctaccaggattagggtaaggcaagggaagcactcgcctcaggggcaaaattaaaaggggcaacaaaaaactcagtgatcaagacaaatgttattttaatgcaatattttttaaaaaatcaaaatcagtgcaaaagatccatggttaacagataccagaagttaaaataaagacatgatctgccctgcactcacatgttccagcctcacctgccacagtcgaatcctggccccacctactccttctggtttaccaaactgtactctttctcacctcctgtgccactttccctacctagaagactcccctgtaaatcatccttcaggcatgagctgtgatgtcacccttttcaggcaagtcttccttgacattcacaataactacccacacacgcacatgcacacacctgggactcaagcccctactctgtgctcccgtaacaccctcctagtattcactatatgcgatcacaattgcctggctgtctccctgacccatctgtaagctccatgaaagtggaggctgaacctctactgttgctgtcaccactgtttccagagctggtggcaatggttgggattatggctgcagcgacagctcctctgaaggctgcctgcaccaagtcaggctgggcccacacggagacagatccctgggaagtcttgatgggctggggacctcatgcaggctgctggctcctccacctgaaaccgcatctacagatgctgtgagattagggttgatggacctgaaacactgaaggagacactgacagacatccaggaaacacagaagtttgggtcccgacgtgagagagacagcagcccaaaggaccaggtgtcattttcagggacaggtcagggacggctattttttttttgccagcctttctctgggtggtctgtgcctgtccatttattcttgctgggatattttctgtctcgcagtggtagtggtgaggcagtcgtgacaaggagcctggctgggtggggggagacagagtcagatgcaggtagaccagcaggccttgtgcattccccgcttccccagcccacctccctcccactcctcaggtttgggtgattacagccaaggatgacagctcttgaaacggagagggactaggacaaaagtgccgagactttaataagataaggtgggaagtcaaagggagaatggggctgataagcctgggccatctctaccacaaagcaccaccccttctcctcctaaatcgcctgcccctagtcctcctaccaaccccttgctaaatttaccagaagagacatgagctagggcttgggctttagcccaatatatactccatggtattcacttagcagccaaggtggctgattaccccagggaaatatgaactctgggaggaaagataacgagacaccgaaggatgttcctccataaaagaaagagtatgacacccaacaacctgcactccactgacaaagactctctcctcagccaatctccagccaggctcctctgaaccctcttctcgtccaggcctcaaccaaacgctcacagggtttcttttttcttttcttttctttctttttttttttctggggatggagtcttgctctgtcccccaggctggagtgcaatggcatgatctcggctcactgcaacctctgtctcccgagttcaagcgattctcctgccttagcctccccagtagctgggattacaggcacccaccaccatgcatggctaatttttgtatttttagtagagatggggttttgccacattggccaggctggtctcgaactcctgacctcaggtgatcctccagccttggcctcccaaagtgctgtgattataagtgtgagccactgcgcccagcctgttcacagggtttctaacagctcaaggccatatccctaggatgaccctgggcccacttaaagtgcccacctgagaaaactcaaggctgccaaaaagatttactgtttttttcagccaacacctgaagacaatatagagtctctgtctcccgctctctgaggaaggacaggatcctacctcagtaactgccagcctcagccacaggtgacctagttgcatttacacagtctgcatttttcacttccctaactctgctaagcttctgctttcccatccctatgccctctctgtctcttaaaacacctgttcccctctgcacaaatcaaagaatcattcagttcttgcggaactcttttccctactgcaatagttattgctgattaaaatctggcctcaccactttaatcagtgtccagctttgtttatcgttgatattcagaataatttatgacaagcataataaataaacacaaaaacatgaaaggctactgactaagccattataaacaagatctaattagaaatttggagaatggaaatgagaatgatggaaatatagagctcaatagacgggctgatggtagagtagaggggcagtgagtcagaaggccatgtgtttcttcaaaataagacccattgatcagcatcccctgggaactcaccccagaccgcctgagttagattgtgcctttaacactactcccgggtgaagtgtatgcacagtaaagtctgagaagcagtgatatggttctcagccttgactgcatactggagggatctgggagctttaaaaagtacttacactttggtccttactgtcagagagcttctgagtaagtagcttggggtatgaaactgtaaacgttcccctggtcattttaacgtgcagccaagtttgagaaccactgacttagactcttagaaaagggatagggatgcaaaatgtaaaaattacaggatgtggggcacagaattagaagaatcaacatatataggacagaagtcctacctggagagacaaaagaaaaaggagaagagggaatactttctgcaaaaaaaaaaaatgactgaaaatttccaagaataaaggaaatgttcaagaccgtatgatgatatattgaaagaactcatagagtgccaataaggaaagatttttaaaaattcacacagaaaaatataggctgagtgtggtggctcacgtctataatcccagcactctgggaggccaaggtgggaggatcgcttgaagccaagagtttaagaaatattacattgatatttgggaatattaaggacaaagagaaacctttaaaacttcagagtgaagaggtagataccaagacaggaaaaagaactaaatgacagatgtctcaacagccacacccaaatgtcattttggtcttttcatatatttaaagtagtgaagagaaaaaaaaattaactcagcatttcttatccagttaaactatcatttaaaaatgagggtggaatatccacagtggtacaaggcctcagagggtttgccataaaagaccacctctgaaccacctgtgtcagtccgggtccatgggtgaaacagagctggaagctcaagtgctgcagtggggaaatggaggagaaagatcaggcaggggcggcaggggagcagctcacagactgttccttcggcccaggctccaatatggctcagcacagtgctgttgctgatgccggctttatttaaatatgtgagatttgattcattatggattttgcattaattttgatttttcaatattatttgtctttgattgctcagttttttgatacccccttaaattttgctcctgaggcaaatgccccacccacctgaccctctaggcctctacgatagggatatttgcaaaaaaaccacctcagttaatcaatgctccaacccaggcaccatccaggttcatggttcttctctggttgtgaaaattaaaaaccgggccaccacccacttctcagccttatccccagccagccagcagagcattgtagaatgtgagcttgcattgtgaacactctgaaaatgtaggccagagaaccttctggctggagatggctcctgctgcgagaagggaatatgacagatagcataagatattacagtaattttactgacaaagcactaagcatatcacaaaagaagttcaaaatcaattcatctgcttccaagcagaagcgagtctaacaggcagtgaagcatcatcttgataatgtagttgttccaaaagaagaaggaattaaccaggctaccctaaatgtgtctgtatgacatgcttttttgtttctgttaccctgataaggacttaaaattccatttgtatggaaataaactaagcttccgaagttatcttcctgttccggggagttatctcaggaggtttgctgcagaatttttctctgactaaatgggatcttaggctcagaggctgcaaggtttcagcttttgttgttaaatagtaaagcacactctacttccagccactacaactgtgcttctttaagggcggtatccattaaggttgtttgattacaaacaaagaaaactggctctaagcaacttgctatccttccaacaagttctttttctacttaatattaactaaagaatcagctgagcaggttaaaattagaatgggaaccgtgcagcgcattgggtggtagaaaatagttgacaactctctcagagtttattcattccaacaatagaacccgctgcaaccattcttttctgcattctctacaattttttcattttttttttagtatgatgttttgctatctagcattctcccctcaagactgaaagtcccaagaaaatgagtccaattgtccatgcttgagtcatatgcccatgctagggtgacaatctcaccaagatgttccttagtgagtgaggaaagtttgccaaagagacatggcagtgctgttccaagaaaagaaagagctgggtgctgggtgggcaaggaccacagaggaactaagaagagaggctatttctcctactgtcccatctccaaagaaaaggaggaagtaaaaaccgaaaaataacagactgattggcgccagtggccaggcctgtaggttaaagattaaaccccacccaaaccgcttgtgctatctatagatcacagacaacggtatgaagaaatacttgcattgctcaccacccccacctagtcacgtaccccatgcttgctggatctatcatgaccctttcacgtggaccccttagagtcgtaagcccttaaaagggccaggaactctttcttcggggagcttggttcttgagatgcaagtctgtcgacgctcccagcagaataaagcctcttccttctttaacctggtgtctgaagggttttgtctgtggcttgtcctgctacatttcttggtttcctgaccgggaagtgaggtgattaagggacagtggaggcagccccttaggcggcttagccttgccctgcggagcatccctgtggggtactccggccagcttgagcaatgtggatcctgagagtgctcctgggtaggcatttgccccagtggaatgcctcatcagagtggtgcatggcaggcccccacggaggatcaacacaggggctgaacactgggaaggaactggcacgtggagtccggacatctggaatatggtaggaccggtcccaggaacttacccaccccatttgagtggaagcatggcctgatcacccatggtgtgcccttattggcactttggtctcagttttgattttgatttggctcggcttgtttgaaaaaaaggaaagtgaaagtgagtgaatgcttgtttgggatgggcaacagatagacagtggttgccgtccgaagtgagtgttgagccctgagctgcagttccgtaggatacctcgtacagctaagtggcggttcgtgctggtgcctggtaccagcctgcctaagaggatctgagattcccgcaagggaagtggccagtgtcaggcgaggcaagtgagtgacccctttaccctttcccttcttgtgttgtgagcattgtttttgtctggcgggggtgagggtggtggagatgggtgagacgcaaagtaagcccactccattaggaactatgttaaagaatttcaaaaaaggttttaatggagattatggggttaatatgaccccaggaaaacttaggaccttgtgtgagatagattggccagcattagaagtgggttggccatcagaaggaagcctagacaggtcccttgtttcaaaggtatggcacaaggtaactggtaagccaggatacccagcccagtttccatacatagacacttggttacagctggttttaggccccccatggtggttaagaggacaggcagcagcagtactaatggcaaagggacagacagccaaggaagaatcctgctccacccgccaagggaagttggctcctaaagtcctgtccgacccaacatcagagaattcatggcaagaaatggtgccagtagcccccctctttcaccaagaaggaaggcctccccctcctgagtccactgagcctgagcttccacaagacctacgtacccctaggccacccagagtagaaaagaaaggatgcgagaccttgggagaaacccctcggttggcagcccgtttgaggtctagaactgggatacaaacgtccctgagagagcaatggtatactggggtagacaaggatgggcatatggtggaaaggcatgcctttgtgtaccaacccttcaacgctgccgatctcctcaattggaaaaacaataccccatcctatactgaaaaacctcaagctataattgatttgctccaaactattatccagacccacaacactacttgggctgattgccaccagttgctcatgtacctctttaacatggatgaaaggcgaagggtgctccaagcagcaactaagtggctagaggaacatgttccggctgattaccaaaaccccaagagtatgtgaggatccaattaccaggaacagatccccagtgggactcaaatgaaagacagggtatgcaaaggctaaactggtacagggaagcccttctggaagggttaaaaaaagggagctcaaaaaaagggagctcagaaggccacaaatgttaacaaagtctctgaggtcattcaaggaaaagatgagagtcctgcacaattttacgagagactatgtgaggcctattgtaggtgtactccctttgatcccgacagccctgaaaatcagcgcatgattagcatgactttagttagtcgaagtgcagaagacattagaagaaaactacagaaacaggctgggtttgcaggcatgaacacttcagttattggagatagccaaccaggtgttcgtgaatagagatgtggtaagctgcagagagaaccgcagagagagcgaacgccaagcctggtgaaataccaacctgctagccgcagctattagaggggtccccccaaaggggcgagagaagggggccccgggaaaaatacccagtctggccatccacgtttgcagtgtaaccagtgtgcttactataaggaaatagaatattggaaggacaagtgcccccagttgaaagggaaacaaggtggctctgagcaggaggcctcagacaaggatgaagggaccttgttcaatctggcaggagggttaccggactgagggggaccgggctcatgtgcccccaaagagcccatggtcaggatgacagtcgggggcaaggacattgggtttcttgtcgatactggtgctgaacactcagtagtaaccacccccgtcacccccttatccaaaaagactattgatataattggagccacagggatttcagcaaagaaacctttctgtttccctcggacctgcactgtggaggggcataaggtaattcaccagttcctgtacatgcctgactgccccttgcctttactgggaagggacctacttagcaagctgagagtcactatctcttttataaagcacagctctttacagctaaagttacctagaatgggagtcatcatggcccttatagttccttgggaggaggaatggagactcttcttatctgagccaggccaagagataggacaagctctggctaagcggtgacgaacagtgtgggtggaagataaccctccagggttggcaatcaaccaggcccccatactcatagaattaagtctggggcccagctggtcaggcaaaagcagtaccaggtccccagagaagcccttaagggcatacaggtccatctcaagtgcctgagggcctttggaattatagtcctttgtcagtctccatggaacactcccctcctacctgttcccaagccagggaccaaggactacaggccagtacaggatttgcgcatggtcaaccaagttacagtgactttgcatccaatggtacctaacccgtacacattgttggggttgctgccagctgaggacagctggttcacctgcttggacctaaaagatgctttctttagcatcacactagcccctcagagccaaaaactgtttgcctttcagtgggaggatccagggtcaggcgtcaccactctgtacactgggacccagctcccccaagggttcaagaactcccccaccatcttcggggaggcactggcttgagacttccagaagtttcctgccagagacctaggcagtcaggtgcaccaagggaatggataccctgtttcggcacctggaggactgtgggtataaggtgtccaagaagaaagctcagatctgcagacagcaggtacgttacctgggatttactacccaacagggagagcgcagcctgggatcacaaagaaagcaagtcatctgcaacctgctggagcctaagaccagaaggcaggtgagagaattcttaggagctgtagggttctgcagctcctaagagctgtggatcccaaagtttgtggatctcaaattttgcagtattggctaatcccctgtacggactcacaaagagaggagataaggaaactttcaaatgggggtcccaacagcaacgagcttttcatgagttaaaagagaaactcatgtcagccccagccctggggctacctgacctaacaaaaactttcacactgtatgtgtcagaaagaaaaaatgacagttggagttttaacccagatggtggggccctggccaagaccggtagcctacctctccaaacagctagatggagtttctaagggttggcccccatgcttaagagccttggcagcaactgtcctgctaggacaagaggcagataagctaactcttgggcaaaacctaaacataaaggcccccccatgctgtggtaacactaatgaacaccaaaggtcatcattggctaacaaatgccagactgactaggtaccaaagcttgctctgtgagaatctctgcataaccattgaagtttgcaacaccctgaaccccgccaccttgctcccagtgtcagagagcccagttgaacataactgtgtagaggtgttggactcagtttattctagcaggcccgacttccgagaccatccttggatgtcactagactgggagctgtacgtggacgggagcaactttgtcaactcacaaggagagaggtgtgtgggatatgcagtggtaaccctggatgctgtcattgaagccaaatcgttgccccagggcacttcagcccagaaggccgaactcattgctttaattcgggcctcagagctaagtgaaggtaagactgtaaacatttacactgactctcagtatgcctttttaactctccaagtgcatggggcattatacaaggaaaaaggcctattgaactctgggggaaaagacgtaaaatattagcaagggatcctgcaattattagaggcagtttggaagccccaaaaggtggcagtcatgcactgcagaggacgccagtgagcttccaccttgatcaccttggggaactcctgagctgactcaggggctcaaaaagcagcatccaccccctcccgggcatcagtcacagcccccctgctccctcaggcacctgaccttgtacctacttactctaaagaagagaaggactttctccaggcagagggagggcaggtgatagaagagggatggatccggttatcagacggaagaatagctgtgccacaactgctaggagccgcagttgtactggctgtgcatgagaccacccacctaggccaagagtcacttgaaaagttgttaggccagtacttctacatcttgcatctgtcagccctggccaaaacagtggtgtagcagtgtcacctgccggcagcacaatgctaggcaaggtccaactgtcccacccggcatacaagtttatggagcagcccccctttgaagatctccaagtaaacttcaccaagatgcccaaatgtggaggtaacaagtatttgctagttctaatgtgtacatactctgggtaggtggaggcctatccaacatggaccaagaaagctcgtgaagtaacccgtgtgcttctccgagatctcatccctaggtttggactgcccttacaaatcggctcagacaaccggctggcgtttgtggctgacttggtacagaagagagcaaaggtattgggatcacatggaaactacatactacctactgaccacaaagttctggaaacgtggagtggatgaatcagactatcaaaaatagtttaggtaaagtgtgtcaagaaacaggattaaagtgggtacaaggtctccctatggtattaagattagatgtaccccttctaaaagaacaggatattccccttatgaaatattataccataggccccctcccatactacagggactccgaggcactcctcgagggctaggtgaaattgagttacagagatagctacaggctttaggaaaaattacacaaacaatttcagcctgggtaaatgagaagtgccctgttagcttattcttcccagtttaccctttctctccaggtgatcgggtgtggatcaaggattggaacgtagcccccttgcggccatggtggaaaagaccccagaccatcatcttgaccactcctacagttgtaaaggtagagggaatcccagcctggatccaccacagccatgtaaaacctgcagcacctgagacctgggaagcaagaccaagcccagacaacccttgcaaagtgactctgaagaagacgacaaacccttctccagtcacacccggaagctgactggtccacgcatggccaaagcataaggaaactcaccatgagactcattttccttaaattttgaacttgtacagtaaggacttcaactgaccttcctcagactgaggactgtacccagtgtatacatcaagtcactgaggtaggacaaaaggttgttgcagtcctattattttatagttgttatgagtgtaccgggactctaaaaggaacttgtttgtataatgctactctatacaaggtatgtagcccaggaagttaccagcctgatgtgtgttataacccatctgagccccctatgactaccgtttttgaaataagattgaggactggcagctggggaaaagctgatatgagtaaataactggaacagaagagaaaggagccccaaaaaaattatcttaaaatttgatgcctgtgcagcaatcaacagtgacctgtatggaaataggataagatgtggctctctagattgggaaaggggctatatagtagaaaataagtatgtttgtcatgacttaggaatgtgtagtgatgaatgtagttactggtcctgtgtcatttaggccacctggaaaaaaagataagagggaccctgtccaccttcaaaaaggaaagagtaactcttcctgcactagtggtcattgtaacccattagaactactaattaccaatctccttgatccctgttggaaaacaggagagtacgtaactctaggaattgagggaactggactggatctccgagtaaatattttaatccaaggggaggtccacaggtgctttcccaaaccagtgtttcagaccttttacgatgaattgaatctgccagcaccagagcttccacacacacacacacacacacacacacacacacacacacacacacaaagacaaagaacttgtttctccagttattaggaaatgtagctcattccctcaatgttacttcctgttatgtatgtgggggaaccactatgggagaccaatggccttgggaagcccgggaattggtgcctactgatccagttcctgacataattccagtccagaaggcccaaattagcaacttctgggtcctgaaaaccttgattattggataatactgcatagctagagaaggaaaagacttcaccatccttgtaggaaggctcaattgtctaggacagaagctgtataacagcacaacagggacagtcacctggtggggtctaaaccatactgaaaagaatcccttcagtaaaattcctaaattacagactgcttaggtccatccagaatctcatcgagaccggacggctccctctggactatactggatatgtagacacagagcctacactccgtcacctgatcaatggggaagtagttgtgtcattggcaccattaagccatcccttttcctattgcccgtaaaaacaggtgagctcctaggtttccctgtctatgcctgagaaaagaggagcatatctataggaaattggaaagatgatgagtggccccccaaaaggatcatacagtactataggcctgccacacgagcacaagacggctcgtggggataccgaacccccatctacatgctcaaccagatcatacggttacaggccatattagaaataatcgctaatgaaactggcagagctttgactcttttagtccagcaggaaacccaaatgagaaatgccatctatcagaatagattggccttagactatttgctggcaactgaaggaggagtctgtggaaaattcaacttgaccaattgctgtctacaaatagatgatcaaggacaagtagttgaaaatatagagacatgacaaagccagcacatgtgcccatgcagatttggcataggtttgatcctggatctttgtttggaaaatggtttccagctctaggaggatttaaaactcttgtaataggcataataatagtgttaggacctgcatgttactcccctgtatgttacacatatttctccagttactaagaggcttcgttaccatcttagttcatcaaaacacctcagcacaagtatacatgaatcactattaatctgtctcacaggaagatctagatagtgaggatgagaatgagaactcccactagtgagtgaggttctcaaagggggaaatgaggagagaggctatttctcctactgtcctgtctccaaagaaaaggagaaagtaaaaactgaaaaataacagactgattggcgccactggccaggcctgtaggttaaagattaacccccaccccaaccgcttgtgctatccatagatcacagacaatggtatgaagaaatacttgccttcctcaccacccctacctagtcatgcagacaatggtatggagaaatacttgccttggtcaccaccccatctagtcgcgtaccccatgcttgctcaatctatcacaactttttcacgtggaccccttagagttgtaagcccttaaaagggccaggaaccctttcttcagggagctcggttcttgagatacaaatctgccaatgctcccagccgaataaagcctcttccttctttaacccggtgtctgaagggttttgtctgtggctcgtcctgctacagaaccaattcttctcaagtcagatccacacttttatgaacactgaagttctgaagtttcccaacaacaaaatgtttggaaaatgcactttgtacagtgtctgatacaacacgcaaaatcttatcatcttcaccatcatcagctaatgttattacttagaaaatctggccgagtattaataaaggtggggtgtttactgtgggaaagtgaaggctgtcttgaaatggcttttttctcaatagaagaaataaaaaagggtggctgagagtggtggctcatgcctgtaatcccagtactttgggaagccaaagagggtggaccccttgagctcaggggttcaagatcagcctggacaacatggcgaaaccccatctttacaaaaaaatacacaaattagcttggtgtggtggcttgtgcccatagtcccagctactcatggggctgaagtgggaggaatgcttgagcccaggaggggatcaagaggttgcagtaagccaagattgtgccactccactccaccctgggcaacacatttagactcagtctaaaaaaaaaaagaaaagaaaagaaagaaagaaaatacaaaagcgatgaaactggttattgttggtatccgcttctagagagccctggattcctgctgcagcctgtgggtcactgccccgccacacaaaggaccatgtatccattaggcaagatgggcacacacttaggggcacacaagattttttaaattagaagaaaaaaaatgaatgtttaaattgaagaaaatgcataatggtatatatttgtctttataccaaagcagttgcaaaatttaaccacaaaagtcataatgtagccccaagtcaccccccacccaccgtggaatttgtatgctctgtacaggagagcaagggctaactttactcccattcctgaccaatgatcttcctccagctcacatgggaccttgctgaatcatccccagtgcttttctctgaagtgggatctaaagttgttcacaaattctgcattcttttcttttctaaaaactctacttctgtgacagactacaaatcctgcactctttattcaataaatattaatttagtatttagtattacacatgcagacgctctgcaaaatactgggacaaaattggccaagacaggcttagtttttgtgcttatggagattaaagtcaaattgtagaaacatgtaatcaatgtgcttatcttactgggctgtaattacttagtaagtagaggaatatatatctatgtctaagattttctacatttacactgatcatagcatatataacctaccccctgaacttgacatttgcacacacacacacaaacacacagagttcagacaaatatgttgtctcttcttctgtaacttttcccccaaatgcctatcctaactacccccatgaagtcccctgataaaaacccttattcaaacaagtccagaagacagaattctcattgggacccccaagaacagaggaaagaatagatgaatggatggtgttaaattaatatgttaagaccctaccccccagatggatggtattaagacagtgggtctttaggaattaattaggtcatgagggtgaaactttcatgatgaggtagtgccctataagaagagacatgcaacagcttcctctccacaatgtaagaaaacctggaccctgctggcacactaatcttggacttctcagactccagaactgtgaaatgtttgtttaagccacccaatctataaggtacttttgttacagccgcccaaacaaactgagacaaatggatggatggatggatggatgaataatagactgaatagaggaataagaggtggacgggtggagggaagaaataacaaggatgaaagaagatgaacagagagatcgaggagtggatgcctagataaatacatacataaaagaataaaaagaagatagaaaatgaaagaaaaaaatgaataactagaaagatggataaattaatatacatatagaactttgacagtagggataaataaatgggtagaatcccagcactttgggaggccgagacgggcagatcacgaggtcaggagatcgagaccatcctggctaacatggtgaaaccccatctctactaaaaatgcaaaaaattagccaggcgtagtggcgggcgcctgtagccccagctacttgggaggctgaggcaggagaatggcgtgaacctgggaggcagagcttgcagtgagccgagactgcaccactgcactccagcctgggcgacagagccagactccatctcaaaaataaataaataaataagtaaaaaaatgggtagatggaaggagaaagcaagaactgatttggggaaaaagggaatgaagggatgtgtgaatatatatattatttaaaaaattatagagaattcagtaagcatgaacataagggtgaaatgagtaaatggatgaatagatggacaattagataaatgaacatagtgatgggctactaaatgggcagatggaagaatcaagtaatgcggtaagaagggatagatgtagggaaagtcgagctgatatttggaagggcagatatatagatgaataggagggtgatgcaagatagatacactgatgactgaatggataaatgaacacacaaataatgggtggccaaagtaacacggtagaaatagacggagtttcatttggtcaggtacagggaatggtagatttgtgggtacatgaatttatgagtggattgcatgaataactggatgagtggatagatcaatggatgatgaattggtgaatgaagattcaataaacaggtgggcatatgagcatatatgagaagatactgtatttaatgtgatatactagaatgtggaacacaaagtgttatgttatagcttggcctaatcctgctttcaactctttggggtctgactgcctcagaaaacatctgaggtaattagctctgtaaaaccttgaaagcagatgttcatttggactgcagtgacacaggaagattttatagggagggtggcatattcaccaaagtgaagaaaacatggggctgaagggagctgagggccccatcttttcctcctcaggatgaagaagtcctcacctcctatttctctgagacaatttgtctggcagagattatcactgacaaattgtttgttgttaattaaataacaaaacaggtggggtgggaagatattctgcaagttctcagatattccctttttggttgtggcacatatgtatgtattcatccagttagattcctgtttagaagggcctgctctgtgccaggtcctgggcatgtccccatgtggatgacaggaaagagtaagacaatcactgcactgcactgagtcccagagcctctacacctagcagccacatgaccctgggcatgctccctatctcatgtcattgtcatagcaaccccatgaagtaagtactacgaccatccagtttcaaagacgagaaacctcaggcacaatgggattggaacacataaaacactccctgtataacaggcgctgttttaagtgtccaaaaacattagatttttttgttacttgctgtaggttacaaaattcgtcccaatcccccactctctccctgactttgtgattttgtaatgtcactgcagcaattcccatcaagagatggcatctatctccttaattcttgaatcagatctgactttagccaacagaatgtgggagatgtgatgttgtgccaattccaaacctaagcctcaagggacactgagggtttttctgtctcttggaccctgatgttgccatgtgaaaaaattcaagctagctcctagaggatgaaaggttttatggatgagaactctggacaaccagtgacaaatagctaacttccagacctgggagtgaaagccttctagaccagtcagtccccagatgaccctcaactgactacaacatgtaagtgagcccatctgagatcagctaagctttgcccagataagcagaactgcccaactgctctccagactcgtgagctagactcatggctgttgttttaagccactgagtttggagtgatttgggagacatgacaggaacctataaaggccacataagtttgaaagagagataaacttaaaatgaccaagatacgaatatatgggagcacaaaaaaaggaaggaattctcctccacaagggaatcagtgaggttcctggagagggtgaagttgggatcaagccttgagaaaagtagagtcaagtttctgccaggagtgtctgcagggaaacctaagcgccaaaaacccacccaagagcctcagacaaataggtgagtcgggctttctcccagccaccagaatcaagacttgtgtaggcaacaagctggtcaggacaagcagcacaacatctctacttcggggccagactgctggacatcaagctacaatctaaaacacccagccaggggctacgccctccatctccctgcttctctcacccctgcactcaccaaatcccttatcctcccatactcccatcagcattcataacagctcctgtcaagagccatgcgctccagactcagggaaatgctcaaagccatgttcagtatcaaaatgagacagaagaaattatgtttaattcaacaaggaagcaactggctttggagatgagatgcggtgggcaagaagacgggggtagctgccagctgcagttaccacaaacaggtgctctgtgtgcagtatataccatacaccagccacggggctactgactctctgggaaggaacacacagccagctactgaatgggcagctgcagagggagctaggcatgatatctaaactggctttgatcaaaaagatatacatactcatagtttaagaatcaagtacacttacaagacttgctacaaaaatagcagccttctgcctctctctattcctcccaccctcaactcccagagacaaccacttgcaacgtttagctgattcatctgatattaccttgatatctctgaaatataaaaaaggaccaatatagtgtgcttttagttttaggtatcatctctgatcttccataattggaacattcttctttcacagctcccctgcccccaccataccttactttccttcctgccagctttccaacgtgagtcttcttgaaagaatctctccagaccattcgacttgctccagtctggaccaatcaccctcatatctggtgcacagctgttgccctggggtctcccttcattctctacctgagaatttccttcacaactctcttcagttagatatcctgcatttccattctctgtttttcacactcccctgatttaaaccctacttttggtggagcacatctcctaataatttgatatcaaagagtacatgagactttaatgtctaagaaagccattattcagtccttacatttgcttgatagcttggctggatgaagatttctaggctgaaaagtatcgtccttccaatcttccaaggcattaaaccaacactgtcttctagcttccagtattgctgctgaaatgtttcaagccattctgtttcctgatcctttgtatatgacacatctttttttccttcctggaagcttctagtatcttccctttgtccttcgtataataaaattttatcatacaacaaaaaagctataaaaagaaacattcagagaacaagaaagtattgaacattaaaaattgtagaacatgaataaaaattcctaccgaagtgttggatgacaaatatttaaaaatctacaataaaggtcaggcacagtggctcacacctgtaaatcccagcactttgggagactgaggcaggtggatcgcctgagatcaggagttcaagaccaacctgaccaacaaggtgaaaccccgtctctactaaaaatacaaaaattagttgggcatggtagtaggtgcctgtgatcccagctactcgggaggctgagaatagcttgaactagggaggcagaagttggagtgagccaagatcgcaccatcgcactccaggctgggcaacagagcaagactccatctcaaaaacaacaacaacaacaataacaaaacaataaaacagagaggaaaggcaatctgaggacacttctggttgtgctgacttctttcatgtaacaggctttcctcagctgtctggagatcctgagctgtctgtgtaatttaaggtcaggacactaacacactgattggaggctcaatcgcttgatgagatctatcaactatgggctttaccagagaggagtcatggggcattcccttaaagaacctccaatatcagtatctctggggaaacccaccaaaaagagagacctaaaaatttctctaaacccctgcctatagagtacaggcctggcagtcagcatcctggaagctgagtgtgagaagaaaaccaggggtcattcaatatagaaatgtttatataaccccattttcagtacagcatccctgctgtctttcatgcctagtgtttcatcctctctgagaaaatatactttctgctttttcaagcctcatctttacctccacttccagaagtacctggaagtgccaatttccgagcctttagtggttcttcagtgtaaatcaggttgcttctcagcagaccagagaaagctgactcctaagccagagtggggagaagcaatcagttcccacttgtccatgtgcttttcaactccccaaatttccacgtttttgtttcctctccctttttatgagtttacacatatctatattttaaatcttcttactttctgtttacgctcagaactgcactaatatgctagttgatgtatacattcaatgtttacgctcagaactgcactaatatgctagttgatgtacacattcaatcagccatctatacctagaacctaagctggctttcaaccaccaaagaaatccatacttcccttttagtttcctaagaccaaccaaatacccttcctatggaaccataaaagagagaaaagttcccacaatatctcactctgggccgtagtagatgataatagctattgtttgggactgcccagctccattccctttctgtggttgggcatataatccacaaataatcaatcatagcatctcattacccagggcagtgattggctcaggagtggacatatgattcaaccaagaccaatcaacatcctttcctgggacaaatatacagatgttgggaagagcaactgcaatataaaaagagtttctaagatgaaaagttgttaatttggggctgccaggggctatcttttcaacacatagaaaacgtctatctataatgaggaaaaaataaagccaagcagagatgtgtgagagagaaagtgcgtccaaaagagaggcaaagagaatgctgatggcatgcaaagagcaaaaacagaaagagaaggggatctggaataagatgaaaagaattttgtagcatggacatggagactggaaacagattttttagaatgggaaacaggggaagaagcacaaaactaacaacatgaaaatagatgaaagtataaaactcactgtaaaggtaaaaatgtagtcaaattcagaatactctaacactgcaatggtggtggatacataatttttaactctagtgtaaaaatttaaacacaaaagtattaaaataactatagctacaataatttgtcaatgggtatgtgacatataaaggtgtaaattgtgacattaatataaaatattgggggaagagaagttaaaagtacaaagcttttgtatgaaatgaaagttaaattgttatcagcttaaaacataatgtcttaactataatatgatttaggtaagccttgtggtaaacacacacacacacacacacacacacacacacacaaaaatctgacatagatacacaaaagataaagagaagggattgcccctacaaaaagtcatatcacataggaagacagcgagagagaaagaatggaacaaaggaagtacaaaatagtaaaaaaaaaaaaaaaaaaaaaaaaaaaaaatggcaatattaaaatcttacccatcaaaaattagtttatatgtaaatggattaagttctctgatataaaaatacagagtggctgaatgaattgaaaaacaagattcagataaattctgcttaaaagagacagtttagctttaaggactcaaagacctgacttaggctttcagtccatgcctgaaagggatagaaaaatatatttgatgaaaatgatagtcatgaagtccttgcccatgcctatggcctcaatggtattgcctaggttttcttctagggtttttatggtttttaggtctgacatttaagtctttaatccatcttgaattaatttttgtataaggtgtaaggaagggatccagtttcagctttctacatatggctagccagttttcccagcatcatttattaaatagggaatcctttccccattcttgtttttgtgaggtttgtcaaagatcagatggttgtagatgtgtggtgttatttctgagggctctgttctgttccattggtttatatctctgttttggtaccagtaccatgctgctttggttactatagtatagtttgaagtcaggtagcgtggtgcctccagctttgttctttttgcttaggactgtcttggcaatgagggctcttttttggttccatctgaactttaaagtagttttttccaattctgtgaagaaagtcattggtagcctgatggggatggcattgaatctataaattaccttgggcagtatggccattttcacgacactgattcttcctacccatgagcataaaatgttcttccatttgtttgtgtcctcctttatttcgttgagcagtggtttgcagttctccttgaagaggtccttcacatcccttgtaagttggattcctaggtattttattctctttgtagcaactgtgaatgggagttcactcatgatctggctctctgtttgtctgttattggtgtataggaatgcttgtgattcctgcacattgattttgtatcctgagactttgctgaagttgcttatcagcttaaggagatttggggctgagacaatggggttttctaaatatacaatcatgtcatctgcaaacagagacaatttgccttcctcacttcctaactgaataccctttatttctttctcttgcctgattgccctggccagaacttccaacactatgttgaacaggagtggtgcgagagggcatccttgtcttgtgccggttttcaaagggaatgcttccagtttttgcccattcagtatgatattggctatgggtctgtcataaatagctcttactattttgagatacgttccatcaatacctagtttattgagtttttagcatgaaggctgttgaattttgtcaaaggccttttctgtgtctactgagataatcatgtggtttttgtcattggttctgcttctgtgatggattacatttattgatttgcatatgttgaaccagccttgcatcccaatgataaagctgacttaatcgtgtggataagctttttgatgtgcttctagattcggtttgtcaatattttattgaggattttcacatggatgttcatcagggatattggtctaaaattctctttttttgttgtgtctctgccaggctttcgtatcaggatgatgctggcctcataaaatgagttagggaggattccctctttttctattgattggaatagtttcagaaggaatggtaccagctcctctctgtacctctggtaaaatttggctgtgaatctatctggtcctggacttttcttggttggtaggctattgagtattgcctcaatttcagagcctgttattggtctattcagagattcaacttcttcctggtttagtcttgggaaggtgtaggtgtccaggaatttattcatttcttctggattttctaatttatttgcatagaggtgtttatagtatcctctgatggtagtttgtatttctgtgggatcggtggtgatatcctctttaccattttttattgcatctatttgattcttctctcttttcttctttattagtctcactagcggtctatcaactttgctgatcttttcaaaaaaccagctcctggattcattgattcattcaaagatttaaagtgtcgactttaaatctttcctgctttctcttgtgggcatttagtgctataaatttccctctacgcactgctttaaatgtgtccctgagattctgctacgttgtgtctttgttctcattagtttcaaagaacatctttatttctgccttcatttagttatttagccagtaatcattcaggagcaggttgttcagtttccatgtagttgtgcggttttgagtgagtttcttaatcctgagttctaatttgattgcactgtggtatgagagacagtttgttgtgatttctgttcttttacatttgctgaggagtgctttacttccaactatgtggtcaattttggaataagtgtgatgtggtgctcagaagaacgtatactgtgttgattttgggtggagagatctgtagatgtctattagatccgcttggtgcaaggacttcatgactaaaacaccaaaagcaatggcaacaaaagccaaaatagacaaatgggacctaattaaactaaagagcttctgtacagcaaaagaaactaccatcagagtgaacaggaacatacagaatgggagaaaatttttgcaatctatccatctgacaaagggctaatatccagaatctacaaagaagttaaacaaatttacaagaaaaaaaaactgcatcaaaaagtgggcaaaggatatgaacagacacttctcaaaagaagacatttatgcagccaacagacacatgaaaaaatgctcatcatcactagtcatcagagaaatgcagatcaaacccacaatgagataccatctcacaccagttagaatggtgatcattaaaaagtcaggaaacaacagatgctggagaggaattggagaaataggaacgcttttacactgttggtgggagtataaactagttcaaccattgtggaagacagtgtgacgattcctcaaggatctagaactagaaataccatttgacccagccatcccattaccgggtatatacccaaaggattataaatcatgctaatataaagacacatgcacacatatgtttattgtggcactatgcacaatagcaaagactggaaaccaacccaaatgtccaccaatgatagactggattaagaaaatatggcacatatacaccatggaatactatgtagccataaaaaaggatgagttcatgtcctttgcagggacatagatgaatctggaaaccatcattctgagcaaactatcacaaggacagaaaaccaaacactgcatgttctcactcataggtgggaactgaacaatgagaacacttggacacagagcggggaacatcacacactagggcctgtcctagggtagaagagtaggggaggaatagcattaggagaaatacctaatgtaaataatgatttaatgtgtgcagcaaaccaacatggcacatgtatacctatgtaacaaacctgcacattgtgcacatgtaccctagaacttaaagtataattaaaaaaaaaaagaaaatgataaacaaaaaagagccagggtggctatttttatatcagacaaaatagactttaagtaaaagaaaatgtcacaagagacagagaaggtcattatataatgataaagtggttaattcatcaagaggatatatgaattgcaaatatatatgcatattgggtgcacattggagcacctattaaataaaccaaatattaatggttatagagggagaaatagacaacaatacagtaatagtagaggattcccattttctttctttcttcctttttttttttttttttgagagagtcttgctctctcaaggtgggagtgcagtggtatcatttcagcttactgcaacctctgtgttccaggttcaaaggattctcatgcttcagcctcccaaggagctgggattacaggcatgcaccacaaggcccagctaatttttgtatttttagtagagacagggtttctctatgttggccaggctggtctcgaactcctggcctcaagtaatccatctgcctcggcctcccaaagtgctgggattacaggcgtgagccactgcaccaagccagtactcccactttcaacaatttatagataatccagacagaaaataaataagggaacagtggacttggggggctaatgggcctaacagacatatacagaacactccacccaacagcagaaaaatagaaattctttttaagtgcacatgaaaaaacatccaggacaaatcatatgttaggctacaaaacaagttttaacatattagaaaagactgaaatcatatcgattttcttttccaacaaaatggtataaaactggaactcaagaacagggggacagttggaaaattcacaaatatgtaggaattaaacaacacacatctaaacaatcaacaggtcaaagaagatgtcaaaagggaaaacaaaaaaaatcttgagatgaatgaaaatgaaaaaatagcatatcaaaactatatggcatgcagctaaaacagttctaagaggacaatttatagtgaccaacacctacataaagagaaaacatctcaaataagcaacctaactttacactttaaggaattagaaaaaaaagagcaaactaaggcccaggtcagcagaaagaaggaattaaaaatcaaaacagaaacaaataaatgaaaataaagactaggaaaataatagaaaacattaaggaaattaagacgtgtgtgtgtgtgtttttaagagataagcagaattgagaaaccattagatagactaagtaaaaaaagaaaactttcagataaaaaaatccttaaaattaataaaattataaatgaaagaggaaacattacaactgatatgacagaaatataaaagatttctagagatactatgaacaattatatgtcaacaaattggatagcctagagaaacagataaattcctaaaaacatacaacctaccaagactgaatcatgaaaaaacagaaaatccaaacagaccaataatgagtaaggaaattaatcagtaatcaaaaatctcccaataaagacaagcccagtaactgacggttttactggtgcactctaccaaacatttaaggaagaattaacaccagtccttatcaaatttttatctgaaaaactgaataggaggaagcacttccaaattcactttattaggccagcattaccctgatattaaagccagacattataagaagactactaatcaatatccctaatgaacataggtgtaaaaatcttccacaaaataccagcaaactgaatttaccagtacattaaaaggatcatacattatgattgagcaggatttattctttgaatgaaaggatgattcaacattcaacatacacaaatcaataaatgggaacccacattagcagaatagaggatataaaacatatgattatcggccgggcgcggtggctcacgcctgtaatcccagcactttgggaggccgaggcgggcggatcacgaggtcaggagatcgagaccatcccggctaaaatggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctgaaaaaaaaaaaaaaaaaaaaaaaaaaaaaaaaacatatgattatcacaacagatgctagaaaaaaaactgacaaaattcaacatcatttcatgataaaaactctcaacaagtaacaaccatatacgacaaacccacagctaacatgacactcaactgtgaaaagtggaaagcttttcatctaagatcaggaacaagacagggtgcccatttgtatcacttccattcaatctaatactggaaatactactaagagcaattaggtaagaaaaagaaataaatggcatccaaagaggagagaagaaagaaattgtttatgtttgctgatgatatgatcttgtatatagaaaaccctaaacatgccaccaaaaaactgttaaaactaacaaattcagtgaagttgcaagatacaaaatctacatacaaaaatcagtagcaactatatatactaacaagaaagtacctaaaaacagaaataaacaattcaatttacaatagcatcaaaaataaaataataaatttaaccaaggaggtgaaaacactgacaaaaaattgaagatgatataagtaaatgaaaaaatatatttatgaattggaagaatcaatattgttaaaatggccacataatcaaaagtaatctacagtttgaatgcaattcctatcaaaattccaatgtcattcttcacagaaaaagtaaaaataatcttacaattggtatgaagccacaaaataacaccaaatagccaaagcaatcatgagtgagaagaaaaaagctggaagcttccatattgtttagaagttagaaatgaaacaaaacaaaaaacaaagttgaaggcatcacactacctgatctcaaaaatatattagaaagctacggtaattaaaacaacatggtactggcagaaaaacagaaacatagaacaatggaacagaatagacagtccagaaatatatccatatgtttacagccaatcttcaacaaaggtattaagaatacacaatggggaaaacatagtctcttcttcaataaatggtattggtaaaactgtatatcaatatggaaaagaataaaattggattataccatatacaataataaactcaaaataaattactcaaatataagacctggaaatgcaaaatgactagaacataggagaaaagcttcttgacattggtgtgggtaatgatattttggatatgacaccaaaagcacaggcagcagaaacaaaaatagacaaataggattatatcaagctaaaaagcttcttcacagcaaaggaaacagttaacagaagagacaacctacagaataggagaaaatatttgcaagccgaatatttgataaagggttaatttccaaaatatatgaagaactcaactcaatagcaaaaaacaaacaaaaaacaaccaaataactttattaaaaaacaggcaaagggaccagctgcagtggctcacatctgtaatcccagcactttaggagggcaaaacagcaggatctgttgagcccaggagtctgacaccagactgagcaaaatgatgagaaactgtcttttcaaaaaaagaaagaaaaaaatattagctgggtgtggtggagcacgactgtggtcccagcttctcaggaagctgaggtggaaggatcacttgagcctgggaggtcaagactgcagtgagccaggattgtgccactgcagtgcagcctggttgacagaacaagaccctgtctcacatatgtaaacacatggatatatgtctcaacataaaacaaacaaaaatcggcaaaggacccaatagacataaaaatggccaacaggtatatgaaaaaatgttcaacatcactagtcatcgggaaaatgaaaattaaaaccacagtgagacactacctcacacttgttagaatcgctattatcaaaaagacaaaaaattagtattggcgagaatgccgagaaaaaggaatccctgtactttgttggcagaaatgtaaattaatacagccactttgtaaaacagtagtgacattcctaaaaaaaataagaatagaactaccataggatccagttgtctcacttccaagtattgtgaaagttgattataaaaattgggtcattctactgaatgaaaacagagttgagaagccagagggggaaaacactcagggtacataacaccgctccaagaatataattatttgcaagcctggctgtgaaattgcctgtagtaacctgaagccagttttatctaatagctactgacacaacctgctgcaaatctaggactagttttaccatcaccaccactcaccaatcagagctttcttgctccccagaactttacaagtgccacgaactttcttgaaaaacaaatacataacatttctccttgttataaaacttccgaccttctctttgttctttggatacaccaaagaccacccagtctgtgtatatcttcccaattgcaatttttcctaaacaaaacatgttcatgtcagagattcatctctatagtttatttgacttcaacagtatatatcaaaaggaaatgaaattggtatgtcaataaaacatgtgcactctcatgttctttgcagcagtattcacaataatcatgatatggcatcaatctaagtgtccatcagtggatgagtggatagagcacatgtgagattgagatatatatatatatatacacacacacacacacacacacatatatatatacacacacatatatatacacacacacacatacatttatgtataatggaatactattcagcttttaaaaaaggataattctgtcacttgtgagaacatggatgaacctagaggaagttacgttaagtgagataagccaggcacagaaagacaactaccatgcgatttcactcaaatgaggaatcaaaaaagttgttgaggttttagttcaaaatggctgactagaagcagcaagcccatgcctctctcacagacaggaaccacaatggcaagtaaatcctcacacttcacatagatcatcttaagagagcatgctcggattcaccagagaaccaatgggacccaaggaaagcagggaacagtggagccaggcagcctgcggagctgggacggtgtggagtgaagagaggctcttactccaaggaaggggtgaatgaggtgagaggctccgggacccacctctccatcacagacttttacaatcctagccacaggagagcccccataatcctccttaggcctccagctgaacacagagccacccagaaactttgcagaggcaccgctcaagcccacctggaatcccacagtcagcctggtgccagctgccatgccaaggagggaggcgaggctctttgcacacccccaggagagacagcacagctgctgtgcagaggagctgccagaccacacaccacactactcccggcctcggctgcttcctgcgaaatggggcttacctgttgcaggccccctgtacagttgacccacccctgcagaaacactggccttggctaggtgtttctctgagaccccgactcccaggccagggagagagtgaggaggcctgggacctctgcatgaccccaagaacaaaatccagaactgcttctgcaggagcaaagtgtgagtaggtcatgtgccccccaggtgccaatctccagtgccctgaggggccctcccttcccccagtgaaaggccacctggctcctgcctgagcatttccgctgcaaccacagctcttctgagagcccagtccccacaggcctgtgctgccctcaggctcccaccacctgggccttctgtctgtcccctgcctgagggttctatcagcctctcagggaccagccagccccttccccatcacagccagctcctgaagtctagggtgccccaaccccagtccagccccttaacccatttatgcctgaggttgcaattttttaaatttttccaatcagaccttggcgatgatcttgagcagtgggatataaataagtcccacatgcttagtattccagtaatggaacactaggcataaatgggttttaaggacccatactctctgtccggtaggccgtctaagggcctgagaactggggcgctatgtagaccaatccaacagtgctggcacctaaccacttttcccagggcctgaggtcaggccagcccaaccagttgacaccaccacaactgatacccatccacaggggctgaaaggcagagtgtatcccctggccctgacaatgcaacatcattaccacatcaaaggaaagagagccatacgctgaaaaggttctgccccaaaaccactcctgtggagagtctcaagacaggtgtgttccacagctctcaacccactgtggcttggatgtagacaacagtgaggatctgaactgagagtcacgagttccaggactggtgtgattgggaatagatcactttcctgcctatctagcgcatggagctagtgcagccccttcacccgatgtagagacctcagcacatgtcactgggagctcccaaagccatctccacaaggcttggtgcctatacttggcattggagtatttgtgggcaagccagggggtccagctctgcccagctctacccactccctgctgaacagaaaactcagggcaccaggcacttcactgtccagcccatcaccagaagcaacagagagcacctcccagtaaacaaagaccaagtacctacccatctgctgtgccacaagctggctcttacccgtcagcgccatctactggcctgcaggttgaactgcacagccaaatataaagcctggccaatggaagtgcgtgggctatagaagcaaagctttagcaacacaacgtactccacagtcactccctagggaaagggagggatggagaaagaaaaaacaaataagaaaaaaaaaatcccatctgaacaaaaataaattcaaaaataagagtggttttctgtgagcagctgctccagatgagaaagaatcagcataagaattctggcatcatgaaaaaatctgaatgttgtgacatgactaaaggatcatattagctctctagaaatataccctaaccaaaatggaaactgagaactgacaaagagttcaaagtataaattgcaaggaaattaaatgagattgaagacaaggttgaaaaccaacacaagaaactataaaaacaatccaggaaatgatgggaaagataaatatattttaaaaaatgcaaaaggacttcttgaaataaaaagcctacttaagacatttgaaaatatagttgaaagctttaacaatggattacaccagcagaagaaagaatttcagagcttgaagactgatcattgaaactaatttgtcaaaagtaaaaataattttgaaaaccaaagccagagaaaccatatttctctggtgagaaatatgaattatctaaagcaataaaacctatgacttattagcattcctgaaagagaaaaagtaagccactggaaaacatatttgaaaataactcaagaaaattttcttaattttgctggagagttgaacatccagatacaaaaaattcagagaacatctgtgggattctatacaagatgaacatcaccaaggcatatggtcttcagactatgctaagtgaatgctgaagaaataaaaaatattaaaggcagctacagcaaaaactcaaatcacctagaaaggaaaattgatcaaacactggacttctcagcagaaaccctagaagcaagaatagattggaggcctatttttagcctctttaaataaatgcaaaccaagaattttacattctgccatactaagcttcataaatgaagaagaaataaagtcttccccagacaagcaaacactaagagaatttgtcaccactagacagatcctacaatacatgctcaaaggcgttctaaatatggaaatgaaagtactatactcaccatcagaaaaagataccaaagtacaaagctcacagatcctataaagcaattacacaattgaaactccaaaacaactagttaataacacaatgacaggagcaaaacctcacatatcaacattaactttcaatgtaaatgacctaaattgtacacttaaaagatacagagtggcaaattgggttataaaaaaaataagatgcaaccatctgctgtctaaaaaagacccacctactggctaaagacacattcagactcaaagtaaaagggtagaaaatgagatcatgcaaatatcatgcaaacagacactagaaactcttaaaaggaaggagggtggaaggggagtgaggactaaaatattacctgttggatacggtgttcaatatttgggtgatggaaacactagaagcccaatttctatcattatgcaggcaatacccttgtaacaaacaagcacatataccaccagtgtcaaaaattaaaatttttttaaatgaaataaaatttcaaactcacaaaagcaaagaatggtgtttgccaggtactggggatgggggagcaaaatgagatgttgctcaaagtaaacaaagtttggtagacagcatgagtaagttctgcagatctattgcaccgaatgtacaataataatgtatacttggaaactgctaagagaatagatcttaaatgttctcactgcaaaaaatgtgctagcttgatttaatattttcacaatgtatactgtatcaaaacatcacattgtacactgtaaagatatataattttatttgtcaattataccttaataaaattggcagggagggatgggtgcaagaaataaaggatatgagcaagaaatgaaaggcatctgtgctgggctcgacttttccaatgtattcacttgacacatcggtgacagtctcatgttctgacttttctgacactgtagtctggaaaaaactatcccctatatgcaacacagccattaaaacacacacacagacacacatacacacacacacacacgcagaggaacttaatacagtaatattcaatatcaccaactttgcctgttaccatggtaaccagcagcattaagtcctgctgctaaaatttcaagagcagatgacatgaactatttatgtataattgcattttataaagagaaagaacttgtctttcatataaaatatgactcagtctcagatgagatgggtgattatatcacattgccgtcagaacaaatgtagcaagtcccttgtctccacgccctctaccccagtgcatgttacttccatatgcaagtggaaagcaagatggcaaacaagggttagcctcccacagaaagtgcctgccctgatttgagctggcgtcactgcaaagacgctcagggttcaagtattcacttctccaaattgagttaaggggttctttttcatttctactcttacaagcttgtgcacctgctgtctgtcccctgtggttggcttgtcttgagccacagccacttgtataagtcatcagcatggagtggacatagaccaggtcaaaagccttcatcttgtagatagagattgagaggggtcataactagatgtttctggagacagggttgtgctcagtagtggcatccattcgccagcaatagcacaggcctaaactagttcagcattggatcatgttgatttttccctcatccggggattttctgcagacattctaatgtcaatttcgcagaccatcatccttcctgagccaagctatcaaggaacaaaaagagtaggtgttacctatgtggtgacagctcccacccttgagcactgagccttgttcctgagcattgcagcactgttcacagccaagtgaaccgtcttcaagaagccttcgtcactcatgtgttcaggaccaggaaaaaagcttattcaataactaagtaaggttatgtgattatctctttaatcatatctttaataagttttctgggaatggtagaggttttaaatgagaacgtattcaaccaaataacgttgagctccttaagggaagaaacaaattccatgttttattcaaggtgtgattccaattctgggtacagagacccccacaaaaacggctctgctctaatgtttgtgggatgggtgggaagatggacaacgcatggatgaaaattcccaaacaggaaaatatatcttgaatgaaagaatgaacgaaaatactggttttagaaaggagggacggatggagagattatcagggcagggaagatcccgaaggaaatgagcaggctttgctgaaagagtttcttgggcatgggaaagacccagatggggttggcctgccatttacccctctgcaggaaattcctccaggccacaccccaccttctctgattttctcagctgccgaaccttgattgagctgtgttccctgttacaatgccagaattgaaaaagagaaaacaaatgagaaaataaatcacgataatttcccctgccttaacaagacacttgcattcacgtactgtgtgcctaagaagggcagttaccagtgcagttctgtagtgaaaaggtttcttgagccagagaaagacccagaaatggatccttggtggccatctggacaaagcccttaatcagtcacctatgatgcccacttgctagtcctgcatccaggttcatgggaagtctgcagccatgacaggctctgcctggggttggccctccaccaaagagcctccggtccctgcctcttggggcacagacccctactgcccccagcctactgacctgccccaggcccctgcagtctttatcatcaccgcatcgtgcagtttgggtggcatctggttctaaaatgttcccaggcttctgccttgcttctcaggtgcaccagtcttttcacacatgggtgggcttctctgaagctgctgcagttactcccagtggccaaatcatttcttacttcccttaataaacaaggcaacagggttttgatgaaagagtttcttctttggagggcagaacagcttccttgccttgattaaaatgtttgccagctgtttctcattctggtctcaaggtggcttaaatcttcaggaaagtcagacacttcactcactggtaattatttttccttattaaaaatctatttgcctccatgtgaccaacatgctactctccatcatgatgttgagccattcccacctcttccatccatctccactccaatttggttttatcatctgatcccaccaggtaagagaaagcaattagccctctgcccttgaagtttgaccccgacaagattaatccggttcctcggagtgtctgaggacctggtgaaaacaagcagggccttttgtcaggtctctcctcacacctgtgaaggtctctgttcatgactatggggcatgacagcattcacagcacaaaacacttcatcaacattctaagtatacccttgcagctcaaaattgtcagcacttgaaggttttcctcttcagagatggtcttatcacaacagcactgtgtggtcattctcctgagtgctgctgccctgcagataggtccaaagcccaacttgcagagtcacttcttcacgttgcggcccaagatgcacaggacttctgaggtgctgaggttgaggaaagaccggatacaagaacacctcaagaattttgtacccagagggcagagcccagacataaatgttttaaaagaaagacgattttccatgatcttggaaatttctaggtcagactgctttcacacctattttggaaaaggggcctactccatccctgcatcaaccatagcaaagaaagtcaacaaagaccaaaaatatatctgaatgaatgggttttcattcattctttcaacaatttattggttgattactctgcatcaggcaaggttctagatgaaggcactagagcctctatttaatctgaatttatcttttcaatacatgagccaaattctgctgactgggaagcactaatgagacaattaaacagaagtctaatctagagtgactggggcggtgctggttcactttgtttaatcagggcaggctctttaaggaagcccttgaaggcatacatgggagagcctgctctcccttgctgggcctggccacctctaccccatcctcctctaaaaacagcgttttcaagatcaaagaggctaaactgacaccactgtcaaaatctaattaaaacctctcttcttctagtaaagatgttaacactggataaagcagatcttcatccccaacaaaaaaagaacttgttttaattaaacatccaattttaagttggttttattgctattgttgtgtttttgtttccatttgtgccagacagaggacaggaagactgtaatctcttacaaaacatacgaacatatgtcctagatggcaagatccctaggcatcttcctctgaagtcctcagtcgcactctcactcacagacatctgctggggtggagggactgtcaaaaactttttcaggtaatctggtgagatgtattcaaagacttaaaagtgtatctttttttttttttgcacttgtctttaattatttccttaatctctggaaatggaatttatctgcagtgaggttcattatagtgccatttgcaaagctgaaaggctggcaacaacctaactgtccagccacaggggataatgacgcattcatctactggggcatggggcacgagcccatgagaaggtgacatgatttacaagaaatctagaatgtgctgttgagtgaaatggtatggaccagtatgatcgcattgtcattgatttttacctgtacattcataagctcgaagaaatccagacagttaaatctcaaaatattcagaggagtgacattgtggaagatttttattttctcagcaacattttcttattttacaaacatcacatatatgacttgagtaattttttaaagttaatgtttaaaagagaacaaaatagttgcccagagtaaccctgtcttttaagtatacctcctaccccaaagtgggcagtaactggcttgtctggcacccatgggtgatcttgtctaagcttgctgccctgttcttagggtcgggggctacctgggtattaacttgagtctgtggattgctgtgaagtcattgagaaggaacacaggccctcccagagtgcaggcacacttgaccatgcagtgcccaccctgccaggactcatgggagaaccagccattctgctcagctcccggttagtcagtcccttccccgctcaatgtttccaagcacccaccctcagtgcatttactgagagtcccctgaccatcagacaaggactgtccacaggccgtgagggagggaggggcatcaccgaggctgctgggcctgctttcacattgcctgtccgtggcatggaggttcctccctccctgatccaccccttgttcccctgcccatgtgaacgctgggattgggcctgagaaagaaggaaaattgcttcggcttccaagactagcctttctcatgtttgtcttgagtgtatttctgagcagaaaaacaagcttcacaaacctcatgactcaccttcatgttttctgtatgcttccctctcccctgccttgtctcactgatcccttgaggctctccctccccagcccacatttactccatagcttccagtagagtttttcaggttccctgcaaagtgcaaatatacacacaattctgtgagtcaggcagtatcttaaagaggttccatcacacccgaaggtttggagtcactagcctgtttgtgacatgtcttcaaggatgaacgaaagatttgaactcttcagccttaaaataataaataaaacctgaaaatgaaaaacctcaccaaattaagcttctgcccattttagaaaacaagggcaaccacggaggagatgactcagttcttaaagacaaggttacccaaatgggtgcattgtgggatccaagaaggatgcttctgagcttgttgagctcagcatcagcacagacatctagctagtccgagaactcagatagggaccaggctctgtcctggtgggttaaatcttaaatctctatgtagcccattactatcagcaaatggatctttatttaagctctgatcttgtattgtgtgtatatccttctccccagctctgagctctctgagaggacagcctacagtttttccatttctatctccagggcctactcccaaaagatgaaccttcaactgtctacattgcacgtctgggccttcagcatcgctgatgcgccagctggcaccagcttcagcagcccagcgcatctgctgtgcttgcatctgccatgtcatcgtggggtcctgggcccctgaatgcagcaggccagcttatgtggtcccatcctctgcatctctgtctgcctctgcagtgcagacggctctgaagtcacaccagcctaacttccaggcccagacctcagggggagccagattgccatatcattcctgtatccagatccagatttttcctgctgcctctgttcttcctaggccgcccctgttattcaggccatctcgtcccactgccaacatgagcaccaagaactacatcattccattgctttcagcattccctccatcaatggtggcaccgtacacagctgtgtctgtgtaaaacaagagttcccctgcctgaagtatgtggggggccctttgctgaaatattttagctcagattcttttagaagaagtttcactcttttccatgaggacttttctttcatcctcaggcatcaaatgcccgttagaaagttctcagttttgcctgcatgtcaatgtttctaaacagtctcatttttattcctgttgttgtgaaataaatgccttaatgtcccccttgcccatactgactgttacaatctgcctggccatgcctcgaccttcccagataccatgcacctgtcccccttgcccatactgactgttgcaatctgcctggccatgcctcaaccttcccagataccatgcacctgtcctacgccataattaaaatttactgcaatcttagctttgtcatctggaccgtgccatataaaaagaaaggcacaacctcagaatgtttttccttctaaattgctgtaaaattatgagttatgtcaactacaataaaacttcaattattcagatgcactaggggaacatgaccaaattttgaatgagtgaagcagctttacaaaaaagcagaaggtgcgtaaggaaagaagcgagatttcagagcttctcatttctgctacaggacaatcagcctcgcgctgcagcagaggacacaaggaacccacctcggagtaaatcagagagcacaccacaaatcagctcccctgatagggtaaggtggaaatacactactggagggaggcctctctcctgtgcccatgtgagatgttggctataaaccccatcctggccagagcagtgattttccactaggcaaatttaaatgtgtgttattgtctagtatgtgagataacaaaattgaagataaactttcactcaccaaaaacttgccatatctcaagtagagtgtcctccctctttcttgcccacatctcaccttcattctagtcatgggtgcttataaaccctattctgttagagacagaaagggttaacaagcaccatgagccaacacaagttcaagatatcatatacttttgattgtctgttttgaaaacgtttatgccgagggaaatgttaaagcaggtgtccgaattagaacaagtgtccatgtaatacaagaagatggattttggctaccaagagccacaagagcagagacggaaccaaaggcaagatgacgtgtcatgagttacaaggaagcagaaggcaagccacccacatctcctttagttctttaggcatttaatcagctagaaaagctggtgcctgctgctccactcccagtggcctatccattatcactaaaataataatgacaaattgagaaaggcacagaggacaggcaaatgtgaagccaagtgttgaagacggcaacaggaggtgacagccagcagccctcaaacaccagaaggagccagtgtcggccttgggggcctcctcctctggagagcaaagccagctgtctacattcatagcccaccagaaagggcagatgagacaaggagggctgcaggacagtgacaaagaattcaaccccggagctgcatcagccctaaagcagccttgcctcatttctgcctgagtaagagcaagccctggaatcacagtgaagggattacattagacaggacctacgttagacaggagcaggggctctgacacctgggcttagctgggagctaagggggagctgccctctgcaggctggctcaccagactcacctgcagagttggccactcaaatggctatctagagcccagcctccgcagctgtccagcagtcccctgcttttgggttgcagactctagcacccaaattccagaatcctctcttgtctcatgagctcataggttaaggtacagcctggtttattatcctgcacaaaatcctaatgacttaaattaaacaacaacaacaacaacaaaaaacagaaaggcccaccaagcacccagaactccctggagctccagcttcttatgtcctaaatatcaaaacatcatcttgtgacttcattattctctgtgtttccattctttctataattcccttcccaacaaccttcacccaggtaactcctgctactcctgctcttctgcagagaccaccttgcataccacccctcctctcccgttacattagaggcccagttgagcattttattttacctttgggacatttattcctttattcactcagcaaatatttattgtgcatctactagtcataggcacagagctagacaatggggattctgccatgaccaagaaagaaacaaacagtccatgtcttcttggagcttgccatctaaaggggaagacatcattaacaagacaaaacaaacatcgtatgatagcatatgatgctagatagcatattaaatgctagatagaaattaaatgctagatagcatattaaatgctagatagaaacagcacactgagctatgagaaaacagcacatgctggacctgaggtgaggccactacaactgaagcactactgtaaacttacacagttttccttcccagtcccaccacctcctgacaggaagcactctccacaaggcagggccccatgaccagcagctcacaccacagcacagggcaccaggcacgatgaagggtcggcgagggcaggggctcttcacccagaagactctgaactctggctttccttcaccttcctctgcacccagttgcacaatttgttcctcataattaatccatttgacaagtgagaaaactattttcaaagtaaacaaaataaatcaaaatggtgctaacttctctccctaatgtcctccatcaatcatggatgactcgagctttttaaacagagaaactggggcagtggagggagtgaaaaaagttttaaactcaactgtgctcccaactctataacattaagatgctggaattgatttgttgttaaaaggagagttgcaagtactatctatgcctagaaggaggagggaaaaaaatcaatagtaaaccatgtaattgggagaggggtgaagtagaaaagggtatattccctactgactcagagaaaaacgcaacaaagagtcaaaacaccctgatttaatgcctaacttaaggctgcacaaggcagagcgacagtgccaggaagatgtagaagaaggaagtgttaacttgaaatgactctcaccagcctctaagggcaggagctgaactgtttgctgaaaaccaaaaattcacaaaggaatagtgggaaaagaggaaacaaggatagcataggtcctccagagaaagacagaagacagagcagccagccttccaaatcggaagtcacatgctcacctccacagtgcctgtaaacaactttttttttttaagtttttatttatttaattttgagacagggtcttgctctgtcacccaggctggagtgcagtggtgtaatcatagctcactgcagcctggaactcctgggctcaagcaatcctcctgcttcagcctcctgagtagctgggactataggcacataccaccatactaggctaatgttttaattttttgtagagggcgggctctctctatgttgctcagggtggtctcaaactcacggcctaaagtgattaccccaactcggcctcccaaagcattgatattactggcatgagctaccacacctggctctttaatttttgtacagtgtattgctatgttgcccagactcaacttaaactcctggcctcaaggtatgctcccacctcagtctgtcaagcgctgggatgacattcatgagccaccacaccaaactgcttaaggttttgccattcaaattaaaaataaaggcaggcacactaggatggctacagtaagaaatatggacaattgccaggtgttggcaaagatgggaagaaatcagtgggaatgtaaactggtgcaatctctttgggaaacattctggcagttcttccaaaagctaaacagagaattcccatatgatcccagcaattccacgcctgggtataaacccaagagaactgagaacatatggccagagaaaaacttgtacatatatattcatagcagcattattcataatagccaaaaagtggaaataaaccaaatatccatcaacaggtgaatggataaaccaaatgtggtacatgcacacaatggaatattcacatataaagaggaataatgcactgatacatgctacaatatgaaggaaccttaaaaaatgctgagacagtagctggacataaaagacaacatattgtatgattccatttatatgaaatgtctagaagaggcaaatccatggatacaggagttggcttagtaactgtcagggctgcaggaaggagagtggaatgagaatgactgctagaagtacaggtttcttttggggtgatcgacatgttctgggattaaacagtgctgatgactgcactcctttgtgaatatactaaaaaccactggattgaacactttaaaagaattttatgatatatgaactacattttaataaaaagaaaataagggcagaacatatatggtaggaggtggttaacctacttgacaaatttatctcatcatcataaacaatacagtaatcattaataagatatatatttaataaatcatgcccaatttagcaacaccttgaagtagatggtttgaggttaagtattatggccctgaaaatggtaaaaatattacttttgaaacattttgtagtatcaaacttttaataaattctatctggcttccaatagctatgtacattaggcaggtattatgggctgaactgtctcccccacaaaattcttatgttgaagttataactcccagtaccttagaatgtgactgtgtttggagatagggcctttaataaagaggtaactacgtaaaatgaggtcctgtggttgggccctaatctgatacgagtggtgcccttctaagaagagattaggatgcaaacaggaacaggggaaagactacgtaaaggacagggaaaagacgacatctacaagccagtaagagaggccttgggagaaaccaccctgtcaacaccttgatctcagactgccagcctccacgactgtgagaaaataaacctctgtggtttaagccacccagtctatggtactttgtcatgacaactctaggaaactaatacagaaggcgttcatgtgttaaattcagatttaactctatatttattatatgctgaagcatatgatagtgaactaatagagtgaactaaccattacaagagctattccattttctaaaagccatcattaagcatttaactataagggtccaccgccaaagtaaaacatattttttgtttttttttagagacagggtttcactctgtcaccctgcctggagtgcagtggtgcaatcacggcccactgcagccttgaactcctgggttcaagtgaccctcctgtctcagcctccccagtagctgggactacaggtgcataccaccatgcccttctaattatttttactttttttctgtggagacacggtcttgctatgttgcccaggctggtcttaaacttgtgacttcaagtgatcctcctgccttctcctcacaaagtgctggtattacagacatgagccactatacctggcctaaaattctttttagaaaattaaaatacttttgtgtgtgtgtgtgtatatatacatgcatactttaaaagaattttattatatatgaattacatatacgtgtgtatatatacacacacacacatacatacacacacacacacacacacacacagtagaatattactcagccacaaaaagaaataaagcactaatagatactttcctggggtatcaacgtgggttgctacaacctggaagaacctcaaaaacattatgctaagtgaaagaagccagtgacaaaagggtacatactgcattattccgtttagatgctctatcaagaacaggcaaatccagagacagaaagcagattagtggttaccaggaggtggagaaggcagaaataacgagtggttacttaatgggtacagggtgtttttctggaattaataaaaaagttttgaaactagagacaattgatgcttgcacaacatttagtgaatatcctaaacgacactgaattgtacactttgaaatggtaattgtatgttatatgaatttcacctcatctaaaaaatcatactcctaccagtatagcaggatacctcttcccacacaggttctaagaaaataatcagctaagtgtacagtcatgcatgggtaaaagtgtttgttttagcatgtgtattgttaaaatgttttataatagtgaaaatttgcctaatgttcatcaaagagtagataaataaatcagagttcatctatatattggaatactaaacaaccgataaaaacaattaggtagatccacacaaaaaagtcccttcacttagaagcatattaaattcctaagtgctattaaaaatgtaactgttggccagtgaaaatgatattacacacctgaggacttgccacctgtcagtagaaggcaaagctgaactgtgttctgtcccagctttatttacatggctttgttcacgtggctgcagttcccagagcagtgcctggcacacagtaggtgctcaataagtcttagatggatgaatatctaggaagaaccattaaattttaagttttaagaggaagttctgtagttcatatatcacagacattgcactttgtcaataagtagaaagaagattacaaacaatgtatctggaaagctgccattctgagaaatatagacatatacatatgtaatatgtgccaagaaataagtccggagacatacacattaaaaagttaacagtgattatctttacatggtgatattataaatgatttaaaaattttcctttgcatgttgtctgaatttttcttttaacaataagcatagactacttttctaatcaggaaaaaattgaaaaagcaataaagctatttccatgtagaaaataaattccttttattatctataattcaattctgaagactattaattgggcatgctagatgctttcactgatctgctttggttgttctgagttctaaatccatttagttctctaaaataaacaacttactcaaagaaatccaaacctgctcagaaaataccaacattagtaatgtccagccacaccacaagcactggtgggccactgttggtccaattattaagaatctgtctgttttgggtgcaataagcaataggctcactcagtacctatgaggcaccaatagtacctgctactgactaactggccaaagcccccagagtgtcatgagaggggagaaaccatccagtcagtcaataatcacaggttaatgaaagaacactccaccagcttgctatccccgaagaccagaaagctgctatgctcttcagaactcttaacaaaaacgacaatgacaaaaattgttttccttgactctcaccttgagaacaaaagactaaacccaagtacaatgacacaatagagtttcttgtatactgttttcatttctcagtgtcacttctgttttctgtgactcttactttgggagtaaataagtcatttcctccaggatcctgaactggtcatacataaaatcttcccggcaggacaagcctcaggtgggcagggagtctgtgaagtagggagtctcaatcccatctccttcagaggccagtgtggctcaaacttggggacctcactcatcgaagggatatgaggcgaggggtgcgggtgggtagcctgcgccagacctaagggtcccactgcctgtcagctcctgacatgcctgactcagggtccaggagccacatcctccaggctttaagcagacaatggaaattctgatttttatgtaaacgcctgtttttgttctcttagccactaattagattttttaaacactatgcagtccaaaccaagaacatctatgggccaccagtatgcgacacctgagcatttgaccttgagtttgatactgactccaggcctttctactcctggcaagtcacctaaacagaggacaggtcattatctgaggacttttggacttgaattcccttttcatctttatttcatgagtttcctcataaaactctgggggagacgcccctcttaagactctgctgttgtttggaaatcacatcgattacaacccacaatcaattttcccctctagtcaactgcaaaataggattataggtcctattcctagaaagggtgcttagaaaaccattagcagatgttcacaacctgcattcccctaccccacattatcctggattccaacaaagacaggggagccagagtagctctgaaaccaggcctgctggagcgggaagtgaatcacttcccttcagtggcccaaaaacctggcaaagaggaatgatgccttggccccaacagccactgcagaggctggctcttaccccactggaaaccttcgtgtccctcccctacatgcctacccctcagtctgctgccctgcctctcctgcatttctctctactccaaaggttcccgtgcagagggcacggaggcaatccagactccctctctggccagccccccaggcttccagggcactaaggagcaaacacaaatctccctctaagctagaaggacggggcaggatgggtccaccctgcccatccgtactggattcggtagaaatgaagtccatgcacatgtgccatcttccttgtagtagtcctcataaaagctctgagagaggtttcatgtcctttttacagaaaaggagatggaggcttagagaggttactttaataagagagagagaagccttcttagagaaggtgaacttccaactagcatcagaagtcccggcaagaacttgaggggcacactgggagaacagtgagtttccccaaacttagctttcccaaagcacccctactagagcccacgaagtcctcaacactctagccacatgggctaccatgggaggctctagggagtttcggcacagaggataggctccttacaccacaaccaaagacttcagagccggatgaaaggcatgatgggagaacacggtcagccccatagcagacggttggagatgacagcctgaaaaccaaaacagcccacaggtgcttaaagaacacaggccctgcctaaaaagagtccattagccctactgctcctgtccaggttacttcacacacacatgcacatgcagatgcatgcacacgtgcgtacacgcacgcacacacacatacacatacacactcacacatatttcttgcagcaggcaagaaataagggagacttgaatgaagtgcagcagggggcctgggagagatgcctgcaggaaattgctcagagaagaatgcatgggattcagcaacccagaaagctgcaggtagagattgagggaaggctgtcagagggagaattgacttttgtttaataacagcacatccctacagagctgttcttcctgtgtcatgtttagacatctagtttgccctttgtgtggctatctgacccacaagcatctccatgtttggagctagatgaaatgtcagcgctggaaacattgctctgagaattttctgcataagaattatatttgaaattgtatatatagatgtaatcagcaagaaagagggtatagaggagagggggataaaagcaatgaatgatgccagcagcagaaacagagactgagtctgggaatctcctactgagtacctttccaataaactcctttctgcttgttaacgaaggcaaagcggtttgaaaggagaggaccagagtagcggtggagacctcaaagcagaaatcgctaataaccactgcctttaggagagccaaaccctcaccatttttattcttcagtcattctgctcaggaacaagctttcagggagtttggctgggtggctgcagtgatccacagacatgtcactcgaagtgcttccttggatcacagggaagtggccaatgattgtcccattttacacaagaaaattaaatggtcagacccagatgacttggcaagaccagggctaacaaatctgggtcccaggttccactgctgagaagcaggtcaagggcagtgcgtgcttcctggcctgggcccttgggacactgccataggctgcagaatggttttgtgttacagggctggaagtgctatgatttttttctaaaaaaacaacattacataacttcgcatgctgtgaaaacattcatttattttacatcttcatttcacattgttgcaatttaattttattgttactgatatccttctatacattaatctaatacttcatttggtccaagaagtcagacactgtgaattatgcccatcacccaaaattttatccaatttaacaaccttgatatgatttagaatatctttaagataataataataagagataaaaatgtttggaaaaaccccaagaaaaaagatgccagggtatgtttgatagcctaagtttgcatcacctatctacctcttggccagaagagaaaagaaaaccttcagtgaccatcctcccaacaccgtatccaatgagagaggaaagatatttcctcttagtaaagtcagggtgctttaccacgtgaccttaaccactcatacagagacagctacactgattttggggccagggtattatgtgtgagcttacctgtgactacttattcaagaaagcattctcagcagaacccagactgccttctccttcccatcttctcaaatccacatagagacaagggaaggtcaagtgtagagcaaacgcttaggggatgtgttgggtggggccatgctcaaagttcagtgcaacgcacaaagaactcattagtgattgccaagtgaacaagcaacaaccaaccatgaactcaaaatactcttggaaagcttaaaaatataccccccttggggatgagggattccaaaaactcttgggaggcaggaatcctgctggcacccccaatgcgctacagccatggcccactgtaataaaagatggtccctaccgtgcatctgcactgcctaaaagcacctgggagaggaactttccacctttgacaaaagtaggtaggcttaatgagttaatgttttcaaatgttttctgagctctttgatgggagcagctgtgccactacaaagcagcctttcatctccaggacagaaatagtctctctctttctaccccctctatccagctaagcctaaccaacctcagcaaagccaccctctccaagacaaaaggaaagggaacagctcacgcagaatgtaggctctgatcctgtcttcctttgcctaatgcaccctggctaatttttccctaatggtatcatcagtggcacatgcggccctgctgcaatgctctgtgccatctgaacaacaggagaaacccttctgctggaaagtgaatgcaaacagattctaatcaataggaagagctcaattagagcaagttcagcacacttcaaaggtgttgctactttctcgctggcttatcccacacagcccttttgaggggctcgaccttgggagctggctggcaacaagagctgctccagacaactctgtaactggaccagcaaacttcccaccatactggatgtcttctacaagccagaagagggggaaaactccttatttcagttcagagccacatttctcctcctgcacaccccagcacctccctcaggacactgagggcaacttagtgaagacctgtgccttggccactggtctgaaaggccctgggtatagcagtgcacagatcatcacaaccacctgcagaaagtcagctgcttcttcaatctgcaaggaaaagactccttcccaagagacctctggtaatgaggtgttaagagtataagagctggggaagtgaggcagaacaggaaacatggcccaaatgccaggcactgttttctgggttcagatcttggcactaactacctatcagctgtggaatcttgcaaaggttacttaacaatcctgcagctaggtgctattgtcatctctggtttataaaggaaacaaaggccgaggtgggcggatcacttgaggtcaggagtataagacctggccaacagagtgaaactccatctctactaagaatacaaaaaaatcagctgggtgtattgctgcacacctgtaatcctaggtactcgggaggctgaggtgggaggattgcatgaactcaggaggcagaaattacagtgagccgagatcataacactgcactccagcccaggtgacagcgagaagactgtcttcaaaaaaaaaaaaaggacaaaaatcctctcaatatctcaaagccttaggaagaaagaaaactatttagcacagtgccaggtgtacagtaagtgtttgataaatgctggctaatgatatgccttctgctgctgttagtaataccgatgtgttggaaaatgttgagaggaactctgaaaaagagctagcggccagaattttcaggaaaagctgcctacatcctcctctttgagtttcataaggcacatttctgtggtactttctcaggacttttattgtgttgaagacaagtttgagaaacactgacttaaataaatttatatatttttgctacaaagaatatctgcagatagatcaagatggccaactagaggaatctaccactcatctccttcacaaaaatgacaaaaacaacataaataactgcattttgagtagagtacctaaaggaaaacactggaagtgacaaaaaccctctgaagcacgaaaatctggaaagccagcatagggagggaagcgaaacacctgaccaggatctgctcagggccaagggaaaggtaagcaggggatcccccatggtctccatagttactgaggctgcctgcaatcccagctacaggctagccccgcagtccccataggccctgagcccagtggaggaaactacctggagtccacaaggtcacattgctccagagaagggacacatgttctccacagtgggacggagccactgggggagcgtattctgccctggaggccattagcccctatatatacatctccatgtcgctgggtccctgccgtcattccactgtgcccacaaaaaaggctgagtgctgtgatcccagctagacttgacggtgcagtcatcatccctgcccccgagcccatgcagtgctctacaatccagggagcaggcatagcacagaggggaggatgccccagaactaggggagccagtgtacatgctgagcagagacctagagctgaccacctcacatctgccgccaccaacaacccctccaggggcggaggtgctgcacatgtgtgcacatcctccgggaactaaagtgcagccagtccagtgattgccatcacagaaagccatacctcctccagaggtggagctgtgcatgccatgtgtccacaaggagcggcccacctggtgcccaccaatgcgagtaaccccacccactccagggccagagccaccaaatgccatgcacatcccccagaaactaaggagtgacctgttcagcagtgccagcagccccacccccaaaaccagtggagccactgtgccaggcacatccccccagggcctgagaaccaccttgtcctgcaacccccctcaatcacaaacaatgctgcaccactgcctttacaaacacccgcaatttaagattctgaggaaatctcagacactgctggcattaattacagtcaaagaaatcagacagggactacactatgatgcccatctagaacaaaagccaaagcaccctacccaacagacaccataggaaacatctataggaaaaggtatttctccacaaaagtaactccatatatttggaaggcaagactatactccaccagatgtgcagatatcaacgtaggaatgaaagaaacatgaaaaaacaagtaaacataacacatccaaagagcacaactctccagtaacagaccccatagaaaaagaaacctataaaatgcctgaaaagggattaaaataatatcaaggaaactcagtgagatataagagaacacaaaatcagaaaaacaatttacaatccaaataaaacattcaacaaaaagatataaaacagaaccaagcagaaatcctggagctaaataactaaatgaatgagataatcaagagcttcaaaaatagactgagcaaaagaaaaaaaatttctgaacttgaagacgagtattctgaaataacctagtcagaccaaagaataaaaagggtgggaagggaattaaaagaatgaagacagtgaagaaagcctacatgacatatgggacaccatcaactgaataaatattcaaaatttaggagttccagaagtaaaagagattttaaaaagctattcaataaaataatagctaaactttttttttgttcccgcaagatggtagattggaggcttttaacacgcctcagccacttggaaatagcaaaatagtgagtaaagatcaactctgaagagttttaattcaagaaggaaaatgtgaattcaccagaatagtgaaggataccccaaatcccattgagaaaaaggtaggcaagcagcccttgtgatagtgtttggctgataaacatgagtgaagcccctgtacataaaaagggcaaagagttttcctctatgactcacctttccacttgggatctgtgcaacccatgccaagaaaggggaccctgattctcccaaaccctggaactaccaggaggagaggctgggagacactgagagggaaagatattggaaaatgctgcatgcattttcccaaccttggaccacggggaagatgtcatttttaatccacactaatacaaagtcagtcattgtttggtgacctaacaatgcagccacgcaggcattttagtctcagactagagactggagcacttgctttggagtggagtagaagcctcccagctgcaatggagcagctagtgtggaaaatgccccagcagtaggcactggaattgggcaatctcccaccacaggactagagtgggaagagggttgctgaaactgtggtttcctctgagaggtgagacttgcagccaagagcagctttgtgacctggaactggtctgtgtgtcattgcttggagtcccagcattctcccccgagaccatggtgtagcagggccctctatgctctatgcccaggcagatatccaggcatttgaagcacccacttccctacattagcagcctaagctgcctcacgcttgctaagcagagaatttggtacagtggggctctgcttcacacccaggcagatttccaggcttaaggagtacccatctgcctggattagcagtctgagctacttcatcctttctatgcagagaccatggtggagcagggtcaactccactccttgcccaggtagatctccaggcatatggagcatccacttggctggatcagcagcctgagccacctcaaccttcttctgcagagaccatggtgcagcaaggctgtctctgctccacagtcagagatctccaggcactcagagaacccactcacctgatttgcttcttgagctgcctaccccagtttcctacaaagaccttattgcacaaccaattactccactcctcaccagtagatatatttccaggcaatcaaatacccactcacctagattagtagcctgagctgtctctccctcccactgcaaagaccttgttgcagcgacagtttttccagggcgaactcccaagtatgcagcatgcttgctcccctggataagagcctgagccacccctctcttcccatgctgagatcttggcgcagcagcacattctcttccccatgacgggacatatcaccaggccttcagtgcacctgccccccggaatagaagtatgaactgttatactcttaccacacaaagaacttagtacagcatcactcccttcacttcacattcagatataactccaggcatttgtcacacctgctcccatggataaggagtttcagccaccctttgtctcatgtaaagactttgtagtggcagcagtctctctgctccttccccaggcatatcatctcacacggggcatacctgctcttccagagtaggagcttgacccactcctcccatcccctgcaaagaccttgtttgaacagcagtttctccactccctcccagagcatgtggcacatctgcctgccttaatgagaagcctgagctgcccttcccttcaggtgaagagaccttagtacaatggcactctctcagcttgatgttcagacatacttccaggcatttggagcacccattcttctagattaggagtttagggcattcccctctcccttccagaaacttggggcggggaaggttttccaattccacatctagacacatctctgagtccttggcagcttccactgcaaaagctggtgcttgtaactgccattaggtctgcctagtttggccctgcccatcttggtgcccctacctaggactgagcagggaactcagatcattgtgcattccaaagatcagccccttgcttgaggcaagagagagcttcctccactaaacaaggatcaagtatattcctgtcaagtttggatgcagccagctgttacccataagcaccacctactggcccggaggttgaaagataaaacataacaagaaatctgaaacaggtgcacagtactggggaacaagataagcttcctaagacctctactaccctggccagagaaggaggcaatgagcctgctcatatgcccaaaatatagttactgcaaccagcatttagcaaagttgccaaataaaagctatctaaaaccaaggaacttaaaatagactatttggtactgaagacacctggaaccaaagccataggaccctacataacaacatatattatggataccttcctcaggggtagaaaaaagatgccatccaaacaaaagcaaactcaagaaaggaaagatagtttatccacatgagaaaaaaccagagaaacaattctaaaagtatgaaataaaaaagtattacaacacccacagagtgaaacactaactctccagcaacagatcctaaccaagataaaatctaaataccaggtaaacaattcaaataatttattttattttgtacttttttgagatggagtctcgctctgttgcccaggctggagtgcagtggcacaatcttaactcactgcaatctccacctcccgggttaaagagattctcttgcctcagcctcctaaatagctgagactacatgcgcacaccaccacgcctggctaattattgtatttttagtagagacgaggtttcaccatgttgaccaggctggtcttgaactcctgacctcaagtgatccacctgcctcagcctcccaaagtgctggggttacaggcattagccactgtgcctggcctcagattattgattttaaagaagctcagtgaaatccaagagaaagctgaaaaccaacagaaaagaaatcagattagcaagtcaagacataaaagaagagataggcttcattaaggaaacagaactcctggaaataaaaaattcactgtagcagttataatatacagttgaaagctttaacaataggctagaacaagtagaagaaataatttcagagctgtatgataggtctttcaaattgacccacacagatgaaagaaagaaaggaaagaaaataatttaaacaaatcaacaaagccttcaagaaatatgttatgtaaaccagccaaacctacgagttgtaggtattacagaggaagaaggaaaaaaagttaaaagtataaaaaatatatttgaagaaataattcaagaaaacttctctggttttgtgagagattaagccatccaggtaaaagaagatcagaaaactcctggaaaacacattgcaagaagaaatacactaagacataaagtcataagactatccaaaggcaatgtgaaggaaaaaattctaagagtagtaaaagagaaaggtctaatcagctataaaggaaatgccatcagattaaaagcagactattcagcagaaactttacaagccaaaaaaattggtggccttttagcctccttaaaaaaaaatgggccaggtgcagtggctcacacctgtaatcccagcacttttggaagccgaggcgggtggatcacgaggtcaggagatcgagaccatcctggctaacacggtgaaaacccatccctactaaaaatacaaaaaattagccagacatggtggcgggcacctgtagtcccagctacttgggaagctgaggcaggagaatggcatgaacctgggaggtggagcttggagtgagctgagatcgtgccactgcactccagcctgggcaacagaatgagactccaactcaaaaaaaaaaaaaaatgccagccaagaatcttatatcctgccaagctaaccttcacagatgaagaaataaagtatttcccaaacaaacacggaggaaatttgtaaaaattaaaatggccttgcaagaaatactcaaaaagttctagacatgaaaataaaaggatacttgctatcataaaaggccatataagtaaaaatctcacagattctctaaagcaattatacaatttaaaccccaggggcaactaggcaacaacactatgacagaaacaaaacttcatatattaatattaaccttgattgtaaacggcccaagtgctcaacttaaaagatacggagtgggaaactggattaaaaaaacaagatccaaccacctgcagcctataagagacaacacctctgggctaaagacagctacagactcaaagtaaatgggtgaacaaagatatatcatgcaaaaggaaaacaaaagaaagcaagattagccatcctcatatcaaataaaaggaccttaaacaaacaacagttataaaaaagacaaataagagcattatataataataaagagcttaatgcaacaaaaagatacaactatccaaaatacacgttgatatgacttggctgtgtgctcacccaaatctcatcttgaattgtgtagctcccataactcccacatgttgtgggagggacccattgggagaaaactgaatcatgggggtggttcccccatactgttcttgtggtagtggataagtctcacaagatctgatggttttataatggaaaacccctttcgtttggttctcattttctctcttgcctgctgccgtataaaacaggccttttgccttccaccatgattgtgaggcctccccagcaatgtgaaactgtgagtccattaaaactctttttcttcataaatcacccagtctcgggtatgtctttatcagctgtgtgaaaatggactaacacacacatgcatccaacattggagcacctggattcataaaacaaatactactacacctaagaaaacagattgatagaaatataataatagtgggggacttcaacaccccactgacatgacaagacagatcactgaggcagaaaatcaacaaagaagctctggacttaaattggactatatagactaaatgaacctaattgtcacttacagaacattatatccaatgatcgcagaatatccattcttctcaattctgcatgaatgttccaaaactgaccatgtgcctgaccacaaagcaagtctcaataaattttaaaaacctaaaaatcatatcaagcatcttctcagaccacagacaaataaaattaggaatcaataccaagagaaatgctcaatactacacaagtacacataagctaaacaacttgctcctgaataacctttgggtaaacaacaaacttatggcagaaattgaaatctttttcaaaacaaatgaaaatagatacaatgcaccaaaacctagggcacagcaaaagcagtgctaactggaaagtttataatgttaaacacctacatcaaaaaaaaaaaatagaaagatgaaaattaataacctaacgtggaccctcaaggaactagaaaaacaagaacaatccaaaccaaaatctatcaagagaaaagaaagatcaagcagaactaaatgagattgagatcaataaaataatttatacaatgaacattccaactgataatacacaaaagagcatcagagactagtatgaacacctctacacacataaaatagaaaacctacaggaaatggatagattctgggaaatatacaacctcccaagatacaaccaaaaagaaataaaatcctgatctgacaattaatgagtaataaagctgaatcattacttccaacaacaataacaaaaaggcccaaaccagacatattcaaagcaaattttaccagatatataaaggagatctgttactaatcttattggaactattccaaagtattgaaaaggaaagatccctccctaactacttctatgaatccagtaacactctgataccaaaattaggcaagaacacaacaacaacaataaacacgacaggttaatatccctgatgaacataaatgcaaaaatcctcaacaaaaatactagcaaacaaatccaacagcacatcaaaaagataattcataatgatcacgtgaattttattccagagatacaaggatggttcaacaactgcaaatcagtaagtgtgattctttacataaacaggactaaaaacaaacaccatatgaaaatctcgatagatggagaaaaggcattcaataaaattcaaaatcccttctaaataataaatcctcaacaaattacacatcaaaggaacatatctcaaaataatgagaaccttctgtgaaaaatccacagccaactttatactgaatggagagaggctgaaaacattccctactagaactgaaggaagacaggatgtccactctcaccactcctattcaaggcggtactggaagtcatagccagagcagtcaaggcgtaaaaaaaatgaataaaatacaaattagaaaagaggaagtcaaattatctcagtcccttaatgatatgatcatatacctaaaaaaacataaaaactcctctattagtttggcagatttgagaagtgaagctatcaggtcctgggcttttctttgctgggaaactttttttgtaccctgaggtgcatcactggattatttgaaaactttctactgttttgatgtatgtgttaattgctataaaattccttcctactgctacttttactgcatcctataggttttggtatgttgagtttctattttcatttgtttccaaattttttttgatttccttaatttcttcattgacccagtgattgtccaagagcatgttgtttaatttccatgcatttgtacactttccaaaataccttttgttattaatgtcttttgtattccattgtggcctgagaatagacttgatatgattttgatgttttaaaatttgttgaaacttgtattgtggcctaacatgtggcctatcttggagaattttccatgtgctgatgagaaaaatgtgtattctgtagctgttggataaaatattctgtaaatgtctgttaggtccatttggcctaaagtagaattaaaattcaatgtctattgatggcctgtctagaggtctgtccaacggtgacagtagggtgttgcagtctctagctattattgtattagagcctaacttcttttttaaacctgttaatatttgttttatatatctgggtgccctggtgttgactgcatatatcttcttggtgaaatgactcctttatcattatataatcatcttctttgtctctttacagtttctgacttaaagtccattttatctgatgtaagtatagctacttctgctttgttttggtttctgtttgcatatttatttctatcccttcaattcaatctatgtgtgtcattaaaggtgaagtgactttcctgtaggcaacatgtagttgggtcctgttatttccttttttaaatcctttcagccagtctgtaccttttaattggaaaatttaatctgtttgaagtcaaggttattatttataggtgaggactgacctctttcattttgttaattattttctggttgttttgtgtattttttgttcctttcttcctttcattttattctgataaaagattttttttaactacagatgcaattccatgacttgttaatggtctgatcaggatttctatttcttcctggttcaatcttggggggctgcatgtgtcctagaatttatctatttcctctgggttttctagtttgtgtgtatagaggtattcatattagtttctgatgttcttttgtatttctgtattatcagttgtgatggcccctttatcatttctgattgtagttggaatcttttctcattttttgttgattaacctgcctagtggtctgtcaattttgcttaccctttcaaaaaccaactttttgtttcattgcttcattgcataatagttattttttcatcttaatctcatttagttctgcttgatctctttgctttcttttcttttgctagatttgagtttgaattgttcttgtttttctagtttcttaaaaattttgaaactttgatcaaagaaactgaagagttcacaaacacatacaaaaaatagaaaaaatatcccatgttcatggattgtaagaatgctgttaaaataactacactaccccaaaagatacaaagattcaatgtaattccaattgaaataccaacaacattcttcacagaaatagaaaaagcaatcctaacatccacatagggttgcaaaagatcccaaacaactaaagcaatcttaatcaaacaaaaacaaaaacaaacaaaaaacaaagttggaggcatcatactactggactacaaaatgtactacaaaatgttagtacatactgtactaaccaaaacagcatagtacttgcataaaaacagacacatacacaaacggaacagaatagagaacccagaaataaatccatttatttacagctatctgattttcaacaaaggcaccaagaacatttagtggggaaggaacagtatcttcaataaatggcactgggattatccatacccagaaaaatgaaactagactactatctctcaccatatacaaaattaactcaaaatgaattaatgacctaaatgtaagaactgaaactaaaaaactactacaagaaaacataagagaaatacttcaggctaatatctgtagaaataaaacctcaaaagcagaggcaacaaaagcaaagataaatgggattacataaaagtaaaaagctctgcacggcaaaggaaacaatcaacggagtgaagaaacaacctatagtataatagaaaatgtttgcaaactatttatccaacaagggattaatatgtagaatatacacaaggaactcaaactactcaacagcaaaaaaaaaaataataaaaataatcaaagtagcaatacaaatggacaactatatgaaaaaatgtacaacatcataataagagaaatgcaaatcaaaaccacaatgagatatcatctcactccagttagaatagtgattatcagaaagacaaaaaaaaaagcagttgctggtgaggatgtggagaaaagaacttttacacacttttggtgggaatgtgaattagccatcataaaaacagtatggaagttgctcaaagaactaaaaatagaactaccatatgatccagcaatcccactactggtctcagtcatatgtagaagctaaacaaattgatctcccagaagtagagaatagaatagtggcaactagcagctaggaagggaggagagatagagagaaggtagttaaaggacacaaaaattatagcttgataggagtaagttctagggttctacagcattgtaggctgaccataattaacaataatttactctatattttccaatagctagaagggaggactctgaatgtccccataatgaaattataatggtttgatgtgacagatatgctaattaccctgatttgatcattataacttacatacaggtattaaaatatcacaatataagccataaatatatacagatattatgtgtcaattttaaaagaatacctgtaaacatcaagatatatgaatgttatgaagatcaaactgagaactgcaaaatcagcatattctccactcagtctcttcttctcccaaataataacatacatacctgacagacatacaagaccttgtgcaacatgtgagcaggaacgggcaggtagcaggctgaggtgtctgcccagctcagtatttggatattaacctccactgtatttcactttttccttcctctagactggatcattccaggctagagaacattgttaatttatcttctatttgcttttgaactgagtacatttcagggtttagttttgtttttgttttatctatatctagctacatatttcatctctttaaaaaataaaaagaaaattgagctgagacaattgggttgttaactctatcaaaaaactttgcagccttaaaaaaaaaataaattggatcagtccattcactgtcctagtatctgtagccccaatttaaagccttcctttttaattacaaaaatctaaattgagaaaatgcttctccccaggaagattttaatatacgggaacagggcacagtcaccctaatacaaagccctaagcagcataggtgggccccaggacccctatgaaatatttcttgcactgtttctcgtgcgcaaaaagtccccagagatggccagcaagactctgcaactttcaattcattattccatacctgtccttctaaacctctatgctgggaccaaagtcctactctaccttaccttaccagggattgtagggttttcttatggtcaaaacaaaacaacaacaacaacaacaaaaaccacacacacacacacacaaagaaaaacccttagaagcttaggtccatatcctataaaaagaatgtcacagttgcactttcaatccctatgtcttgaccatctgagctttcacccatagcagaaactcagacttctgcccacatgtgacctccctgaggataagctggacttgtaacagatagaggtatggtaaagaggcagtcgcaattagcccttccattttgtccccataaggaggtagggacacagtgctttagttccttcccagactccaagatgccctcctacagccagatctcactcaagtgcaaggcagtaaaaatgttaggagttcaggctgtagagtcagcctgctctgggtttgacttccagttgcatgatccaaagaaggtggcctaacatctctgagactcattggcccagtttaacagatgaagaagctaatagtcgtctcacaagccatagtttggagagagagagagagagagaacataaatgaagctctcagcttctggaacataattaatgccagccaacattaagaacttatcatgataattagtaactaattaatggggaacgaatgctcacaaaaaggagggaaataaaaagcacagaatcaatcaacagggaaatagttaaatgaactttgttgctttcgggtttaggaagcactggcacacacattgcctcattttattatggtgaacatgtaaaagaggcaggtaccattattcccactccacatgttggaagtaaagctcagagttgcaaagaaaacgagtacttaaacaaaggatttctcagcaaggcaaaatttacttctgcagaagggtgctgcttgcatgtctggtcaccacaagagcacaccgaacaaagtggggaaggggcttttatccctaatgcagtttgtccctgctactgtgtcctgtatccattagctggagttggactgcacaatttaagctgaaccccactggctaacttgagaggtgcaggaacgtggttataccaatgggaagggcagttttggcaggaagagctgttgcgacaggaggggtaattcgcagaatgggttagcatatgtggtctttgcagataaggactggcgggaaagttgtttactgaaactaagacagggaggcataagggataaggaagttggtttgggcttgaagtagggaacaaagaacaagggcactgaacaagctaaacctttgaagaggaacttcttttgtatctgacacacagactagaaaaagtgtcctagactgggcatggtggctcatgcctgtaatcctagcactttgggaggctgaggcaggtggatcacctgaggtcaggagatcgagaccagcctggccaacatggtgaaaccccatctctactaaaaatacaaaaaattatctgggcgtggtggtgggcacctgcaatcccagctacttgggaggctgaggcaggagaatcacttgaacccaggaggcagaggttgcagtgagccgagatcacaccattgtactccagcctgggtaataagagtgaaactctgcctcaaaaaaaaaaaaaagttctaaaaatgtgggtgggtttgccagaggccatatgaccaggaggtagagaatccaggacttgaatccagatattctgtccctaaatccactaagctaagttgtttcccacggaaaactgaactccttttttataaccttctaagagggctagctttttaagcaaccagttctgaaagcatgttcgctaatgaagagccctcgggaaatgccaaggaaacctttgcatgggtgacccttatcttgcctccgtgtcctggccaccagaactctgctgttcttcattattttacgttgaaacaagatatgcccccaaatttcctgacaccttttccatccaccctactatatttaaaaccaccagctctgtgcaggggatgggaactctggaacaagttcatgggactacttcttaagaaattaaatggtaatttttaaaaagccacacccgaagaaaaaaacacacacacacaaaaacaaaaacaccagtgtagtaacatagatatgacaaggcctgagtgacttttgagattaaaagtgaaacatttcttagaaaatgatgattgacttgatgccttagactctccagcacaattgctggcctgtggcctcactgcggctgtgttctcgagcttgggtcctttctgactcacccgtagaccacagtgacgcctcctaattaagactttacctcttcttctcgccctgccaagtcactgtgcacccaataaagtctctttagaatactttcaacgtcattgccttgtgttcaatgtattttgcatcgtattcaacactctctgtagcccaatctcaaactaactctccgctctctctcttactgcttcactacacataccatactgtggccagacaactctccaagggaagacctctgcttaaatggcagagtgaagtgtttcctaaagtcctctaaaattctctctgtcctcccaatccccttcctaaaaatctgtggtcaagttaagaaatgttgcttggtaatccttgatctagtttcctcacagttgttacattattgcctggtggccatatttgcagaaagcccagaactctgaatatttagagttgggtgaatttttttttcctgacctctcccacctactagtcatatgatcttgaacatgtgaaaactcatctgtgaatattttctcatgtaaaaaatgggagtaatacagctttgcctatatgcttagagtctacttcagaagcgttccttaatgtctaagtctcttaaaattcttatgagaatgtctgagcattccccagtggcatatctggacagtgctctgtagaaggcattctactgggtgtgtgggagagtgaaagatacgtaagatctagctcctgttccaatgaacctttgtaggtgaggagactcctaccaaaaaagtctgtactactgcacattaatagtcaaatgataaactatgatgtacagagaaaagagaaggcactgtagactgggtggtagggggatcagctcatcctggtctgtctgggacttcccttgtgttagcactgaaagttccatgtcctaggaaacccttcagttgtgggcaaaccaggagggccgatcaccctacaatggttaaggaaggcttggcagtgattggagtgtgtctcagaggggcattttaggtggtaggaaacacacaaattgcctctctactaaacaaacatacacccaccctatgactcagcaattctagcgatataactgtgagagataagttcatggcagcattatttataatagccccactgcaaccaagcagatgtccaccaataggagaagggatatataattgtgcatttatagactggactattaaatacaacacaggtgaatttctcaggtatagtgttgagtgaaagaagccagacttatgaaaatcagaatctgtatgacttcttccatatgacagaagagagaataattaggagctattgattacaaggggacacaagggagatttggtgtgctagagaggttctatgccatgatctgggtggtggttacatgggtgtgtgtatatatatataagttaatcaagctgtttacttaaaatttgtgcattttattgcatgtattattcctcaaaaaaaaattttaagctgccatttattaagcctatgtgctctgcacagtgttaaacatttttatcctcacaatcctgtgaggtgtagacattggccattttatagattaggcccagaaaaggaaaaagaaaatttctcatgaccaagtgtttctcaaaaagtgtttcaaggaatagcagttctgcaggtgttatctgaaaaaaaaaaaaaagaaaagaaaaaaaaaaaaggcttgtgttcaactatgtttggggaactctgggagtaaaagggttaaatgtacctttttactgcaggattaatatgccaatgtgcatacctgatctcttttgtaaagcctccaaggtgtagtaaatactacagagaaatacctgtagaccaacatttacattttgagaaaatgatttagccttatattgtcaatatttgctttaatattctgagatttttgccctatgacattatgcagttaattttatagtataagcgctgcactcatctaacattaccagctcatatcagcccctcctccagaaaagcttttaggtgatactgttcttccctcatcacagcataatgccatcagcaaattagttattacatttcacagagcctagtggaaacctctcctgccaattactgagtagtcaattacattctggacatatgcattttacactgattaaaaaaagaattacagccgttgattttgcttttcaaattaagagataacatctatgtaatatagaattacagtgacttgactcaataaaatagtgatttaaaagaaaaaaaatgggatttggagaaaaactgtaaccaacacattatccaaaaacaaggaataagaaatgttgttagcctttctaagccccaaagactgaaagacctcagggaactgtaagttctaacctaatactaatactaccttgaaaagccaaaatgttaatttcctccagcactggagaggatttgtctcactagaaaattttagatataaacaccaagtcaaaaataattcttcagtgactctgagcattctgccaatgacaacagatttaaaatgcattttagaagcaatgacagggaattaaatagatttctagtgctgtaaagctgtaaagcttaatattacttcacaaagtgttaaagtgtctgatcttccctcagctcatttggtaccttgtgagcactgaagaaaagctaagtgcaggggcactttattaatgtattggaagccacatcaatggtagtatgcctaacaccttccaaaaagttttgagaaatctaaagtaaaacggcatgtgagttcctaaaagccttaacggaaaatattgtcagctatcacctacaaagctgcctctagctaaaggccagctataaattagagatatttaattttgcagtaacactcacaaaaaactacaatgcattatgcttcccctgaaaataatgcaaagattctaattagtttttaattgcttgctaaattgttcagttttattcaaaatggcctttaaagagctatgcaccaaaaatacttccaatatttctgtgagaaagttgtcagccctcctagcctgaaggcagcagaaattgaactccacaagtgcacaggcatggggggctcacatgatttttagtaagggaggattttatttcaaccacctgtgacctcaccaaaacaaacaggtctgagtgcagaaaacaacttgatgtaaacaaatggaatctgggttgcctgagattctgggatgtgaatgcgttcacctggaaaagataatgtcctgggaggtcactctacccagactcccctttatctaaatattctcaaatgtttctatggtcaaacaccaaccattttagttaagatttatacagaaatgagccagagaaactcttataaatttgacctggttacccactggctactaacagagtcatccacttcctttggaaatggttccaatcctgaagattcaagacaacttcagctttcagtcaagattgagtaacagttatcagatttaccctcctgccttaaataactacaaaagtggacaaaatatatgaagcaatggttttctggacattaggtatcaggcaacacaggactgtgatacgtaagaagggaaatagaaaaggtgaactctacaattataccagcttcctacctgaaggcagtttccaggccttagtacagggaggggaaatgaagctcagctgattcaccaattcagggagacagagtcagagttcagaggacaaggcagccagaatttgtaaggcagagcacaggagatgagggaaatgcagagccagagagcaccagaaacctgcagacggtcccctcaaggattacttgagttccaatctgtatggtgtgagaagataatactcgaggctgggaaagagccaccagaaaggaataagcaggaaaaatctcactcctaccagccagagtgaaaagaccacataatacatgagggaccagacagatttctttaaaataaaggggaatcacatgaggtatctaaataagtcaaaatcatagaaacagaggttggaagatggttgccgggattgttgagaggagacagaattagtgtctaaggggcatagagtttcagttctgcaagctgaagctctggaaacctgttgcacaacaatgtaaatatactaacattactgaactgtacacataaaaatagttaaggtggcaaatttaactttatgagtttataaccacaattaaaaataaaatttaaacataaataacaataaaaatgaataaaaaggaaaggagggcctaaattagcccaagactgctctgcatgtgcccaaacgaagcttacaagcaagcactgaaaggatccaactaatcccaaataactactccacaaagaagccacattacttaaagaaataaaaccaatcacagcaataatatgaaattcttcgtattcatcatccagtcagaaaaaagacagcaaagaaatggaaaaatatgacccatatccaagagaaaaagtaatcaatagaaacagagccagaggcaagagaggtaataaaaagggcaaataaatatactaaaatggctattataaatatattcaatatggtcaggagagaaaaacatcatcatgatgaagagagagagtaaaaaccatttagaaatgaaaaatacaatgtctgaaataaaaaattcacggaatgggattaacagtggtgtaaacagtgcagaggaaaagatgagcaaacttgaaaacatggtactagacattatccagaaagaaaaaaacgacagaatgaataaagcaccagtgacatgtgggataaaatgaaagaagtaacatgcatgcaattacagtcaaggaagtagaaaaaagagaaggtggaatagaataaaaatatgaagaaataaactcatatgatgaagtacaataaactccttgcagaataaaaatgaagaaaaccacacaaagacacgataatgaaatgttaaccagtaataaaatgaaaatctgaaaaaacatccaagagaaaaagatacatgacagcagcattgtcagaaattatgcgagccaaatgacagtggaggaacatccttaaagtactgaaataaactgtcgattcaggattccctacccagcgaaagtcatctttcaaaattaaagacatttttcaaattaaagctgggagaattcagttgtcagcaaaacttaagcaaaagaaatgaataagatactaaacagaaatttgagcctttaccaaagagaaaagagcactggaagtggtcattatattaacactattaaaaaattttaaatctttttaaaggataatagtttcaaacaaaaataacaacaacatcttgagaagtttataaacatatgtaaagagtacaatgtatgacaacagcacaaacgataggtgggaaatggaccttacacagaaggggataaaatattatttgcaggtagtacgtgcatgttgtaaaccctgaagcggggtcagcaaactctggcacaggctaaatccagcctgttatttttgtatagttcagaagctaagaatggtttttgcattttggaagaggtgagagggaaaggaaacgtgaaagcatctacgtcacacaaaatctaaaatatttgctacctggttctttacaaaaaagttgctaagccctgtcctagaataaaatttctctaccttggtgctactgacattttgagccagataatcccttgttgtgggggttgtcctgtgcactgtaaggtgtttagtgggactcctggcctctacccaatagatgccatgaacacccacccccagtagtgacaaattcaaatatgtatccagacactgacaaacgtcctgggggtgagagagaaatctgactgcagttgagaactactgcactagagtacatctatttttttttttttttaaataaaaaagaggtagagctgggccagccatggtggctcacgcctgtaatcctagcacttctggaggccaagcagggtggatcacctgaggtcaggagttcaagacaagcctggtcaacatggtaaaactccgtctctactaaaaatacaaaaattagctgggcatggtggcacttgcctgtagttccagctacttgggatgatgaggcaggagaatcacttgaaaccaggaggtagaggttgcggtgagcagagattgcgccactgtacttcagcctgggtgacacagtgacactccatctcaaaaaaataaacaaataaataaataaaggtagagctgataagccaatagtagaaataaaatgaattcttcaaaaaaaatttttaaactctcattccaaaagaagtcagaaaaagaaaaaagatttttcagataaggcataagtataaaccacagaaaaaatattgataaattagacttgatcaaaatttaaacttctgctcctcaaaagacactgctaaaaaaattaaaaaccaagccacggacagaaggaaaatatctgcaaaacacacatttgataaagtactagctttctcccaccgcccaaaaaaaaaaaaaaaaatatatatatatatatatgtatgtatgtatgtatgtatgtatatgactcaagacaacctgatttggagacaatataaaaagaaggcaaatatgcacatgaaaatatattaaacatcattaataagagaaatccaaattaaaaccaaaatgaactaccacgacacatccacagaacactgaagatttaagagacggacaataacaagtgctgacaaagatgaggagcaactagaactctcaggcatggctggtaagactacaaaatgggacaatcactttggaaaacaatttgaaactttacaatgaaataaatgtgcactcactatatagcccagcaatctcataggtatttgccccaagagaaatgaaatatatgttaaggcaaaaattgttgcccaaatattcttagcaactttatccatgataatcaaagagcatgaacaacccaagtggtccatcaactggtaaatgaataaatagaaagaaacaaactactgatacaagaaacaacagatgaattcatcttaagggcattatgcaaagtgtaagagcaacagcaaagactatatactgactcatttcttttctatgtaattcaagaataggcaaaactatagtgacagaaagcacatcagtggttgccaggtcgaactatgggcagaggaacttgcctgcaaaagaaaatgaggggacttttggaggtgatacaaacattcaatattatgattgtcatagttacacaactgcatatatttgtcaagacccagagaatcatttaaaattggtgatatttttattgtatcaaaaaagatgatataagctgatttaaaacaaaaatagccaggaagcctttagaaataagaatggagtaagagtgagactacattttcccctagtcattagtaggaaaaacaacttgctacaattcaggatgtccgggaaatagtccttctggtcaaatttggtagggtgctagtgctttgggtccttgtacaagaatatacatttaactaaaatactggttgagagtatttaggccacagggttaacagtaggcacacatgggaatttagtattattcccagtaaacggggaaagaatcaactcttcaatagacagtatcaagagaactcctgaggcatttagagaaaaacagttccatatcatacagtacacaaaatcaaattacagatggaatacaaatgtaaatttaaacaagattataaagtcactagaagataatattaaatttttaaaatcttgtgatagataaggcctatgtaaacaagtcacaagacccagaagagtagatctgactacaattaaaacttaaataaaataccgtaaaccaagttcacaagctcagacagcccaaaagatacttcatacatgaaagtataaacatttctataaatatgagtataggttacttataaatatacttatatatatatgatgcatttgtttaaatactaaacgattaaaagccacactgtatacaatacctataaatcaggagaagaaatggataaattcctcgacacatacactctcccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaactattccaatcaatagaataagagggaatcctgcctaactcattttatgaggccagcatcatcctgataccaaagccgggcacagacacaaccaaaaaagagaattttagaccaatatccttgatgaacattgatgcaaaaatcctcaataaaatactggcaaactgaatccagcagcacattgaaaagcttatccaccatgatcaagtgggcttcatccctgggatgcaaggctggttcaatatacccaaatcaataaatgcaacccagcatataaacagaaccaaagacaaaaaccacatgattatctcaatagatgcagaaaaggcctttgacaaaattcaacaacgcttcatgctaaaaactctcaataaattaggtattgaagggacgtatttcaaaataataagagctatctatgacaaacccacagccaatatcataatgaatgggcaaaaactggaagcattccttttgaaaactggcacaagacagggatgccctctctcaccactcctattcaacatagtgttggaagttctggccagggcaattaggcaggacaaggaaataaagggtattcaattaggaaaagaggaagtcaaattgtccctgtttgcagatgacatgattttatatctagaaaaccccattgtctcagcccaaaatctccttaagctgataagcaacttcagcaaagtctcaggatacaaaatcaacgtacaaaaatcacaagcattcttatacaccaacaacagacaaacagagagccaaataatgagtgagctcccattcacaattgcttcaaagataataaaatacctaggaatccaacttacaagggatgtgaaggacctcttcaaggagaactacaaaccaatgctcaaggaaacaaaagaggatacaaacaaatggaagaacattccatgctcatgggtaggaagaatcaatattgtgaaaatggccatactgcccaaggtaatttatagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgacgcatatctacaactatctgatctttgacaaacctgagaaaaacaagcaatggggaaaggattccctatttaataaatggtgctgggaaaactggctagccatatgtagaaagctgaaactggatcccttccttacatcttatacaaaaatcaattcaagatggattaaagacttaaatgttagacctaaaaccataaaaacctcagaagaaaacctaggcattaccattcaggacataggcatgggcaaggacttcatgtctaaaacaccaaaagcaatgccaacaaaagccaaaattgacaaatgggatctaattaaactaaagagcttctgcacagcaaaagaatctaccatcagagcgaacaggcaacctacaaaatgggagaaaattttcgcaacctactcatctgacaaagggctaatatccagaatctacaatgaactccaacaaatttataagaaaaaaaacaaccccatcaaaaagtgggcgaaggacatgaacagacacttctcaaaagaagacatttatgcagccaaaaaacacatgaaaaaatactcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaacctttgtggaagtcagtgtggcgattcctcagggatctagaactagaaataccatttgacccagccatcccattactgggtatatacccaaaggattataaatcatgctgctataaagacacatgcacacgtatgtttattgtggcattattcacaatagcaaagacttgcaaccaacccaaatgtccaacaatgatagactggattaagaaaatgtggcacatatacaccatggaatactatgcagccataaaaaatgatgagttcatgtcctttgtaggcacatggatgaaattggaaatcatcattctcagtaaactatcgcaagaacaaaaaaccaaacaccacatattctcactcataggtgggaattgaacaatgagaacacatggacacaggaaggggaacatcacactctggggactgttgtggggtggggggaggggggagggatagcattgggagatatacttaatgctagatgatgagttagtgggtgcagcacaccagcatggcacatgtatacatatgtaactaacctgcacattgtgcacatgtaccctaaaacttaaagtataattaaaaaaaaaaaaaaacctcaaatccaatagaacaggcaaaagatgaactggcaattttcagaaaaataaacctgtgaaaatatagtaaatgatgagataatcaaatcaaataacagtaatcaaataaatacaaattacaatgtttttttcattcatcagagaagcattttttaaaattattaatattcagtgttatgaaagcatgtcaaactgtcactcccatatactgtgggtaggagtataaaccagtgctctgttgttcaagacactctggcaaaagctatcaaaattttaaatccacaaccctcaatccaaaagtcttcatccaataatctaaacatagactatcttagagaagacacaaagtgttgcattttgaatcctttttatgtatctatttgtaataatgaaaaactggaaatttgaatacccatcaatactggggaataggttaagtaatgactcatccatccacagcagacatagatgtttttgcctgcaaagcagttcttccatcttcttctagcaacagaaccgccccctttcccctagaaactgcccttccatcacctgggaggtatcattcatgaggctctacccactctctatcaggacagaaatgtgatttaatgggaacagatgacttcatttctctggttgtatagtgagtggtcaaaaaacaagcggaaaatatgacccaagcagatgctagaagaaaggagtctctctctccgagtccataaaaactggggccatctttggcaccacgtcgaacaaagccaacctgagagtgacagccacaccagaaaaggcagaactaaaaagatggatccaccaaccatgcctaaaatcagctcttgtcctcagacttcctagttccaggaccaaacctcataaggcctgcttgagctgagtttctgtaacttataactgaaagaattctggcaatggagtagaacacaaatacacagggatgaggtggatctgtatgtacagacataattttccacaaggtgttaagggaaaacagcaatagcaattttcagagcattattatattatgcctggtttgttgtttttaaaagatatacatttttctgttaatagtgagcgctggcaaaagaggagaatattcattttaacactaacacataaaagaccttgaaaaatattatttatacacattttttaaaatcacacaataaaataaaacatcatgcataaaatttgcatcaaagcccagtcatcaaatttaccttaatttccaaagaagcccatggaatatttttcctagaaaggagaagaaatagcagcagcaaactgaattataaagaaacaaaagtggtattgctcccatgaggtcatcagtgtttgatatataactttcttcatctccctctggaaagccaaatccagaaaataaatatttcaacatccttctacaactccaggaaagggagatatacttgaggtcaaatgatctctgggcagtttttaaaaatatattcatgtttacatctatgttgcaatgacagaccaagaaacctaggaaaggtgatacttgtgaagctcaaatgtagtcaattaacatacagaattttgctacctgccatattcaggttacactaagggaagaccagaaggacaggacacagggtaactcaatcaacacagaagactatcctttttccacatcagtgttttcatctaaaatgccaaatccataccactccagggtgctctcagtactccctacactgtgctgagatgtgtgactccccatgactgagaaaaaaatctactctctgtaacttaaacaagaacgcataaggcctattcactaataactaattatgtgaataaaaattaatattagcttagatttaaactaaaatcaaaataaactctgaaaaactatcatgctataaacaggaacaaggatggtattaacttcactgacctatctgtgtattgtcttgacattctagaaaggtacaaaagaatatataaaatctaaactccaagataaagtgaaaattcaattgaaaaaccaacatgattctttaagatgaataaatggctttatcttgaggcatcatatctagagggaaaaagaaaaaagaataaatggtttttaagtcaatatttgactgaagctgatgcagaattaatcagtattacattttaaaactctttgcaacaggatttttaaaaagaagtaaaaaagaaacctttcaatgatcaaacaataaatctaacatatatccttctacatttagtagcatcttaaaaataagagtttttttttttcaaatttaagaaacaaatataaccacacttagggaaaaaaaaataatactctttctgaaacaccaaaaagataaaatactgtgggttcttaagataattacatatgccacactggcactatggtccataatgggtttgaaaaaataacaagatttgattttattatttcatcactataatcttaatcattaggcatattaatgtcacgtatacttttttaatatttatttttaaaagctatgtctcaacaatatgacaccaaaaacacacagctgatacaggttgtataggtaatcattttgactgtgaaaaaatatgatcagaatactgttacaataaaggaaaaataccttctttttaatcattctcattcagcaacagtaaaaatgctctatgtacacggtggctctgaaggacacatttcatctctttttcagacctgctgtgctatctattgctgttttggtgattacacagttcaatatgaaaatgcgtcccattcagattctcaatagtaagtctgattaggcagataactttccaatcataaaagcttttattttaggacaaccattatgcaaatctagggtggaaatcggactcactgtaattgggataagaagacactctgagaagaaggctgtacatgtgacactgcatttggtgcactcgtcttgcattctcttcctttcttcctcctctttgaagccccagattaaagtataattacactagagagttacaaatgggcttattagaagagaactatatgtttaagacagcaaggctttcagataagaaatctccaaatattttctgttatatgtttttacagtctttcttataaagaaggagtgtttgatgcgcaacacctgctaacagaaataattctacactcaagcccagtagaataatcaaatataaaatacagacataaagcaaactacaacggcaacagtgattcttggggcagcatgtgcaaaatacagtattttgctatctaatatcattgtgatcagaaaagaaatgtgccaaaacactgtttctcattccacttgaactggatccccataattccaacaaacatcacttgtgacattaggttgtcatcagcttgcatgatccccagttcacttaaccttttcttcttcatctggcctttttgtgtaaaggcagaaaccagttcatttacaatttccctcaacttgctcagaaaggtcagatcttgcataaaactccattttagcaggtgcacattgcatcagctcctctggatctactctttcagctacatctgcctttctacttgtctgaattttaagtgctttattttctggataaacaaactatgacaaagttcagtatgcaagctagcccaactaaaacataacatttctacacagtctgttagagctttcaagtgttttctgccaagtattcctgctgtcatctaactggagtttacaaattccttgccataagaatctcaatgagtagttttttccaattctgtgaagaaagtcattggtagcttgatggggatggcactgaatctataaattaccttgggcagtatgaccattctcacgatattgattcttcctatccataagcatggaatgttcttccatttgtttgtgtcctcttttatttcattgagcagtggtttgtagttctccttgaagaggtccttcacatcccttgtaagttagattcctaggtattttattctctttgaagcaattgtgaatgggagttcactcatgatttggctctctgtttgtctgttattggagtataggaatgcttgtgatttttgcacattgattttgtatcctgagactttgctaaagttgcttatcagcttaaggagattttgggctgagacgatgaggttttctaaatatacaatcatgtcacatctgcaaacagggataatttgacttcctcttttcctaattgaataccccttatttctttctcctgcctgactgccctggccagagcttccaacactatgttgaacaggagtggtgaaagttcatatggaacccaaaaagagtctgcattgctaagacaatcctaagccaaaagaacaaagctggaggcatcacactacctgactatactaaaaggctacagtaaccaaaacagcatggtactggtaacaaaacagcatggtactggtaccaaaacagagatatagaccaatagaacagaatagagccctcagaaataatactacacatctacaaccatctgatctttgacaaacctgacaaaaataagaaatagggaaaggactccctatttaataaatggtgctgggaaaactggctagccatatgtagaaagctgaaactggatcccttccttacaccttatacaaaaattaatttgagatggattaaagacttaaatgttagacctaaaaccataaaaaacccagaagaaaacctaggcaataccattcaggaaataggcatgggcaaggacttcatgtctaaaacaccacaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaaacaaccccatcaaaaagtgggtgaaggatatgaacagacacttctcaaaagaagacatttacgcagccaacagacacatgaaaaaatgctcatcatcactggacatcagagaaatgcaaatcaaaaccacaatgagataccatctcacaccagttagaatggtgatcattaaaaagtcaggaaacaacaggtgctggagaggttgtggagaaataggaacacttttacactgttggtgggactgtaaactagttcaaccattgtggaagtcagtgtggcgattcctcaaggatctagaactggaaataccatttgacccagccatcccattacagggtatatacccaaagtattataaatcatgctgctataaagacacatgcacacatatgtttactgtggcactattcacaatagcaaagacttggaaccaacccaaatgtccatcaatgatagactggattaagaaaatgtggcacatatacaccatggaatactacgcagccataaaaaaggatgagctcatgtcctttgtagggacgtggatgaagctagaaaccatcattctcagcaaactatcgcaaggacaaaaaaccagacaccccatgttctcactcataggtgggaaatgaaccatgagaacacttggacacaagaaggggaacgtcacacactggggcctgttgtggggtgggggagggggagggatagcattaggagatatacctaatgtaaacgtggagttaatgggtgcagcataccaacatggcacatgtatacatatgtaacaaacctgcacgttggcacatgtaccctagaacttaaagtataataataataataataaaaagaaaaaaaaaagaatctcgatgagtgactgtcttgctctttatgccaaggtttcctgatcttcatacaggatcacaaattttgaactatttgtctacccttttcatcctacaatcttccccactcaacagatatttattggatatttactatctgttaaacattgtgttaggaactaggatgcagattggtaagacagtgctactttcctttaactcccaatctagcagcaaactctagatgagccccatgatcccagcccccggtattattttcatgacgattaaatggcaaaaggagtttgcactgcaatttgcaatgtaattaaggttcctaatcagttttctccagctggttgcaaaagaggaaaagaggaagtcagagagattcaaagcatgaaaggtttgccttgagggaggctctcttctgctgagatagaggggaccatgaggcaagaatctgagagcagcctctagaagctaagtgcgagccccagcaaatagccaacaagaaaacagagacctcagtcctacaacctacagaaatgaattctgttgatgaataacatgaatgtatttggaagtaggttcttccaactgagcttttcttttttttttttttttttttttgagatggagtttcattcttgttgcccaggctggagtgcaatggcacgatctcggctcactgcaacctctgcctcccaggttcaagtgattctcttgcctcagcctcacgagtagctgggattacaggcatgcgccaccacacccggctaattttgtatttttagtagagatggggtttctccatgttggtcagtctggtctcaaactcctgacctcaggtgatctgcctgcctcggcctcccaaagtgctgggattacaggcgtgagccactgtgtccagccccaactgagctttcaaaccagagcactgtccagctgacaccatgacttcacccttcagacctgtgaagaaataaagaacttgctcttcaggagtggaccctgaaggatgacaaggagtactcttgaaactgctttaaactttccttaactcggtcaatgcttaattcttctctatgactgagatttagtagactgagatctatgtcatcgctttgaagttcacaaatatccagtgagttagctcacctttgctgccaagaaaggcagatgacagggaggcacttccttctaccaataaaaaatggaggcaaactccactattggctccagtaaacacagccctcaacctggcacatggattaccccacctccaacctcaacagatatcagccggagccaccactgctatcacacacccatcctcattctatacgtttatagaaagccaaccacagtaagaagggaactgaaggaccacagaaaccacaatgtcaaggttttgaatgaacagttgaactagctgactttgaaagttcctttctccctcagattctataatgttatagctttaccaaaacttctctttctccatgcccaaacatattctggcaatcttaaaaaaaaaaaaaaaaaaagcaggaagactcagatccttaatcggattttaatgctgaaaaaaaaagtaaattaggtctgatttttctatctaaaattcctaaatatcgcataccttcagtttcatcttgggcactttcttggaggttagagaaaactgtagctttcaccaagaaaacaccataaccttcattttatgatattactcaccaaggatattttgggaatgtcataatgttcatctaagaagacctgtgacactgaaaacaaatgtttcaaggaactgtcttttcaacactgcctgcttaaaaaatcttgccttttttcacactattctaaaaataaagcagaaaagctatgctgctatgctgattcacatgctgtagcacagtgtgatgcagcattcctctgtcatttctgcagatctagaggcaacaaagtattcttgcaaaagactttcaatcattagctactgatattattagaatttatatactatttaggcctttcaaagtcggaaaacaataggacccaacatgggaatgtaataaagcataatttcttaggtgaaatcattccaacctttagaaagcaagtgtctcggccaatgctcagcttaatgaggagcccttccttgcaacagcgggtccattctcacgcagggaacccaaacttactcccaggatatatttctatgccagcaccctgcaagttacaatttgagataataacaatcagtttcaaaaaggcaggaagaattttattacaatcactttttaggcttttacacagtgcaaatgtaaagcacaaagataaagcattttacagataagctttattaggtattttaaaccaacacttcatttgttccagattagcaagtcattagcatgtatcattttcaaaccacccccaccccaccccaacatacaggctgagtgtcaacattcaattcctgttccactgtctttcattctagataaatcggttttcagattctgccaaaagtagaaatcctttaacaattttgttgaaagatgcacttaatcaaaatgaccattctctcatctactcaattagtgaagaacagtatttgagtttagtaaaatattataatttgagactagaaataaggccctatatttaaaaaattccagttataagataccccaatccaacttaaaaatcacttctacgaattaagcaatggccttcactgctacacaggttaaaattaacaactagttcaagtgtaatttatatagagtaaccagaaagattcaaacctggtccaattctctcacactgtctcctcacaccacatggcaccaacaaaaaagaaacagtaataggaataatttatttcctaatgttatgcaaggcactttaaaaagcaaaatgagtcactcaaacctctatagttatttaggaaaccacttaggaataatttaatacacaaaatcataggtgaagaagagctggtataactactcatgacacatctactgcatgtatgatacttttctaagagcagtcatataccatgagaaaacatttattattatttttccctttgcatatgcctgaaccatatatgtacacactaacttatctcttctgtagagatgtttttaaaaatctgctaactgggacttcagaaaaaaaattttcagctcggggttatgtgcaaaaaagacacaggagtgattatattaaaaatacatatacaaatagttaaatatcgaacttcaggaatcacataaaatttaaaaagaatgggaacagcagctatctggcaaatgatatgatcatattcaaacttagttataaagatgaacaaataatttggcaattaaaaagtaactgccacttgtgaaacaatagagatgtctctattttttctgctaggtataaccaaaaaccatgggcattgtatataaaataaacataagataactgaaaaatggaaagaaggtggcagaccagcagcagacctcaagacccaagaaagaacaccaacacagtgggaagttcccagggttttcttttcacttcataatccccagacttggagcttatgtagctggcaatccagtatacaaacagacaaagaccaaaaatgcccccaaaatactgctttgtctagtcaaaggactaggcaacctagaaagatgaaggggtgggttgcccctccacacctgtgggtgtttctcgttaggtggaacgagagacttggaaaagaaaaagacacagagacaaagtatagagaaagaaataaggggagccagggaaccagcgttcagcatatggaggatctcgccagcctctgagttcccttagtatttattgatcatttgtgggtgtttctctgagagggggatgtgtcagggtcacaagacaatagtggggagagggtcagcagacaaacacgtgaacaaaggtctctgcatcatagacaagataaagaatcaagtgctgtgcttttagatatgcatacacataaacatctcaatgctttacaaagcagtattgctgcccgcatgtctcacctccaggcctaaggcggttttcccctatctcagtagatggaacgtacaatcgggttttatacggagacattccattgcccagggatgggcaggagacagatgccttcctcttgtctcaactgcaagaggcatgccttcctcttatactaatcctcctcagcacagaccctttacgggtgtcgggctgggggacggtcaggtctttcccttcccaagaggccatatttcagactatcacatggggagaaaccttggacaatacctggctttcctaggcagaggtccctgcggccttccgcagtgtttgtgtccctgggtacttgagattagggagtggtgatgactcttaaggagcatgctgccttcaagcatctgtttaacaaagcacatcttgcacaacccttaatccatttaaccctgagtttgacacagcacatgtttcagagagcacggggttgggggtaaggtcataggttaatagaatctcaaggcagaagaatttttcttagtacagaacaaaatggagtctcctatgtctacttctttctacacagacacagtaacaatctgatctctcttgcttttccccacaaaagacagaaaacagacaataatacctccattccagccaaacagcacaaaataaaagagcgaccccattcccatcatgccagccaaggttgagaggaacctggacttttgccctctgaaggctgtaaccaggtatcccaacactcccactggggtggaatcagtaaaagcaaaacagggagccaggactttcatccccactaactggtgacaaggccctctctgcagcagtattagtgaagactgaggagcctgggcttgtacccccacctagcagcaacaagatgcctgccccctccccattggggtggtgtcagagcaagcctagtggagattacaactttcacaattggccagtggtaagaagaccagccccatataccacagtgtcagtggagaccaaatgggaagctagaattcccactcttacccagcagcaacaaggagctcctccacccagcttgagtatcaacagaggctaaggggaatccatgacttctacctcaacaaggtaatggccacctacccccatcttttatctttctgcagaaatgtcagagaagttagagaagatccagactttcataatgtaatacaaaaaatgtccaggattcaaatgaaaattacttgtcataccaagaaccaagaaggtgtcaaattgaataagacaatcaactgatgccaaaaccaagatgtcagagatgacagaattagctgacaataatttgaaagcagccaggataaaaatgcttcaatgaggaattataaacatacttcaaacaaatgaaaaatgagtctcagcaaagaaatagaacacagaaataacccaattaaaattttatttttattttttatttcaatagctttaggagtgtaatatagtttggatatttgtccccacccaaatctcatattgaattgtaatcgccaatgctgagggtagggtttggtgggtggtgtttgagtcacggaggcaaatctctcttggcttggttctgtcttttcaataataagtgagttcttgtgagatgtggtcatttagtgtgtgccccctcctaccccctttcacttgctcctgcttttgccatgtgaggtacctgctccctttttgccttccaccatgatagtaagctccctgagcctccctagaagctaagcaaatgccagcatcatgcttcctctaaagtctgcagaaccatgagccaattaaacctcttttctttttaaattacccagtatcaggcatttcattacagcaatgcaagaacagcctaatacagaaaactggtaccaaggagtggggcattgctttaaaaacacctgaaaatgtggaggcagctttggaactgggtaatagcagaggttagaaaaagtgtggagggctccaaaaaagacaagaagatgagaaaaagtttggaatgtcttaaagactggttaaatgattgtgaccaaaacgctgatagtgatagggacaatgaagcccagcctcagatggacatgagaaacttactcaaaactggagaaaaggtcatgtgtgttatgccttggcaaagagcttggctgcattctattcatgccctagggatctgtggaagtttgcactacagagtgatgacttagggtatctggcagaagaaatttctaagccacaaagcactcaaaaagtggcctggctgctgcttccaacaatctacacccagatgcaagagcaaaggaatgactttaagttggagctttaaagggggggcagagcataaaagtttagaaaatttgcagcctggccatgtggcagagaaagaaaaagctttctgggggagaattcaagcaggctgcggaacaactacttgttagatacttgcgtgactaaaagggatccaagtgctaatatccaagacactgggaaaaaggtcttgaagccatttcagagctcttctcagcagcccctcctatcacaagcccaaaggcctaggagggaagaattgtttgggtggccaggacaaggttcccaaagcctgcacaacctcaggacagtgctccccacattctggctgctctggctccagctgtggctcaaagagttgcagatactgcttgtgcctccaatccagagtgggtaagccaccataggctttggcagcttccacatggtgttaagcctgtgagtgcacagagcgtaagagtgaatgaggcttgctactctctacatagatttcagaggacatacagaaaagcctggatgtccagacagaagcctgctgtaggggaagagccctcatggagaacctctactaaggcagtgcctacaggaaatgtggggatggaactcctagagtccccactggagcattgcctagtggagctgtgagaagcaggtgaccaaactccagatctgagaatggtagatccaccatcagcttgcaccctgagcctggaaaagccacaggcactcaacagccagtgagagcagctgcaggagctgaactctggaaaggcacaggggaagagctgcccaagaccttaggagctcaccccttccatcagtgtaacctgggtgtgggacacagagtcaacggagattattttggagatttaagatttcatgacttccctgctgggttttaaacctgtatgaggcctgtaacccctttcttctgcctggtttctcccttgtggaatgggaatgtttacccaatgcctatagctccattctatcttggaagtacataacttccttttgacttgccttgttcagatgagactcagatgagattttgaaccttaaacttttgaactaatgctggaataagttaagactttaggggactatcaggaaggcatgattgttttttgcaatgtgagagagacgcgagatttgggagggtccggggcagaatgatatagtttggatatacatttttccctgcccaaatctcatgttgaattgtaatccccaatgctgaaggtggggcctggtgggaagctcttggaccatgggggcagttccctcatggcctgatgctgtcttcatgatagtgagtgagatcttgtgagatctggtcatttaaaagtatatgacacctgcagtccctctatctctcttgctcctggtccagctaggagctgcaatgtgccagctccccctctgccttctgtcataatagtaagcttcctgagacctccctagatagaagcagatgccactagaagcagaagccactatgcttcctatatagcctgcagaaccattagccaattaaacccctattcctatgaactacccagcctcacatatttctttatagcagtgtaagaacatcctaatacagagtacacatgctttttggttacaggatgaattatagagtggtggagagtctgggattttagaatatccatcaccaaaatagtacacattgtacccaacaggtactttttcatccttcaccctccttccaacctcgcctattctgagcctccaatgttggtgataccagtctgcaagcctctgtatacctaaagcttagctcccacttgtaagtgacaacatgtagtatttgattttccactcctgagttacttcctgtagaataatggcctccagtttgatctaagttgctgcaaaagacattatttatttttcatagttcattattttctgagtagtatttcatgatgtgtgtatatgtgtgtgtatatatatatatataaaacacaaaaataaaaattttagaactgaagaataattaaatacctcaatgataagttcaacagcagaatgaaaagaacagaggaaagaaacagtgcatggaaagacagaacaataaaaatttaaaaattaccctatctgaacaatagagagaaattaaactgaaaaataaacgtaaactgagcttcagggacctattggactataagaaaagatccaatatttgtgtcattacagacctggaaggagaggagaaaaaaggtgaggctaaaaaggaaataatgactaaaagctcccacatttggtaagacacaataagcccacagagtcaagaagctgagcaaactccacacaggataaactcaaatgaatccatgaaatgatatatcataattaaattactgaaagctaatggcaaaaacaaaaaaaaatattgaaagcatcagtgaaaattttacaccttagccattggagagaaattgtgattgacagcatcagaaaccatggatgccagacaaaagaggcccagtattatttaagggtggaaagaaaagaactgtcaatccagaatcctatacctgataaagatattcttcaggaatgaagaaatcaaaacattctaagaagaagagaaactaagataattagcaaccagcagatctactctaatggaatgggtaaagaaagttctctgaacaaaagagaaataataaaagagggaatcttggaacatcagaaaggaaaaaggggcaaaagcaagcaaaaataccagtaaataggctttccttctcctcttgagtttaaattatgtttgaaatttgaaatgaaaatattagtatcgtctaatgtggttctagatgtacataaaggagatatttaagacgattataaaaagaagaaaaagaaattgcagggagccaaaggcttgtgggacgtgaccaactcagcattccactggaggctatatgatcaaacaacaaactgtttttcatgaatgcaggatgtgggcaaactcatgactgctcctgctggcagaaggtttgctggaggcaatcactccctggtgctgaggttatctgccgtgacatctacagcctgttgttcgaggactgcattcttgcaagcctactctggaccaggcagctgaccccttctttcatcccccttctcactatctcttttgcctaataaatatggaagactgtgtaaagctcagggcccttgtccactagaggcaaggtgccccctgaccccttcttccaaatatactcttttgtctcttgtcttttattcccacattcacccggctttgtttggtccccctaggtctgtgcgggttacatagtggtgccccagtcagcgacagaatcgggtgctccacaagagatgtaaaaaaagcagagtttctctacttcacttgaactggtgaatgaagacaccagtaaactgtgaggctatgtacatatattacctgaagcgatcactaaaaaaatagctacacaaaaagatatattcaaaaacaaatgaaactatgaaaactgctcaggtaatccacaggatggcagaaaaatgcaaatcaagaaataaaaagcagaacaaacagaaaacaacaaataaaatagactaacgactaaacatcaataattaaatgtaaatggtctaaagacattaaaagacacagattgggagagtggattaacaacatgactcaactatatgctatctacaaccaaatttaaacagaataatataggcaagttgaaagtaaaatagtggaaaaagatatatcatgcaaacattaatcaagggaaggcaagtgtggttatattaatgtcagataaggtagactttggagcaaacaaaattaccagagacagataatgacattacataatgagaaatatgtttcaccaaaatgacaacatagcaatcctaaatgggcatacaacaaataacagaactgcaagatacgtgaagcaaaaactaacagaactgaaaagacaaacatatccatacttgtgcttagagattttagcaaccctatctcaaaaattgacacaattactaaacagaaaatcagaaagaatacagaaaaactcaataataccacctaccaatttgatctagttgacatttatagaatgaaatacccaaaaacagcagaatacatattcttttcatagggccactttacacataacaagacagaccacatcttgggccatgaaacaaacctcaacaaatttcaaagagttgaaatcatacacagtgttttcttacaaccatggaatcaaactaggaatcaacaaaaagataacagtaaaactcccaatacttagaaactaacacttctaaaatctgcatgggtcaaagaatgaaaatacaaaatataaaaatatgtggaacacagctaaagtaatgccaagagggaagtttgttaacattaagtgtgcacactagaaaagaggaaaagtctcagatcaataacctatgctttcatgtggaaaacatagaaaaagcaaaacaaacccaaaacaagcagaaggaatgaaatcataaaaacaacaaaaaccaaggaaattgaaaacagaacaatttttaaacatcaatgaaacagggttggttcttaaaagagagagaacaaacgaactaccagtatagattaccaaacagagattatcactacagaccctgccgacatcaaaagaataaggaaatactacaaaaaattcgatatatgtaaatttgacaacttagaagaaatggtccaatactgctaaaagcaaaaactaccaaaatttactctatataaaataggtcatttgaatagctctttacctattaagaaaattgaattcataattttaaaaattccaaaagataaatctcctggcccagacggtttcattggagaaatctattaaacatttaaagaattaacagtaattctacaaaatctcttttagaaaataaaagagaaaaaatacttcagagttcattttatgaagctaatattagtgatacccaaaccagacaaagacgggagtacaaaaaaaacaaaactgcagacaaatattctttatgaatatagatgcaaaatttcctcacaaaacattagcaagtataattcagcaaaatataaaaagattatacactatggcaaagtggtatttatgccattgaggcaaggctggttcaaaatttgaaagtcaaccagtataacctatcattatttttttttctaataataaaaatcaggtgatcatctcaagaaatgcagaaaaatacttgataaagaatttgataaagaatatccataaaaaaacttgataaagaatattcataaaaaacctagttaacctcattcttaatgatgaaatattgaatacactccccataacatgaaaaataaagttaagatatctactcttattcaaaatagtgctggaagttctagccagtgcaataaggcaagaaatttaaaaaaaaaaaaaaaaaaaaaaaaagcttactaatcagaaaaaaaaaaacaaaaaaaaaacgcaacttttgatacttatagataacatgattgtctacatagaaaatcccaaggaatctacaaaaacacttttataactaataggtaacattcagcaaggtcaaaaaatacaaaatgaacatacagaaatcaattatatttctatatactagcaataaacatatgaacattgaacttaaaaatatagtatgacaatctaataataacaagcaatggagaaaaaactccctattcaataagtggtgctgggataactggctagccatatgcagaagattgaaactgaactccttcctttcaccatattaaaaaatcaactgaaaatggattaaggacttaaaagtaagatccaaaagtataaaaaccctagaagaaaaactaaagagctactgcagagtatcagcagtgtaaacaacctacagaatgagagtaaatatttgtaagctatgcatctgacaaaagtcttaatggctagaatctataagaaaaaaaaacaggcaaaaaacaaacccatttaaaaatgggcaacggatataaacagacacttctgaaaagaagatatatgcatggccaacaagcatatgaaaaaatgctcaatatcagtaatcattagagaaatgcaaataaaagccacaatgagataccatcttacaccagtcagaatggccataattaaagtcaaaaaatagcagatgttggtgaagttacagaaaaggtcatgcttaaacactcttggtggtactgtaaattaattcagtcattatggaaagcagtttcaagatttttcagtgaacttaaaacacaactaccatttgacctaacaatcttattactggatatatacccaaaggaatataaatcattctaccaaaaagacacacaaactcgtatgttcatcgcagcactagtcacaatagcaaagatatggaaacaacctagatgcccatcaagggtggactggataaagaaaatgtggtaaatatataccatggaatactgaggcagacataaaaaaatcatgtcccttgaagcaacatggatgcaaatggaggtcattatcctaagcaaattaacactggaacagaaaaccaaatactgcatgttctcacttatagatgggagctaagtactcagtacacatggacacaaagatgagaacaacagacaacagaagctactttagcgggcagagagggaggtggataaaggtcaaaaaactacctattgggtactatgctcactacttgagtggctaaatcatttgcacatcaaaccccagtgacatacaatttacccatgtaatgaacctgcgcatgtacctcatgaatctaaaataaaagttgaaaaaaaaagtacaaaacacaaacaacaattgtatgctgaagactacataatgttgatgaaagaaatcaaagatctaaataaacagagaaatatgttcacagattggaagactcaacataacaaagatgtcaattcttcccaagtttatatacgagtttattaaaattcctttcaaaatttcagcatcatttcttgtggatataaaattattctaaaatttatattgaaaggcaaagaacttgggtagctgaaacaattttcaaagagaccaagtgggagaaatcactctatttgatttcaagacgtaaatacagctacaggtattagtgaagaaacaggacactgatcagtgaaacagaatagagaacacagaaatagacctatacaaatattcccaaacaatatttgaaaaaaatgtaaaaccagtttattggaggaaggacagtcttttcaagaaatggtaaaggagcaactggacatccaaaggcaaaaaaacgaaccttgacctaaacctcacatcttacagcaaaattaactaagaactggattacaactttatataaaatgtaaaactataaaaattttagaaaaaaataggagaaaatatttggaaatctacagctaggcaaagagttcttaaacttaacactgaaatgctcagtccataaaaggaaaaattgatgaattggacttcatcaaaaataaaaactttgctctgtaaaagcccatataaagaagataaaaagactagctacagcgcagcagaaagtatccgcaaaccacatacctgacaaaagactagtacctagaatatatatagaactcccaaaactacagtaaaaaaggacaaacaatccaattagaaaataggcaaaagtcacaaatagacatctcactaaagaggatagaagaatggcaaataagcctatgaaaaaatgttcaacaccgttaaccactacagaaataattaaaaccacagttagtactacacacctatcagaatggctaaaacaaaaaatagtgaaaacaccaaatgctttcaggatacgaagaaactggatcacttaaacattgctagtgggaatcgaaaattgtataaccactctggagaacagtctggaagtttccttaaaaaactaaacatgcaactgccataggacctacaattgtattcctgggcatttacccctaagaaataaaaagtatcttctcagcaaaatctgtacacaaatgcttacagcagctttactgataataggcaaaaactgaaaataatctagatgtcctccaatgggtgaataaacaaactacagaaccaccacacgttggactactacccaacaataaaaaggaacaaattactggtacatacagctactgggatgaggctccagagaattgtgttaagtgaaaaatgtcagtcccacaaggtcatatcccaaaaggaatgtgatttcatttttaaaacttttttgaaatgatgaaataacagaaatggaaaacagattaaggtttgccaacagttaaggaagagactgatgggagaggaaagtaagtgagtgtggctataaaagggcaaccagaggaatcgctgtggtgatggacgtgctcctcagcctaactgaatgtcagcattctggctgtgctacgatactgtggtttcataagatgtcaccactgggccaaactggtaaagagtgtacatacaggatctctctgtgttatctcttacaacagtagtgaatctacaattacctcaaaataaaaagtaattaaataaaagcaactgagctttgactgttataaaattgtttataaagtcataattttaagagcctaaaattctctgaaagttacagtaaattgtgagatttattatttttcttactaatctatgttttgaaaatgctacgtaagaaccttgtacaattgagcttgcatgacttagtagatataaatgtctgaaattctttgaagaaagagaataggagtctgcacttacatcttggtctcatattttatatatttatttacaacttaaactcaaactatttcccaaaaagagctcatcatatcttgtcaccatgtaaatccaagttcttcattaaaaatgtgcgtgctgtgcctcatgctacttcacatggcagcacaattttctgatggagtctccttatggtgagtgcctgtgatgaaaacacacagctgactgctttaagaagtaatgtaccttttccagtatcagggacagcctggagctgacattagatatagtctaaatatttaataacttccatttaaacttgaattcgaaattcataaaatacaaaacaatgaccgttttgagctattttctcacatctaaaagtaacattcttaaaaaagaatgacttgacctcagaaatgcaaaagcacttttcattaccacaaaagaatatcagagatcaactttgctcagtatcttggggaaaaaagatcttattcaagaaagaagacacagatcttaggaaacaaatactactgcaatgtgaagatagctagtttcagtctagtgctaaattgaaaacaatgaatacagaccactacgttggaaagtattaaaagaaaaagatgactgcaccgagaagaaattaatattaaactaacacattttcaagaataggctgaactattttttacttcagggtaagattcctaagttgtcatgctgtgtacataaataatcagccttccaagtacaggcataccttggagatattgtagtgtagtttccagaccactgcaataaagcaaatattgcaatagaatgagtcacatcaattttttggtttcttaatgcatataaaagttatttttatgagagaacaaggcaggaggatcacttaagcccaggagtttgagagcagcctggctacatagtgagactctatctctagaaagacataaaaatattagcctggtgtggtggtacgtgcctgtagtctcagctgctcaaaaggctgaggtggaagaatcacttgaccccaggagattgaggctgtagtgagctaggactgcaccactgctctccagcctggttgacagagcgagaccctgtctctccaaaaaaaaaaaataaaaaataaattaaaaaaaaaaaaggtatgtttatataatattgtagtctaagtgtacaaaagcactatgttttaaaaaaaagtataaaccttaatttaaaaatactttattttgctaaaacatacaaggatcatctgaccttcagaaaatcataatcttttttgctggtggagggtcttgcctcaatgttgacggctgctgactgatcaggatagtggttgctgaaggttgggctggctgtggcaatttcttaaaataagacgaacagtttgccgcattgacccctcctttcgaaaaagatttctcagtagcatgtaatgcgatgttatgatagcattttactcacagaagaatgtttttcaaaataggagttgatcatctcaaagccctcctctgctttatcaactacactgacgtactatgctaaatcctttgttgtcatttcaacaatattcattctctttaccaggagtagattccatctcaagaaatcatcttctttgctcatccgtaagaagcaactcctcacctgttcaagttttgtcataagattgtagcaactcagtcccatcaccaggctccacttctaattctggttctcttagtatttccactcatctgcagttacttcctccactgacttcttgaccctcaaagagtttgggagtgttggaatcaatttctcccaaacccaatgttaatgttgacattctgacctcctctcatgagtcttgaatgttcttaatgacatctaagtggtgaatccttcccagaaggttttcaattgactttgcccagatccatcagagaaatcactatcaattgaagctatactttatgaagtctatttcttaaatattaagacttgaaagttgaaattactccttgatccatgggctgcagaatggatgttgtgttagcatgaaaagaatattaatctcctcgcacatttccgtcagagctctcaggtgaccaggtgcattgttcggtaagcaatattttggaaggatttttttttttttttctgagcagtgcgtctcaacagtgggcttgaaatattcagcaaacaatgcaataaacggatttgctaccactcaggctttgttgttccatttctagagcacaggcagaatagacatagcataattcttaagggccctaagattttcagaattgtaattgaccactgattcaagttaaagtcaccagtaagagaattggcctgtcttttgaagctttgaagccaactaatgacttttctctagttatgaaaagtcctagatgcatcttcttccaatagaaggccatttcatctacactgaaaatctgctgtttagtgtagccaccttcatcagtgacttcagctagctcttctggatagctttccgcagcttctacaatagaaactactgcttcaccttgcacttttatgttacagagatgacttctttccttaaacctcatgaaccaacctctgctagccaactttttcttctgtagctcccttgactctctcagccttcacagaattaaaaagagttaggaccttgctgtgtaggcttatgcttaagggaatgttgtagttgatttaatcttctatgctgacaactaaaactttctccatattagtaataaggctgttttgctctcttattcatgtgtttggcttttgatgtgcctttctcactaggcttaatcatttctagactttgtttaatgtgagggacatgcaactcttcctttcacttgaacacatagatgtcattgtagggttattaattggtctcctttctatattgctttgtctcagaatagagaagcccaagaagagggagagagaagggggcatggctgattgttggaatagtcagaacacacacaacacttactaagttcaccatttttctatggtgatgcagttcacatcaccccaaaacaattacagtggtaatatcaaagaccactggtcacagatcagcataacaaatataataataataaaaacatttgaaatattgtgagaattaccaaaatgtcacacaaaggcataaagtgagcaccagttattggaaaaatgaggccaagtagacttactcgaagcagggttaccacaaaccttcaatgtataaaacattcaatatctgcaaagcacaatacaactaggtattcctgtactcaacagtggcatttcattaaattctatcttccatagaaagtaaagttttccttcaaagcctagaatgagtaaatacaccaaacagtcagacatttaagatttcttttataacaccatgctgaacaaatcttatgcctgagatgttaatatcctcattcatgcagtccacagaagtgtcacctttttccctcttttctatcacaatattaattggtagaccatatcctaaggaagagaacagaaacatttaaggtgggtgaggggaaatgtccaaacacaaaaatgtagaacacatttctctagtgcaaggggcttgaaatgataatgagaccagtcaacccagatgcatttaaataaagtcgatctccccacatatcttatttaaaccagggcatcaaatttttaacaataacaacttcccaatgtgtccccatactagcaagactactctatcagccatctcagaacagcccagcacaaaatgcacatacaaagctgccatgaaagttaaaaaataatcctaaggatctacaactgggtcaaagggctttaaagcattcagctctcttaagcttttgtctaactgcatgggtgctgtggaaggaaccttaagtatctgagattctatgattctaatacaaattacatttgaataaacctaagcagttctcaagattacctaattttaatattctcgtagaaagaatgacttaaaatctgacaaactgacttatgacagtttagctacaggaaaaaacagtctatttcattaatcaacaaaaagcattagctctccataaatcttaatcaaatcagtaatacaggccaagcctctgagtgggcttacaaaaacctggaatatcggaaaactaaagaactcgcttgactttcattataaaacagaagacaaacacatagacgaagctgtaagaaagaaagacctcattgtctaatgataagtccttgagtacatgaaagcagtaactgcagtaaacaggcaaagccactgaacttatccatacttgaagggtacagacaagcctctgggggcactagagaaggcaagatgactccatacactggaatgctaccagggtggactagaaatgactgaacagtgagtaattttgtttctgattctgtatgtgtctgcctgtactttgaatattttctacaataaccattgtttttttagcatcagaaaaattataaatagaaaaagaattgcatattgaagaaaaaacagatttttacacaaattacgtattcttatcaatttaaaacataaagccattacctaaagtgaacagattttctaaagaaagagaagcccaaccataagtactattaataccctgcacatagtaggtactcaatatatctcttaagtgttaggtatagattactatcagataagctttaatttactcataagctagtgctccatatattcacaccagagataccatttgattcctcaattctcagaaatgtcctctgttagtaaatttacagtcatttttacactcaactatcagaatttgataggttatttatgacactctggcaattacattgtaatttcctcaccaatctaagaactcttatctactatacaatttataatatgaatgttatttttactctgccaaaaaataaagtgtttttattgcagtgatttatcctgcacatgtgttacttatacatacacatctattataaatcaagtattggagaggagaaagaacaaaattaacaaacataaaacaaaaaagggagtgagatgatgtactagtgaacagcaggaaattaaactcccagccttgcttccattaagaagttttgacaagataaagatcaagaacacagcttaagcagttagtgaacagctgcacaagtcccaaaatgatatatgatttttttgcattacaagcttcattgctaacttgtagcagttttggtaaatagttgaataggtacaactaaatttgacacattacggaaatatacaagaccaagatgaacaattgtaaagtaatctgaacttaggaattactccaaatgaacaaaaagattataactggaaaagttatttttaatagatattgaagatatctattaaagcagataatagttatctattaactattatatatttaatattaatctttcaacattaacgttttcaaaagtatactgtgtcaagacacaaagtgtagcatttgtgacactcagcaaacttttagagaattaagataatttttgataccaatttcaagtaaaacgcccttcaccatatctctcacaaaaataagctaaatttaaaacaaaaaacaaacagccatgcactaagatatcacaatatctatgagataagagcaagtaacaaactaaaaaatactgaaattaaaaataatattgttgggaatcttttttttttaattctagaaatttgacatcctttccataaatcacctacgatctgtatagtttgcttcttcctcatggtcttttttctatacagccctgtaagtatcttcccaacatatacactgctacaaagaaccacaagtccacttactcaaaaactgggtcaactccttttaagcttccaatgcctttaatgtttcaaggcaattcaataattcatttgaagtgaaataggttgaaatcacattcttggagctttgacaagaacagtcatttattgtttacttaatcatgtcatgcatgagagtttggttgtgtcttccatacccaccttccaactcaatggagtcaacactgcactccattatgccacataccacaaaatggtcaggacaaacgataacagtgtcaccttcatagcaggcatttataacagataatggatcaccgaagaactagaaaacaacaacatatttgcaaatatacacccacatatggtgtggatctctgtccccaaccaagtctcatgtctcatgttcaattgtaatccccagtgttggatgtggagcctagtgggaggtgactgggtaatggggacagtttctaatggtttagtaccatccccctagtgctgtctcatgacagagttctcatgagatctggttgtttaaaagtatgtagcacctaccctcattctctttcttcctcctcctccagccatttaagccatgcctgcttccccttcaccttctgccatgattgtaagtttcctgaggcctcccctgccatgtgtccttataacctgcagaactgtgagccaattaaacctcttttctttatcaggtatttataggcagtgtgcaaagtgacaaatatacaaccccacaaagcaactcgagtattattccaagtgccttcatgtctcactctgaaaatggagccaacactgcacgctgaagcatctcctttggtagtggactgaacctaatgcatgcctggtaagtggctactgctgatgaaaggcagggttctcactacttcctatttaacagaaaaccacctctgggaagctctgtgtagaattcatgaaaacctatggtgaatcagaaggaaaaaagccacttgcagcaagacactcttcttttacctgaatttctatatcttcccccaaggcacctggcaaagcctgtccatgagtagggtccacagcagaccagtcatcatggtggaggagatctcatgggtggaacttctgacaactggatggacaccctttgcttagatgttagaattctgataaccaaacacataccatgaagaaaccaaacagacctaacagttctcagtaagatagcaaggaagaaaagatgctaactagctaagaattacaaaggcacacatacctcaacaaaggactctccatgagttttagcttttgcttcacctgttcaatctctgaatacaattttaacccttcaaccatggagatattttcctgctcagagctacaatttgccaaactgcttctcagattaaaaaatttgctgtaactctcctcacattgagacaacagattgtggtagtcacgtcctgaaggaactcagttttcaagaatgtcataatccctgagagtttaaaagcaaactgaaatccattgcctttcagacacattttttctcattaagaaagcccatggagtcctcaaagacccactaagaaaagtgctttataactcaggtacatgttaagtctctctgaatagtactctaagtggtaactgttgaaagtttcaaacaccacttcattgaagtcattaatttttcttcttttgaggaattgttttttcttagatccaaacatttgtgctttagaattacctaaagttcatattgtacaatttgtaatcattatttaataagaaattattttcttctcatatattagattcaaaatcttaataaggagtgggtggcaagggccaactggggagtaggggtatagagggaagtaaattgtttcacaatggttaagactgccatgtttttcagagatctgaatgtgattttaaaatgttttaaaagattaccatatttataggatcaaaaattagaaatgactcaaactgtctagtccttccttacatttaaagcactatataggcacaaaattatgttgaatattcccagagaaagaccaggggatttcaaaaaaataaacctttgagattttgaggggaaaaaaatgctgtcattattagagaatgattaacacaaaataaccttgtactggaccaccttactggcacttgaaatttattcatttacataaattctcaaatataatgacagaacaaaaagtatgtctcaatgtaataaaataatttataaatgtacagtcaatagatattaaattaatgggtttaacaataaaataaaatattgccattacctgtagttttaaaataattgctttatttttcagttaaatgtatatcaactagctgtgccttaggttagagcttctcaattctgatgaatattagaatcacctaggatctttcaaaaatacagatgctcaggccaacatccagagcaataaaaacgggcctctgaaagtggagaggtattttttaaagttccccaagcatgtaatgtgtagccaaggttgagaactattgtcttagattattatttttttaacttcgtcatgctcttaagaagatggggggaggggagaaagctgaacaaaatcctaattcatatcaaattatggtgaacactcaatatttaaaatgaacagaagattttattttcttgcttttccaagtaaatggattgggtaaagcttgaaaaagtaaggattttgtctactttggttatccacactcatttaaagatactctagaaatctactttgcaaataagaaattacgaaccaaaccactggtctattaagttgcgaagattaagactaaaattttaaaataagtttcttagcatttccaatatccatgcaagttagcttatttcttctcattagattgatactttacagtctagaaccagtgaaccaacatcatcttcagacccctaagttctgaagtagtgtgttttgaattagaaaggaaaaatatttgccacatggtgcaaaatcaagacagtgatttgatcttgcctgctgatagctctactcctatcttagcccaggaacctttttagagtctgcatacatgtgataacattccagtttctccatcaagtgccacagtttcttctccgtaactaaagacaattcctcccttatgctgtcccatctgccagtgatgtacaaggcatgtatggagatcattacttgtccacacatgcaaggctctcaaatcagaatacaattttttttgtccacatacagatcaaatttgccagatatgcattatatttacctaccattacattctacttcaatcaaaaccaatcactgctctttaagagcaagtgtatcaaacctagaaaatattcaagctttttgatgttctgggattgtactgaacacactatagaaaaataggaaatgcacaatagaaaaattagaaaggtagaaatcacagtcaacttatgaaagctgaaatcagacatacataattgtaaaccaggtagaaccattaaccagattttcattttttaaaaaattttgttattatttactatttaaaccaagagaaacttactaaatcaaatcaaactgcatgaaaatgtaaaggccttgtcttatataatgtcaaatcatctttcacataggaaaaacaaattaccttctacaattctttttagtgtgagttctaattttattgcagcattgcctgttaatttactgctcaggaatacaggagaaaattactggtcttacagcaccatctagtggaaagataagtgtcgcatgtaacaagatcagcatagaacaactacttaatttaggttgcatgattaattttggtatttttgaacggaaaagcttttccttgtcaaaatatgataaattagaagaatgcgtttaggtatttttgattcatctgttagtttaacctagtatgttttactataggaacttagagtaaagccatatactttaaaaaaaaagtattatttaagtttcaagcaaaaaagtctctataatgcaaataagttctttgtttttcaaacaattgtcattaaatagatgttcacaaacctcctgattttaggcttagtttataaacagttaaagcaggtttctctgcacttgttcgtttcatttaataacttgaaaaggggctgcactatttgtatattggtctatttctgtctataggcccttggagtaagagtatgtgcgtgtgtatgtgtgtgtgtatgtgtgtgtgtgcgtgcattgcgcatgtgtgtgtctcacaaaggtaaaattaagccatggtaactattttttcaatatgtacaaggtcagtaataaacacaatctcaattgaggtttaacacgtctgacaaaacaatcatatgcatcatccttttcttcatcccaactcttccaaatgttctggtagaaaaacctgaaaaataacttaatatcattcaaatttaatcactggctccaaatgttaggattctggagggatgagagctaaagaataaatcaaagcaattctcatatctcagagaatgctgcatatttgctatggttatcagttgagtcacacaagataaagaccttctttgaatcagctagaggggtttttctataacactcatttttttaaaactttctttttatcagaagtagtatttattgaccatctctaactgggcaggtagtagttccatttgttgagatagaaaacactgggagagaaacaggtttggggttcaaaatgaagagttgtgtctttgccatgttcaggctgagatgcctatctgacctcccagtaatgacgtcaaatgtacagagaaatatacaagcccagagatccagggaaaggtcagggctagagacataaatctgggaggtgtcagcatattaatagttttaaagcagtaaatgagatcatctagggacataatataaagcagcagttctcaaccctggttgcacattagggtcccccgggatactttaaaaaattgattccctatcccagaccaataaatcagatatctgcggagggaagggggttagcattcacatgttttttaaagctctctaagcactttaacaaatttttattacaaaaaattctaaacatacaacagataaaatagtatcatgaatatcatgtatccatcagccaacttcaagaattacccacttgggagaaatcttatttcatctctacctcaccaacctaccctctgctcctctcctctcatcatcctgaccctggcttattttgaagcaaatctcagatgtatcaaatcattcacaaatttttagtatgtagctctaaaataaatccttatgccaaaaaagttttaatttcttaatattaccaaatatccagtcagtactcaaattttcctaattttctcttttgctgttgttgttttacagttgacttgttcaaattaggatccaaacaaggccagctgtggcccttaatggatgcgtctcttaaatcacttttattctatacattaccccttgctctttttacccttgtaatttatttaatagtttcacacacactgaattttgttgattacttatccatggggtcatttaacatgtttttctgtttctttcctttctagtaaactgatagtaagatctagagcttgatgggcttcaggaaagactttttggcaggaatacttcaagtgaggtatgatgtacttgcatcgggaagcacatatagcaagtcctctaatatcagcctttcattgaatgcctttcactatataagggaataaacatcaattcctggccatagtcgcagtctgtgtggagttttcatgtttttcctatgtctgcatgggttttctacaggtactctggcttcccacatcataaagatgtgcatacgaaagatgagcatgctagctgaactggtgtgtcgacatcgtcccagtctgagtgtgggtgtgagtgcaccctgggatgaagtggcattgtgtctcatgctggttcctatcttgcaccctaagctgccatgataggttttggccacctgcatccctgaactggaataagcaggttggaaaatgaaagaatgaatatgaattattgtcaaataaaaaatcttaaattagacaataatcatacaaatgcacaacaataaacaatgcagtataaaatcactcagcgagtccatcaagttggtgacggtttgaaccacgtggtggtaaagggtactccttacaatttttactttgccgacatttattcctcaatttgaccaaccaccaccatgactgccgtgactcactgattcaccaaaaattgggtaaataattattttgtttttataatctttcttatatgtatacaggattcacatttatttcaatgttcaagattaaaattgtttttggtctttatttagaagtttggtgatgtttttgtgaccagaaataggccataggaactttaacttttgtttgtatctattagcctatggtaacattggttttgtaatttcgcttaaagttgaagtttccaagaacctgtcgacaacagtaagtgaagacttctataacgcctagccatctctttttgtgaggttaagactgatcaatggattcaggtgttgtcagcctgattcacccactatgaagttctctattagtttttcacctaaagattacagcagtcattgaggatcactgcctacaacctttatttcattagtggttacaaaatatggatattctatcattccttcttcatgtagtggttggatgtgtctataaggaaaatccccaagttattataatgtggttccaaggtagagtagatgagaaaaagaagagtaataggattgatcccttggtaactcgaacactctaaaaagttagagcatgagagaagagctaggcaagatgactagaaaaccaagccggtgagacaccaaatgaatagtgctgtcgtagaggctgagaggagagtgtgttaagatgggaatggaggaggcagagcaaggtagtggaaaagaaggctcctctgatcattctctgtgcaaggacaccaatttaacaactatccagttctttggtaagaactaaaaatcacgtgagcacctatagcacctggttttaacttcatatcactgaaaagaggcatggaagagatagaaaaaacagtcttgaatcgccgatgccacccctcacccaccatcctgtgtggtacagagagcatatctgggtgctgcaggagggagagcactgcaattgtaaggcattaaactgagctgtcctgccacagcagaaaggaaaactagaccaaactcagctgacactcacctatggaggcggcatttaaaccagccccagccagagcggaatcactcatcccagcagtccaaacttgagatcctgcaaaccttgccactgagggctaaagcactttgtgtctctaagtaaacttgacaggcacactaggccataaggactgcgactcttaggtgagtcctagggctgaactgggcccagaaacacagagacacagtggacttggtgggggcacacaacctactgagacatcagctggggtgtctaccggagtgctggcatcacccctcccctaaacccagactgcacagctcacagctctaaaggagaccccatccctccacttgagaagaggagggggaagagtggggaggtcttcatcttccatcttggataccagctcagccacagcaggataggtcaccagccagagttgtgaggcttccccatgccgcattccaggccctaactcccaacccccaatgacatttctagacacatcctgggttacaaggaacccactgctttgaaggaaaggacccagtcctgccagcattcatcgcctgccaactgaagaccccttggaccctgaataaccagcagctatacccaggtactacgtcaagggccttgatgagccactgagacttgctggcttcaggggagactcagcacattcccagctgtggtgggccacaggccaagtctccttcagcttgagaaaagcagagggaaaagtaaaggggacttcgtctctcaccttaggtactagcacagccacagcagggtagagtacccagcgggctattagtgtccctaattctgggacttgattcttgaatggcatttctggacctgtcctgggtcagagggagggaagcccactgccctgaagggtgagtcccaggccaggcagcattcaccaccaactgagtcgagagacctggggccttacaggaacatcagcaatagtctggcagtagtccttgtggcctgggatggtggtagctacagggtgaggctcctctgcttttggaaagcggacagaagagtgggaaggactgcatcttgtggtttgagtgtcagctcagccacagtacaacagaacaccaggtagacgtctaaggctttgactctagtccctgacttcaagatgacacctctggatccacctggagcctgggggacctcatcaccctgaagggaaggacacaggcctggctggctttgtcacttgctgactgttaagccccaggttcttgagcaaacataggcagtagccaggatgtggttacagtaggccttgggtgagactcagtgctgtgctggcttcaggtctgacccagtgcggtcacagtggtggtggccacaggggtggttgtgtcactccaccctcaactttaggtgactcagaagagaaactctgcttgggagaaagtaagggaagagaacaggagtctctgcctggtaatccagagaattctcccggatcttgctcaagaccatgaaggcagtaccttcgagtcttcaaacattcaaaaaaactgagataatatcaagcatcttctctgaccgcaatagaataaaactagaaatcaataacaagaggaattttggaaactatgcaaatacatggaaatcaaacaatatgcgcctaaatgaccagagagttaatgaagaaattaagaagaaaattgaacaatttcttgaaacaaatcataatggaaatacaatatagcaaaacctatgggatacagtaaaagcagtactcaaaggaaagtttatagctataagtgcctacatcaaaaagaggaagaactccacataaataatctaacaatgcatcttaaagaactagaaaagcaagagcaaaccaaacccaaaattagaagaaaataaataataaagatcagtgcagacataaataaaactgaaatgaaaatacaaaacatcaatgaaacaaaaggttgttttttaaaaagttacacaaaattgacattgccaaactaaaaaaaagaaaaaaaaagatacgaataaataaaatcaaaaatgaaaaacgagacattacaactgatattgcagaaattcaaagaatttgattcctagtatcattgttggatagtataggcaactatataccaataaatcagaaaatacagaagaaatggacaaatttctagatatatacaaccaatcaagatttaatcaggaagaaatctaaaacctgaatggaccaataacaagtaacaatatcaaagctataataaaaaatctccaagtaaagaaaagctcgggactgatggcgtcactgctgagttttaccaatcctcctcaaactattccaaaaaatagcagaggagggaatacttccaaactcattctacaagaccagtattaccctgatatcaaaatcagacaaagacgcatcaaaaaaaagaaaagaaaagaaaaaaaagaaagaaaactacaggccaatatctctgatgaatacttattgaaaaattctcaacattaccaaaccaaattcgctaatatattagatcattcatcataacaaaatgtaatgtatccccatgatgcaaggatggttcaacatacacaaatcaatgtgacatatcatatcaacagaatgaaggataaaaaccatatgatcatttcaattgatgctgaaaaggcatttcataaaattcaacatcccttcatgataaaaactctcaaaaagctgggtatagaaggaacatacctcaacataataaaagccatatacagcagacccatagctcttatcatactgaatgtggagaactgaaagtctttcctctaagattcggaacacaaggatgcccactttcaccagtgttattcaccacagtactataagtcctagctacagcaatcagacaagagaaggatataaagggcatccaagttggaatggaagatgtcaaattaccttgtttgcaagtgatatgatcttatatttgaaaaaaacctaaagactccacccaaaaactactagaagtgataaattcagtcaagtcgcagaatacaaaatcaatatataaaaatcagtagcatttttatatgccaacagtgaacaatctgaaaaaaatttaagtaaccccatttaaaatagttacacataaaattaaatacctaggaactacccaaagaagtgaaagattataatgaaaactataaaacagtgatgaaagaaagagaacaccaaaaaaaggaaaaatattccatgttcatggaatggaagaagcaattttgttaaaatgtccatactatccaaagcaatctacagattcagtattatcataaggaaaaagaacaaaactggaagaatcacattatctgactttaattttttttatttatttatttttttgagacggagtcttgctctgttgcccaggctggagtgcagtggcccgatctcggctcactgcaagctccgcctcccgggttcgcaccatactcctgcctcagcctcccgagtagctgggactacaggcacccgccaccgcgcccggctaattttttgtatttttagtagagatggggtttcaccgtgttagtcaggatggtctcgatctcctgacctcgtgattatattacagagctatagtaaccaaacttcagggactggcataaaaacagacacataaaccaatgataaaaaatagagaaccaaaaaacaaatccccacacataagcgaactcattttccacaaaggtgccaagaacatacactgggaaaaagacagcttcttcaataactggtgctgggaaaactggttatctatatgcagaagaaggaaactagactcctatctctcactatacacacaaatcaaatccaaatgaagacttaaatctaaaaccttaaattatatataaaaaaaaaacccttaaactacaaaactactacaagaaaacattagggttttccctagaacattggtctgggcaaaaacttcttgtgttataccctacaagcacaggcaaccaaggcagaaatggacagatgggatcacatcaagttaaaaagcttctgcatagcaaaggacacaatcaacaaagtgaagagacaacccatggaatgggagaaaatatttgcaaactacccatctgacaagaaattaataaccagaatatacacggggctgcaaacaactctataggaaaaaatctaataataaaaaaatgggcaaaagatttgaatagccatttctcaaaagaagacatacaaatggcaaacaggcatatgaaaaggtgctcaacgtcattgttcaccagagcaatgcaaatcaaaactacaatgagatatcatctcaccccagttaaaatgtcttatatccaaaacacaggcgataacaaatgctggcgaagatgttaagaaaagggaaccaggccaggcacagtgcctcatgcctgtaatcccagcactttgggaggccaaggcgggtggatccctggaggttggaagttcgagaccagcctgaccaacatggagaaaccccgtctctactaaaaatacaaaattagctgggcatggtggcacatgcctgtaatcccagctactcgggaggctgaggcaggagaatcgcttgaacctggaaggcggaggttgtggtgagcagagatcgcgccattgcactacagcctgggcaacaggaaggaaattccatctcaaaaaaaaaagaaaaaagaaaaagaaaagggaaccatcctacactgttggtgagaatgtaaattagtaaaataattatggagaacagtttggaagttcctcaaaaaactaaaaatggagctaccatatcatccagcaataccactcctgggtatatatccaaaataaggaaaataagtatactgaaaagatacctgcactcctacgtttatttgcagcactgtttacaatagctgggatctggcagcaatctaagtgtccatcaacagacgaacggataaagaaaatgtaggacttctacacaatggaatactattcagccataaaaaagaatgaatcatttgcaacaacatggatgaaactggagatcattatgttaagtgaaataagccaggcacagaaacacaaacattgcatgttttcacttatttgtaggatctaataatcaaaacaattgagcttatggagagagaggatagaaggatggttactacaggctaaaagggtagttgggggatgaggggaaggtagggatggttaattagaaagaatgaatagaacctattagttgacagtataacagagtgactatagtcaataataacataattgtacattttaaaagaacgaaaagagtctaattggattgtttataacacaaaggataagcatttgaaggaaggatacaccattctccatgatgtgattatttcacattgcatgcctgtatcaaaacatctcatgtaacccataaatatataaacctactatgtacccacaaaaattaaaaataaaaaaataaaaaaatagaaatgatcaaacacctagaatacagtcaagaggtcaagcaggatgagatcagagaagtgtcaactggatttgagaacatggaagtccttgataatcttgagcacaattttcatggtgaagtcagagtagaagtgttactgggatgccaagaagtacagactgtctgtctgtgactatatataactctttcaaaaagttctgtgtgaaaagaaaggagcactaaaaatgaagccagccatcttttaattcttatggattgggctgtcagtctcttcaccctctagagtctattttttttttttttaatgaatctaagcatgcctttactcaattcaaaaaaaacctctgccagctctttgcggccctcaaaatgaagtcctaaacgtgataatataacatggattcataatttaactccaattacctcccttgcctgagagcccttgtgggtaaactgtcaatttcacaagctctttctaacctccatgtaacatgttggtcagcctgctggaagtgtcttccttctccacctggtaagcctgtatttacaacccatgactcagctcagacatcctcctcaccagtaccatgccaggcacttacacatcattcacatctacacctccccagtctttattcctttaagccagaaacatgagtatcagccttgacttccacatccactcatgtctcatcccccataactgttcgacaaccaaggcccagctattctactttctcaataagcctccatccccactctagacccctccatatccccactctagacccctccatatcgccactctagacccctccatatcccccactctagacccctccatatccccactctagacccctccatatccccactctatacccctacatatccccactctagatccctccatatcccccactctagtgctctccgtatcctgaatctagacccctccatatccccactctagacccctccatatccccactctatacccctacatatccccactctagatccctccatatcccccactctagtgctctccgtatcctgactctagacccctccatatccgccactctagatctctccatatccccactctagacccctccatatccccacctccctattccatctccctccacttgttttccacacagcagccagaacgaaccttttaaaacacaaagcaagtcatattgaccccagaataaaaatccctccatggcttttcatgctcttacaaaatgattcactgggagacaaagccctgcaccgtctgagccctgccaacctctctaccctggctgagagtccacaggactctcccagcactgtgttctggccacattgaccttgcagctcctcaaagccactgagttcctgaaccggttcccccatctctgccacccctttcacctgccattcctttcaccttttacacccaaatttgaatgtcatttcctcaggaaataagcacagaacagcaacctgacccagtcttaggacactctgcaattcttcacggtgctcacggccgcttccaattgcatctgcatccttatgtgactattctataaagcttcacctcccacctttagactggcagctccccgacaagggtgttggttttgtgcaccagtcataccccaccctcagctgagaacccagcactccacacttattgaatcaatgggcaaatgaaaaccctcataatttgaccttctctaggcaccgaccagaatctgagtcctcaacatggagagtaaatgtaaccaggctcctcttccttaacaggaactcttaccagttccaggtacttgtctttctaccaacttctatacccatagagattggcatcctctctaatttcctaaactcatcagttatcccttcaccttcaaatgcttcaactgacagactattttaaagcaagagaaacataacagagtcattttggtcctggacagaaaccagttctttagatttatattgcttggcttaatactgaatacccagggttaaatgttcttgcatgcaattagagattgtccataagatgtcggaagcggcatctgaggcactctgcttctttatcgagtatttaaactaagcttggcaaaaccaggttaactgacaaatggtatagaaacaggaaagtactttcaaaactacaaaacaccaagcaacattattaacattatgatcgttgcattagccagtcttccacttactagaggaatataagtccatttttacatggctaaaagtagacttctttagtgaatgtacttacatatagaaaatccaaaagaactatctgtatcagacactatctgatagaagatttatctgaaaaaaattttaaatcatacctattaatatgaatccaggtgtgggctttctttctcatgtaagggacaaagggtctgtttgtacaggtggaaataactgccaaataggctgaatggcaggaacacaaaccctagggatccaggaagcagcctcagaaaacaccttctctgaccagatacctccttgaagaaaatgtgtattagtttaatcagtgcatacatcatcatcatggtacacaaacttctttgctttccttcctttcctctttctgtccttttagactcaaatataccaaccataagccttagcatccataacttttaagtcagtttctaaatatacacaaaccaaattaagaatcccctaccttttgttaacatttggggataccaggtaaaagacaaacaggaatgctttgtactgtactatttttgttaacttttctgtgagtttgaaattatcccaaatgatttaaaacttttttttaatttaaaaagattatcctatcattgaatattttaaaatattgccatgaccaagtttacagtttgaattttaaagctgggtctaacacagaccagaattacttcaattcatccaaaatttctggccacaaagttatttttatcaacttaccttcctagctgacatgctcagttacaagttacaagtgctgtctccagaatcatcaaacaccacccagctccttcaggggcaactgatgttccttcagctcgaggagctctttcacacactccaaggtgaaagtactcgctcaagattcacagaggtatggctcagcaagctgcaccactgccttcaaggctgaaatgtccacatctgtggcctaaaatgtaaaataatgtgacttaacacgtggaaatcaaaattaagctccacgtataaaacactactgacagcctgatttttttaaagcatgcaataggggcagggatgcttcttccattatggaagcctatccttccataaaggataaacatgagaggcctggcttttagctcatggaacttacattgtaatcaagggggtaaataaacaagatagtgatgagtaggtgacagagagtaactagcaggggtggtgatctggttttgctgggatggccaggcgaagtcacctctgcgctgagaatgaaaaggaagcagccatccaaagagcagggaagacgcaaaaggcctgtggtcgagaggggcttggccactgaaagagcagaaaggcagtccttcttgctagagccaaagggaggaaactgggagcaggggagaaacagtaagtgatgaggtaggagagaaaggcaaaaagaccaggacatatagagcatctggcgcttggattttacatgttctccagcaccatgagaagccataaagccaacacgggaccctcggtaaatgcaatgcattagtagttttaagcagagaaattgtacacttctcttttaaaacaatgactttgactgcttttagagaagtgatgggggcaggaggggtgggcactatcataacccaatgaaaaggccagaacttcaactgaagatatcagcataatccaaaacttaaaaactcacaaggaacagctgcaacccactgcctcgttcataatcactgcagtatgcaatgccattttctaaaggagctgcagcaacaacttgtatacacaccccctggtttaacattttagcttaacaggactttttgtggttcagttaacaaacactgagaaaaattcacagctgtaattggagtgcaaatttaatgtaaaaggcccagtcagttgaaaaataagattgtttttactttctgcaatgagacacattatcaaaagattaaccacatatctacaaatttactaggcaaaaatgggatagttttaaaatgcctctttggtttgagttacttaatgggctacaactaagaaggtaaaaaattaatggaaactgttgacttcataattaggcctcctcattttttaaatgatctcaaatacttcctccacttcataggtttataatccagttccccttgtcaaaggacgctgaaacttaagccactttaattccctggtagctcctcctcagctgcctttaaaatttgcggaacacttcctacaccatagcaattagatgtgaaaaacatgctatttcaatcagctcataaactttaattaaaaataagcactttggctctaagagtctgaagtaaagtgcttatagcttgagacaaatgtcttaacaacaaaattaactttacctcaagcagcaccttgagcacatcatgtgccagactgtccgccatccagatggctcaaggaccttctccaagaactcagctgtgaattcccgtgcctcagaggccttgcagtcaactacaaacaaattaaacacaggaagaagtgagaatgcataaagcagagggaagttaataaatccacttaaatccattttctcagaaccaacaactggcaatctgagggactgagataggcagtctgcttataaactaaaaagataaaaggagcaaaaaaggacaggcacggtggctcacgtgtgtaatcccagcactttgggaggccgaggtgggcagatcactagagctcaggagttcaagaccagcctgggcaacacggcaaaaccctctctttagaaaaaatacaaaaattagccaggtgtagtggtgcatgcctgtagtcccagctgctcaagaggctgaggtgggaggatggcttgagccaagaagcagaggtcgcagtgagccaagatcgtgccactgccctccagcctcggtgacaaagcaagactctatcaccaaaaaaaaaaaaaaaaaaaaaaaaaagcagaaaagaaacaaaaaagagaacctactcacctaaaatgtagtcttgataggccctggattactcacagagtaaaagttgatttgtttgcaaaatttctaggtgaagtggcttttttccttctggaataaaactttgtaaactacaacctggctcatcaagacagttacaatcactgcgtgaatcttcattttgaaagaaacctaaaaaaacaaaaacgataagcaggcacaagtatcccagatacttccagtgctcgtagagtgcttctgtcttcacatccttgcttgaaattccaaaccaacaaggatttgagtatgaatgctctatttatctctattattgtcagaagaaacagctttacgaacttaaaaaatatctgaaaatccaagttctacttaaaaacagtaagagcttaagatctttcacaagttaggtttttgttgttatgtggggatttggaggaaagcagagaaataaggttgttttttaatccagtggaaaccacctaagttcttctccctagaagtaactatctttactatagttagtaagttataacagtcaagtatctgttatttttttttctcccaaacacttccacaaagcagcattaaaagagagagctgatttcctatactccctctccaacgggctgaagcctctctttattttctacaatatcagtctgccaatggctcctcaataaacagggatgagagattcttaataatgcataaggtttacttcactaagactactaggttcctcctcattaatttcaatgactgtgtctaaggaaaagatcagaaaatgcaaatcacattaggtttgggctgtatgtaattatgtttcataaggcatgattcagccagtggcgtatctaattctgtgtaataagatgtttttaaaaaacgaaatgacggctgggaacggtggctcacgcctgtaatcccagcactttgggaggccgaggcgggcggatcatgaggtcaggagatcgagaccatcctggctaacacggtgaaaccccgcctctactaaaaatacaaaaaattagctgggcgtggtggcgggcgcctgtagtcccagctacttgagaggctgaggcaggagaatggcgtgaacctgggagacggagcttgcaatgagccaagatcatgccactgcactccagcctgggcgacagagcgagactctgtctcaaaaaaaaaaaaacaaaaaccgaaatgaccactaaataagcaatgctgagggtagcacttagactggcagagtagtttccgaaggtggtttcaaggaaggtgtctgagacggtaattagcagcagtctttcttcctccaccacctttgattttctcctttccctttctccttccttccattcctttgtcccagctcaggcccccagaattacttgatcccacacatgagacgatcaaagcaggcaagggtctactactgttcacaaacactgacacgcatgagccttagagggcatcaacaccttactggctgtgtgacaatctctctgtgcctcagttttcttgcctataaagagaagataaaaatagtatgcttacttcaattaaattaagagaattaaagaaattacttgttaaccatttactacagtgccaattacacagtatatatgtatatttgttaaatataccttacttcggcaccactctttacagctattttgtttttccagctttactgaagtaaataaaaatattgtataatctaaggggtacaatgtgatgttttgatatacattatgaaatgattgccaccataaagcaaattaacatttccatcacctcgcatttgtgcgctgagaacacgtctcactctcggcaaatttcaagtacacagtagtgtcattaactacagttaccaagctgcacactagatccccagaacttactcaactttgtactctttgacccacatcttccccatttctcccacttgcagcccctagcaaccactacgctgctctttttctctcagttctgctttattttccacataggtgatattatttagaatttttctttatttacagccactttaaaaatattccccttcgcacagtgtttcactgcgtcttcaccacaaggacagccactggctccgtctttagatgggaaaactgcggcccggcgacttttgctagttggaaaggtgggtcagtggtggaattaagtcacacttaggccttttcacttcgcagcggctctttccactacacgatacaactgaacgtgttaaagtaaaaacgtgacccagtttaaaatgtcgggggcgggggaacggaagcggggggaaggaatctacctgaggagtgaggaggcagaaaggaccgagaacaaggggacccggttccatttctggaccccgtccgcaggctgctcgcccgacttggggtcgctctgccccggacgatcaggacagctgcgtgggcccagggttccagctgcctttatcttcgggagagcgaatggctcagatctccgcggagatggagctggaaaagcggagccctcgctccacggctcgcggcagttccttgaagcccacccaggtggggagcccctggcgcagcccaactctctgcagtctcggggaagctgaggcagagagggaagccccgccccgggtccttcccgaccccgacgtcctggcccgccgagtcccaaggccccggcccgggcgccccccgaggggccggacgcccaggcctcactagggagcggctcctggcccggcccggcgggcgctcacctttctcccgggcactggagcctccctggccgcccaggtgcacgcgaccccgagactccgtctcccggccacccagtcaggcacttcaaattcccgcggac

SEQ ID NO: 408 - DNA, 4700 bp, Homo sapiens
ttaaattatattatatgaaatacaaaatgtggaaaatttggaaattacagaaaaaccaaagatgaaaattacagtgactttgttccaccatacaaagataaccactcaacattttttagtatgccttccgtcttttttatctgctctacgtatacaagcatacacccatattttaaaaaacaaaattgaaatcacataacatgcactatttttacaaccttttaatattcaaggagcatttttctttcagtcagatgttcttttacatgacttttaatgtctgcgcggtactccaccatctggatggagatacaataatttacttaagcaatcccctattgcaaactttcgttacagcagaaaaggaataaattcccaaccaaaccattgcttcccatttttctccattgcaatgctgggatgaacatcttatcactaactaaatccttaagtattttcttaggataaattcccaaagatagaattcgtaggtcaaatgacatggaggcttttaggccacatgacacatatcacccaactgtcatccaggaagcctgcaccgatgtatactcccacacgcaatgtatgggaatgttttttcagtagtctctttgccaatattgggtcttatttttttctgttatggtttgctaagggaaaaatgcttccagctctatttgcctttctttaattactaatgaagcatactttttttcatggttttatccattcagatttcttttatgaatttcctgtgtgtgtcctttcgcagatggttcttggtccttgaggctgcttatataaacattacaggctgggcggaggtggaagtagggcggtgaagccacagggcaccgcactatggtgccacatctcggaggcagaaagcctggagagaaatggtgatcaaagtaggagagggctggaggctcgccgtcaatggaggctggctgccctccctcctcttggggtgctcctggcctttaggggctcctctgctggatgcccaggtaggaccctgtgctctccaggcctggtccttcactggtctccatattcccaggctgcctctcctcacctctgctccatgatgggtgaagatggcagaggcacatagcgagggctggagggagatgctgtggccagtgaagcaaggagaaagtacggaggcagtgtccagggacagagtcacctttgttgcagcctatgagtctatcccctgcttctctaccactgtcccacacgcatcctgcccctcagcttggctgcagaagagcagggttccacggtctactcttctccacatccttgagtttttcacaagcggaggacaagatacagctccctgcacatctcctcccaccaaatcgaacagacacagcttcctgtagccgctaggtgagaatggatcagggctggaggtggcaggtttacactcactgcctgatatctggaaggaggtcacatcccacaacccacctcccctacttgctgcaggggagaatttcctgtctgcacaggcctgagctggggatcacataccaccttggaaagcaaagtgaggaaagaaacagagtagcagcagttagaatcccaccaaggggctgctgtcctgctttggatatcaggggaagccttgggccacccttgcatggggggaagtcacggagaggcgagctcttactagctcctcgcattggtctaactctaaccccctcctccagcttcccattccccacccagcttctgggtgatggtatcagggatgggggagggacaacagcttctgtgaaaaggtgttttgtttccacccacagcagggggagagcccgggttctgagtcaacccagatgggcttctgattccctcatgcacactcatctgtgtgactgcccatctcacaggtggagaaactgagacaggaggtctaagggtctcagatacaggtaagtgcccaggaatctagagtctgggccagcctaaggaaatgcagggaaaagtaagagcagaaggatgactcctcacgcctgggtttagtatcacttttccctgaagagtgagcttacttttggacctcatctggaaaggccagtggggaagaatgaaagatacggaaggagggtcaagaaggaagtcggggagacagagtgttctctccacttcttcccactgtcacacaaagaccaactaaccttgggttgtttgagccttctactcctcaatccagccagtgtctctaatctaaaaccgctccttgctgggccaatctgggcaaaggctctccaacttgcccaaaacgtatcatccaccctgctgttcggaccttcccagcccatttctgtcaccttccagatgatggggaaagcagctcctcctcctcctcgaagccaggggcagagggcaacagttcttcaactggcagctttagctgggtcaggacataaagcttgccactgaagaactactgcggctcagccaggtgagggcgtgagaggaacaggctcctaagggaaagggagggaaaatgggaaagatctgagcagggcatgttgctgcaacgctgacccactcgctggccatcagggtcctgccccagtagacctctgagattctaatgcagggctgcagctctgatctgggcccgcggaagctgttaacctcgctgagcagcaagaggtggctgtaaacagacttcccttgctcttctttccagaactggagtctagagaaacccagtcctgctctcaccctcccctgccctagcggcccctgggggcccagcctcctcagcattcagacagggtggggcccgggaccctggacacaccccaccagcacgcaggtactagaagtgtggtacctcaggtccagaaatgtgagttcagtgatcagcccaactgacttgttcccagggagttcagctggaaggagagttctgggggcctggattggggaagagtgaggaagggaggaggcctagcgtttgaaagaaggtcagcagaggcccccggggctgtgaggggcggacaggggaccacaggctggagaggagggaggtatcggcagggtggccggggctgtgaggggcgggcaggggaccacaggctggaggggagggaggtatgggcagggtggctgggcagcttccccaggactctcagatgccaggcattccgcttgcgcattccgggtacatctggtatgaattccaggctgtctgccggcccctccatgtctgaactttgttccaagttccaagccccgcccccacagttccaacgcatgaatcagcaggaaaagccgggccctgcagcatggcccagggagggggctgggggcgtggcaggctcgggggatgtgagctggggagggcgggtccgtgctgacactcagtccaagggcatggcccacgccaggctgaggggccaaggcggtcttgccttggaatttctatactcagagggtaagaaagattgggggatacggggtgcggttcaaattccgaaaccctcttgggaggcatgaactttgtgtatcttccttcccctgggtgaccagtccaactccgtccgaccttcctctgtctgagatagctctgttcaacccagaggactcagcagctgctgagagtctgtgccaagcaggtgcccttggctgcagggcggggtgggcccagggcactgaccctctgaccagctgctccatcaaccctctggcactctgacagctcctagcccaatctgacagccaggatgacaggccaaaggagttggaggctggaaccagggccggagggaggtgggggtgacagcctcgccggaggccatggggaggggccaagagttggccgagaggtggggagagaggcagcccagtgatgactaacccaggcgccccacccagccagccggcttcccaggcagtcagggccaggcctgggctaggggcctcacaatcggacaggctggggggaggtgcagaggtgaccttctctcggcccaagacggccagttagtctggggagcgggggttagagtttccaggccctcctcttgccctcttccccccgcccaaccacggtgaaaccctaacctttgggttgcataaggccccggcaccgccgccccctactcctctcccctccccccttacataacatcccctggagagaacgagaggaggggccggcccgcccagcgaccccttccctgccagggcgctgaactggccctgacccagtgaacgccggcagaggcaaagcacctcctcgccgcccgctcggggggtccagaccctccccaggctagatggccggcccctgtatcctcagaccgggggccgccgggtgagccgcccccggccctccggcccctcggctctccccccgccccccgccactccgccagcccttccgccacgactcccgtcccagactctttcctcgtagctcctgacacactaacccggccagtccaggcccctctccccgaggcgcccctgcccccgccgccccttctcctcccggaagggctgggtgtggccgcccggaccccactttcaccctccatcccgttaccgcggctccccgctgcgtgaccgggtcgccagctcacacccacctggtgctgggtgtgggggttgctgcacgagggggagcaaatcactgcgtccgctccccacggccggcggcgctgtctctt

SEQ ID NO: 409 - DNA, 241244 bp, Homo sapiens
aaaggccagaagtgactcctgccgtagctgcggcaggcctggaggccgtactgggacctggccagtaagtgtgcatttaagagtttgcgagtgagcaggaccttgttcgtccccgcgatttatttgtgctgtgtaattccagacagtagatccgtgaaggactgtgtggtggggagggtatgaaattgagtgtggagagggcatttgagggcaagtcccatgactgactgggccagacagaaaatttaaaattcttgtcaacaaagcccgtttgaaaattttcagtgcatacatagccatattattatgttgtacatgtggtacacataaatattcctgtttttttttttttttttttttgagacggagtagcactcttgtcgccaggctggagtgctgtggcgtgatctgggttcactgcaacctccacctcccgggttcaagtgattctcctgcctcagcctcctgagtagctgggattacaggcacccgccaccacgcctggctaatttttgtacttttagtagagacggggtttcgccatgttggccaggctggtctcaaactcctgacctcaggtgatccgcccgcctcggcctcccaaagtgctgggattacaggcatgagccaccgcacccggctacacatatattcttatataaagtcaggttcagatactcaaatccgtgggtaccaattgaattatttttccaaatagtggaaaaagtgatgattttgttgctcagaaggtactacctttcccatccatgttttaaacataatttctcatactttgagccttcacactgcgcagtacctcagtttccccaggaaagccacaagccatagtttctgtgaggagctgagaagatagtttgccctcttgtgaaggtcagcctattggaatctaagagaagccctgttttgggtgtgttccccaagggagatgtttttctccttcaccatggagaggctttcttttttcttgcggcctccggaagcggcatcttagtggcccttggaactaggagggaggaatcaggctggcaaattctatccttaagcaaggttctttccatctgcccacggctgattcttcagcttctcgctttggaaaatgtgaccgatggagtctgcgatgacggttcctagggacaccgatatgtggaacatgtgcccaaacctctgccacagccaggaggcagaatttaagtttgcttactgacagctgctgtgtgtcagtcctggaatgttaatccttacagagagcttggatgacaggcaacagcttttagcagctgtgctaatgatctcatccatcaaacgaccctctcttcaccttactgttgtcagttatatccacgtctttgatgagaagtggatatgaaatcttaagaggcaggttacttttatttattttaaaaacatgagcctttaaaagaattccaaaaatagtacacacattgaaaaacataatcaaacatactgaaggaaaattttaaatcttgcctaaaattttagcatagaagtcatctctacctaaattttggtttaaatcctttcacatttttttccatgtttttatgtatccttttttctttcttttttttttttttttttgaggcggagtctcattctgttgctaggctggagtgcagtggtgcgatcttggctcactacaacctccgcctcctgggttcaagtgtttctcctgcctcagcctcccctgtacctgggactacaggcgagtgccaccatgcccagctaattttaatattttttagtagaaacggggttttaccatgttggccaggatggtatccagctcctttttttttttttttttttagatggagtctcgctctgtcgccagcctggaatgcagtggtgcgatctcggctcactgcaacctctgcctcccagattcaagtgattctcctgcctcagcctctggagcagctgggactgcaggtgtgtcaccatgcccagctaatttttgtatttttagtagagatggggtttcaccatgttggccaggatggtctcgatctcttgacctcatgatccgcccaccttggcttcccaaggtgctgggattacaggcatgtgccaccacgcctggccaatttttatgtattcttaaacacatacacaattgagatatcagtctgcaagcactgttttgtattctgcttttagaacacattttaaaattttctcatgatattaactattcttttagattatgatttttaatagttacgtagtgtaccatgctttgaagataacataatttatataacaaattttctattattgggcatttagggtgctctaagtttctgttctttaaaatattctgctaagtatatatgtgtacataaatgcttatgcatatctttaattgttaaatctatagaatagactttctgggcaaaggctaaagatagttttcagtttgcaacagtggagtccctgttattggagccttcacaataatgatattgcataggaaaacaaaaagtattcactaacgatcttgttgatcattatgtattgtaaatatgcaataatcaatttaagttgaatgcaaagtaaaatgagaaatcttggaacagttgcagaatttagtgaagtcagtgaaagtagtaaaaaaaattggcttgagttttgcaaagccattgaccagcgtgcattcagcagtgttgaactagttaacaattgaagaactgaaaatggacaaaaatgatgacccaatagatgtttcccgagaatgaattcaggatcaaaggattaggaaggctcttaaaaatattgatgaagtcatgcatttttgtgaaaaaggatgtattttattattgcattgcaaaacttaaaggatgtcatattatgttatcacatatgactgtgagaaatctgtcccttttgtcccaactgcaacatttactcattctttgttctaagaatagcagagttgcaattatgatctaaatcttaagaaatgcaacagaaggctgggcaccgtggctcacgcccgtaatcccaacactttgggaggccgaggcaggcagatcacgaggtcaagagattgagaccatcctggccaatatggtaaaaccttgtctctactaaaaatacaaaaattagctgggcatggtggcacgtgcctgtaatcccagctgcgcaggaggctgaggcaggagaatcacttgaacctgggaggtggagtttgcagtgagccactgctctccagcctggtgacacagtaagactccgtctcaaacaaaaacaacaacaacaacaacaacaaaaaacaaaaacagaaaaaaagagaaaatcaattgtttctctgtatgttagcagtgaacatgtagacagcaaaattagaaatataatgccatttacagtcacttaaaaaaagaaagaagttagacaggccgggaacggtggctcacggctgtaatccgagaactttgggaggccaaggtgggcggatcatgaggtcaggagtttgagaccaacctgaccaacgtggtgaaaccctgcctctactaaaaatacaaaaattagccagacatggtggtgcacgcctgtaatcccagctactcaggaggctgaggcaggagaatggcttgaacccgggaggtggaggttgcagtgagctgagattgtgccactgcactccagtctgggcaacagagtgagactccgtctcaaaaaaaaaaaaaaaaaaaaaaagtttgacatagatctaacaaaatttatatatggcttgtatgctgaaaactaccaaacactgatgaaagaaataaaagaagatctaattaaatgaaacagactgtagttaagaattggaagattcaacatagtaaatatgtcaacaaactgataaacaggcttcatgcaatttctgtgaaaaagtatagctctggctttaaagtttggcatatagtattctaattactaattatcttcccagagtactgtaattgtgatatttcccctaatgcagaattttaaatttatggaggtataattgacatttaaaagtgcacatattaaaagtgcacagtttgataggtttttacatacatagatgcctgtgaaaccatcatctcaatcaagataatgaacatgttcatggacccccctcccaaatttcctcctgctcccttgtaatcccctccaccctttctttgtgccccctacaaaccctccctctgcatcactagccaactgctggtccactttctatcactgtagttttcattttctagaattttatataaatagaataatatagtatgtactttttggaggggctgctgctttcaatcaacgtaattatcttgagattcaccctttttagtgttaatggtttcttttgatagctgagtagtatttcattgtatggatataccataatttgttacccattcatttgttgatggatattttggtttttctttttggtttttgcccctattacaaataaatgtgccataaacatttgtgtacaagtcttcatgtggacatacgctttcatttctctttggtaaatacctaggaatagaatggctagatcatatagataatttgttaacttttaaagaagttgccaaactgttttcataagtcattgtaacattttacattatgactcttggccaacactttggtcttttagtcattgtagtaagtgtgttgtggtatcttactgtgttttaattgatatttttctcatgattcatgatgttgaatgattttcagatgcctttttatcatctgtatgtttagtgaaatgtttgtctaaaccttttgccttttaaagtattatgttgttaccttttccctggatttttagatttgtttatatattctgaatataaatctttcatcagggatataagttgtaaatactttcaatctgtggcttgtcttttcattctctctataacagtgtttttcaaagagcagaagctttacattttgatgatgtacaattgatcaattttttcttttgtggcctgtgtctttggtgtcatatctaagacatctttgcctaagctgaggtcacaaagattttttcttttgtttctttctacatgttcttatgattgtagttttgatttcctctttgatccaaaattttgttttttggagattatttaactttttttttctcttttttgttttaaacttttgttattaacttagacacatttgagattgcggtctacacaatttataatgaaaagattgagggtgataggggtttagaggttgggggagagtaaatgttagaaggtagaggaaggagtgaataaagtacagtctttgtctagatttcatttttgttctgctgcttcctctctttctggaggttctactccatcaagcctttttttggtcttattttctgtccctcttttataagttcattctttcactttgtctctcatccaatctctctgacaatcctatgtatgctagctaccttcaataaatctggaatccatctacttctctttgtctcccgttgttatttttctgccctaagccactgtcatggtttttattgttgttgttgttgttagtttttttgtttttttttttttttgagacagggtctcactctgtctcccaggctggagtgcagtggtgcgatcttggtttattgcagccttgacttcccgggctcaggtgattctcccaccttagcctccctcgtagctgggactacaggcatgtgccactatgccctgctaatttttttctttttttctatttttagtagagatggggttttgctatgttgcctaggctggtctcgaactctcgggctcaagtgatctgcccacctcgacctcccaaagtgttgggattccaggtgtgagccaccgcgcccaactgccactgtcatcttttaacctttatttttcagtaggctcctaactagtttcccagtgtccatctttgctcccttagtttattctcaacacagcagccagagtgattcttttaaaatgtttgttaatatcaccctgctcaaaaccctccaaagctttcccacttcactctgagtaaaggcaaaagtccttagagtggccaaggggccctacatgatctggtctctcagttcctctcttatgccttaactgtctcatcttgctcagtctcttcctgccctgcttgacctcctccctgcccccctaacattccctacctgcccttgccttagggcctttgcattttctgttttctctgcctggacgtgctgtgcgcccatatactcacttggcttaccctcttgcctccttcaggtcactgctcaagtgtcttcttaccagagatgccttccttgactactgtctataaaatagtaaatgcggccgggcgcggtggctcacgcctgtaatcccagcactttgggaggccaaggcgggtggatcacgaggtcaggagatcgagaccatcctggctgagacggtgaaaccccgtctctactaaaaatacaaaaaattagccgggcgtggtggcaggcacctgtagtcccagctactccggaggccgaggcaggagaatggcgtgaacccgggaggcggagcttgcagtgagccgagatcgcgccactgcactccagcctgggcgactgagtgagactctgtctcggaaaaaaaaaaatagtaaatgcttccctcctactttctaatttcccattagtacttataatctggctcattacatagttatgaatttatttattgcttttctttcgttgtggaatataagcttctagagagcagaaactatattttgttcacacaaaacttaaatagtggctggcactatttattgatttattatattgatgcacatagtagatgctcaatatcgtttgtggagtaaatgaatgggcccatacagagggcagcctcagggagtgtttttcttagtaatttgtaacaatctagagagatataataaaaacaagctcagcaaaagatatttgtgtgtgtgttggtggggggtgaagaggtgggaaagggactgttgggtggtgctgaaggtataaaatattgaatgctctgcaaagccatatataatattaagatattaatagctaggtgagaactgtgagcatgaatagctttgcaagtgaaaaaatgaaagtccggtttaatgtatacatttactgtagtttttatttattcagctttaacaggaaaataaacgtcataaagcaagtgaccaaaaatagcacattttgtgcctttcttcagcctcttgatagcatcaggcaggtgtgtttactctgcactgatttttgtgtgaacctctcggctcttcactcgcaatttgttgacctgggactcagcaatgtcagcccgttcctcggcctcctccagctcatgctggagtttgcggaatttagatagattagcattggattgttcctcctaagaatagagataaaattgtgagaattagactgtgtggttctcattgcacttatcaccagacaggattagttcctcaaatcaggtatttccttcttatggtctatttagcatatccgactttaaatctaaacagagtttataacttcaactacaatttttactttaaagaatgaaaggagagttttgaagtggaggagacagcctcatataaagcccatacatccttttatgatttatgttctgtgtggaaaggaggaagagacctatgtacacttatagacatcagtaagtaaatgtaaggccaaattataattggggaaataccacttaatatatattttgattctagtatataaagaaagggaaaagatgggactagacagaaagtctcctctgttaattgactcattgccatttatgcctctcccttttttctttccttttcttcctatttacttcctacctatcacatgtgtctggaagagtggagggataaccaggaagggtataggtacagaatcttctaacatgttcttatattagctacagcaaatgtgggggcaagagcccccactgatgacactagtggtgagtgaagaagtcaggtggggtaaaagattgatgtttggcttttgagaacttgattttttctatgtctagagggagaggaatatttatgatggtattaattagaatttctactgtatatcatttgtagctatcaagtaagtgagctgtttagaacttgcccccctcaacccttacaaattgcttaataataaaaatatctcggctgggcgtggtggctcatgcctgtaatcccagcactttgggaggccgaggtgggtggatcacttgaggccaggagtttgagaccagcctggccaacacggtgaagccctgtctgtactaaaaatacaaaaaccagccaggtgtggtggtgcatgcctgttgtcccagctactggagaggctgaggcataagaatcacttgagcttgggaggcagaggttgcagtgagccaagatcacaccactgcactccaacctgggtgacacagcgaggctctgtgtcaaaataaataaataaataaatcttttgaagtcttattctgtaatttggatttggcgggacaaattcatatttataaaatcatccctcttaaaatgagtggtagattttcactttgtcttcttccttattgacgcattctcttaaaacactttctactgcaaaagaaatttccttctttcctcaagggcttaaagatacttacagcctcctcagcttgtctcttgtatgatttcaccttcgcctgtaatttatctaccaagtcctgcagcctgagaacattcttgcgatcttcttcagtctgaaagtttgaaaaaaataatctgcattcattccgaagagataaggctactctgggtactaaaataaaatcatttggcatgatggcaggtgggcctggggtaaacttgatcaactctgagattttcttcatagaattaacagtagcactcttggtaaatgtttccactgtgcaggtactgtattagagaattgcacacatcctctccagtccttacctccccatccgggaaaatagacactgttatctctattttacaggtgaagaaactgaggtttagagtgttaagttcaagaagcaagagaggccaaactaggactaatacccagttaatctgcctttaaaatctgtgttctttactgtcatgctattttctaaactttagaaatctgaaggcctccctaagttttagtataggtctgtgataagcaactgtctttactccttacatgtaccaagttaatgcgtatttgtttgtgagtggcatataaataaatagtcataaggttttcaatttccttctgggcaggaagagtggatattctggaaggctattccctttacctggtaggtgagttcttttactcgtcgctcatgtttccgtaaacctttaacagcctctgcattacgtttctgttcattttcaacctctccttcaagctcacgtacctgcagccaagaaaaatacttacgcagtcagtcttgggggatattaattagcccaagacctactgaaggcatggggtgggtgttcccagccccaggacaggatgggagtcttgtgtaggaagagagaagggtagagagagtgccctttttcccttcccagatttagagagattgagacacccaccctggcctccagtttctggatctgcttcttcccacccttcagcgccagctgctcggcctcatctagacgatgctgcaggtccttcaccgtctgctccaggttcttcttcatccgctccaggtgggcgctggtgtcctgttccttcttcagctcctcagccatcatggcagcctatttaggaaataaattaagaaagtaatgaaacttgatgatagcaggtgcatacgtgtcagtaggccaaatgttcatcttacatcagtgatggccttcttggctttctcttctgcattgcgtgattcttggattacttcttccacttcactttggagttgggaaacgtcattttctaatttcttcttggtgttaatgagactggtattctgttaaaagtagtcgtggaaatttacaaaatttgcagtttgccctcttgggattttacaagtgtcttacttgttggttcgtgcaggggatctgctggcaacatttcactaaactttaattatttgttcagtggaaaatgttaattatttgcaaggtaggaactcctttcccccaacttccccagtgtccacctgatttatgcataaggacttctgaggtttgagaatgcctttattggcatacattagttaattgttcttttaattatatttcagtcagacatcactagttattctatctctggaaggttggaaatagaaaagaatagattcgttttgtgagtggcaggcactgagagtttcttgctttgaaagaatctattctctctgaatttttatgatttgttctgtcggagagcactgaatttgtcttatgaaaacatgttcttaagatttcaactcagtgtttctagagagaagcaatatcgtctcaacaggtatttgaaaatgtttaggggcagatatttttggttgtcaaaatgactagggggtgctactgcatttaatgcctgggcaggttaggaatgctaaatgagctgtaaggcatggggacagtgaacacagcagtgctaaatgcttaagtgctaccaatgagaaacactgcatggaacattttcagattttggaggcaacaggtatctttactcaatagtattctacctcatggtttccaaaataatctaaatagccaaatcttatttttaaataaaaaagtaatagctttttttttttttttttttttttttttttggtgaggggtagaaaccccaagaaagaaacaggaacacacaccaaaaaaacaaaaaaaaatcacccataatccaccaattaccctaagataatagcaatgagtatttttgagcatatcccccatccatgtttacatacacatatttatacaaattgagtactttcatgttataattcgaatgcatcagctaccagtacaccagcatttgtttgatgtgagggtctcacctgggtgtggaggagctggacacgctcactggcatccaggagctcctgttcggcgattttcctgcttctctctgtctgttccagagtggcccacagctcctcgatctcagcctgcagcaggttggctctgcgctccacaattgccagctgttccttgaggtcctcctggccccggagagcatcatccaggtggagctgggtttcctaataagtgaaaaacagaaaggccttaagtgttctgaagaggatttgaagatcccaggagatgaactgggagattgtactggtgacaggaacagaagatgacatatgcctgtcatttgaatgcatctgattatggttaggtcatttgcttagggtgagagagaattatcaggagacatagattcttgttctatttctaccattaactggttactgtgtcatgtgtgagtcactaatgtctgtcatttgtggagcagtttccatatgctctatcaggacttgacatctgttatttcatttgatcttcacagtaactcagtgaggtgggtagtttcattcttattttgaagaaggaacagaggttctgagaggttaagtaatttgcttaaaatcaggcagctagtaaatgacaaaactaagactcaacctcaggcctgtctggtgcccaagtctgttcactttctttcatatcatactgtaatgcctaggcatctgtttgttcttctacataacattttcttaaaaataatatgttctatgtgtatttaattcagttacctttgtgcggtcagctgtataatttgttaagagaaaaaaaggatcgtttaacaaggtgtttgggaaatggaagacaggtactttccctgcttcatctgggaggcgaatgtggacccgtttaccttcaggattccttgggtgttcctgtagttccttaaactctctgcagctaagcgattggcatggttcagctggatttccatttcattcagatctccttccattttcttcttgactctcagagcatcatttctgcttctaatctctgcatccagcgtgctctgcattgtctccacgactctagtgtggtttctcttcagctggtcaatttcctcatccttttctgcgatttttctatcaacttcagacttgacttggtttaactcaagctggatacgcagaatctttccttcttcatgttcaagagatgccttaacaaaacagtgatcaattaataatggagaagaacctgagtatttggagtatattccctcgtgagccaaactcttgtcaatatcagtttgtctaattttacaaagtataatacagtagttctgggaatcttctaggtaaatcattattttgtttatttagtgacagattatatagggcagctctgcaataaaggtgcattgtgctatacaaatattgttcatattaatactaataaaattatataattaaattcatgtatagtaaatataaattctcaatctgttttagaaattaaaatgttcttgtgtgatatactagcccctgacctagaaactatcagttttaaaatgttaattttttttccgattacataataaatgttcattgtataatgtggaggcaatacataaaaccaaaagaaaacctagctgttgttcccccagtaaagagaaaaacattttaatatggtgtattttttctagtcttttttcctacttctatatatttttacataatcaaaattatattgtatatgcaaatttgtgtctttaaaattactgtctaccgtaaaatatttttccaaaataatcatatttcatggctatataaaatttcatcacatgactgttctgtgatttgcttacttttgttcttagattgcacatctttgccttaaagctttactccatttgacatcttttgggtgataaaatcttagaaatagaattgataggtcagagtatttacatttttaaggattttgataactattgccaagttgtccttcataaagatcctgtgagtttaaattatcactagccccacttttttttaactgatgtttgtctttgtttttccataacataatacaaggtaatatgtacctctgcttcctctaaagcagcctgaatttcacatttctcttgttctacttgcttctttattttctccaattcatgaatttgctttcctccctctgcaatctgctcagtgaggtcagaaatctcctctgtggttgaacagacaggagagaaatggtcagaaagatggcaacatggaaaggtcctcccagggatatatggagtagggaggactgtgaggactcacgttgcaagttcttattttctcttcttagcgtttcgagttgatccagggattcctcatagacattcttcaccttgaacagctcagtgctaagagaacgtgactccttctgggaggcctcaagttcagcctgagtttcctcatacttctgcttccattctgataggacctgaaaagcaataaatcatgagttgatccaaggagaaaggaagaccgagtaaaacactcttaaagtttaagcagtctgggccaccttgtcaaagttcctttgcttcttatcaagggctgcacaggctgcattagacctttccacatcaagcatgaggtcttcaacttcattctggagccgctgcttcgtcttctcaagggaagcacatttggcgttcacagcttctacatgttcctcagcttcttgcaggcgctgggccaactttttcctgaaaagttagccaggcagtcaggagaatggccaagaccagaagcaaagtgataacctccttggtcccttttcacagtcctatttcttttcttttcttttgtttctttttttgagagacggagtctcgctctgtcgcccatgctggagtgcagtggtgcaatctcggtcactgcgacctcccgggttcaagcgattctcctgcctcagtttcccaagtagctgggattacagatgtgcaccaccatgcccagctaatttttgtatatatgtatatttttttttaaatagagacagggtttcaccatatgttggccaagctggtcttgaactcctgacctcaggtgatccacccgccttggcctcccaaagtgctgggattacaggtgtgagccactgtgcctggccacggtcctgtttctatactggcaaatggcatatgattttcaaaacggtggcagccagaactgctttctagattggtaaactgtatggaaagatccaaagtggtgaagagttggaaacaagtcctgggaatattatagaattctaagaggctgctgttagtgctgccattgtatgcgccttactacctaagtaactcaggattttcaagacttctgattgagtatgactgtggaaaattattagccaggacaatcttgttgtttgacttatatatccattctcactccaatatggatttgaggttaactagatattttactggccagaaatatactgagcatattcatttgctttctcagacttttcattccattttatgtgtttttttcctagagaatagccagtttcttctaatcattatagttggacaatctctcctgggaaagaaactgatacataaatcaggacaattcgtgcagtttaaacaaaggcaggttttttttccctcctgaattctctacattctcagttcattttcagttgtgtgccaagtacacatccttatggtagtgaaaaacctttggcttgatgcccagggagatctacttgaaggtctccgtttgtctatatgcagactaaggcttcactttatttaggccaaccctaaacattatgtatggtttggtggcctccaacatgagttttaagaggtatgtcttctactcagtgcttaagaaggtgggctgtagaatcagaatgacaggctccaaacccagctgtatcatttattaagcagatacttttgggttagttggttaacaacttacagcctcaacttcctcatctgtaaaatggggattagaataatgataccaatataatattgttatgaaggtaaataagctgatatacatgcatacattatatatatataatacttgacacagtatgcactcaataaatgttagcttttgctattgttatgttatcatcatcataaatatcacagctgcttctgggagttcctcttctagagttcacagcacatacttggcctcctccagctcctctgtgcgctggatggcatccgtctcgtatttggttctccactgggcaacctcactgttggccttggacagcgccctctgcagctcagctttgccttcctgctcttcctcatactgttcccgcagcaggtcgcagtcatggcgggaggactgcagggcgtgtgccagggcgttcttggcctgcagaagtagcagttcagtgacataaattcatgtattcagtgatatttaacttacacatcccaagtagagcctaactgggcaggtttagatttggttagtcaaaaaaatccttggcaaaactcactttagtttcttcctctagttgatgtttcagctcttcaatctgctgagtagatgcttgcttgctccttgaaagctgagagactaaagcatctttctcatctaattgtcgagaatattcacctaggaataatagacataagggaattttttactggcataaaaataagcctaaaccttttacatttatatatgtgtgtgtgtatatatatatgtatatatgtgtgtgtgtatatatatatatatatatatatacaagttgtatataccttacctgaaatgcttgggaccagaagtgtttcagatttcagatttttgtttgattttagaatatttgcattacacttgccagttcagcatccctaatccgaaaatctaaaatctgaaatgctgcagtgagcatttcctttggacatcatgtcagccctcagttttgaattttggagcatttcagatttttgattttcagattagggatactcaacctgtgtgtgtgtgtgtgtgtctgtttgtgtgtgatgtgtttaatctacacttcatctgcttctaagtatttttttagcactggttagaaccggagatttaaaagcagcattgccatagaagtgttgtaagtaaacttgtctgctcagtcttgacttctttcctttttgaccttcttagcaaactctgatcatttgtttatctttctctaaagtgggaatattgctatttattagaacccctagaatccattttatttagtccatggtgttgggacccagagaagatgtctttacccgcttctgtctgcaggcgcgctctctgtgctgtgaggtcattgatcagccgctgctgctcctcttccttggtcttaagctcactcacttgatcttctagagagcggcacatcttttcaaggtttccctacaggatatgtagcaatgaaagatgagacattgaatgcaataaaaaggttaaaacttgattcttaaaatatttgtagagtaaataaattcatgtcaagtgtgagtagaaagttaggacatcaactctgtggaacatgcaagaatttaggcatggcgagtgcatagtgtgcctaaactggtcattgttggagaccatttattccaatgatattgacgcttgcttaaagtggattttgaaatcatcttaataggccgggcgcggtggctcatgcctgtaatcccagcactttgggaggccgaggcgggcggatcatgaggttaggagatcgagagcatcctggctaacacggtgaaaccccgtctctactaaaaatacaaaaaattagctaggcgtgctggcgggcgcctgtagtcccagctactggggaggctgaggcaggagagtggcgtgaacccgggaggcggagcttgcagtgagccgagattgcgccactgcacttcagcctgggcgacagagtgagactccatccccccgctccaaaaaaaaatcatcttaatcgatcataaccagcattttaaaaaataccatagaatgggatatatttggttagaaaatatttgagtagtgctgtaaaatgcctgcaaacaatgtttagtgatagagaataatgggtgttcttacagatgattaccttcatttagagacagtattgggtaccttggctttggaaatggcctctgcgttactgctgaggtcatcagtctccatcttcagctcactcttctccttctccagcttctgtttgacccgctgcaagttgtcaatctgctccccaagctcagccatactgtctgcgtgcttcttccgaagagcagccaccatagcttcatgctgcagggtggcctcctccaggtccctgcgcagtttctgaaactcagcctcccgcttcttgttcaattccacctgagcagaagttgccccaccggcttcttccagcctctcgctgatctcctccagttcccgggagaggtcagagcgctgcttctccgctttggctcgggacgccctctctgcctcgatttcttcccccagctcctcaatgcgggcctgggaatgaaagaagcacataaacataaactcatctcaacttcagtgtttttttggtgtgcagaaaaaatagaggtgagatgactcacctgcaactctttgatcttcttctgtagttgaatttctacagcttgctcatcttcaattttgcttatcaaattgctgatttcaaattctttcctttagacagaagagcaagacgtattaatactcatgtgaattgaaagatgatatcacatagaagtttttttctaaaaggctcctacttttcaagcttttcatcaagttgctgtttgtcattttccatatccattgtggattcttgggccaatttgaggtcaccctccagtttccgctttgctctttctagatccattcgaagcttcttttcttgttccagagacccttcaagctaataagaaagtaaatatggtaaaaattgaaagtatatatttttaaaaaaatctttcaaagggatatttaaaatgtgcttacatcatccacttgctgttctagcttggttttagctttggtcaggatgttgactttgtcctcctctgcctgcaggtcatccagggtctgctggtgggtctcttggagagccttcttctccttggacagttttgcaatggtttcatccaggcctgccatctcttctgtaagatttttcacctacaaaggttaagaaagagattatttctcctataaagcaatttagttggtggcagaacctctatacagtattgtaaaatatgactgataccttgttctccgtggcatgtttctccttctcaaccttggccagtgtcagctcaaggtcatcaatgtctttcttgagttctgaacattcatcctccagttttctcttcttggctgtcagctcagcattgatctcttcctcctcctcagctctttcagtcacctctttgattttggcctcaagttggattttgtttttaatcagttgctcacacctttcctctgcatcagccaagctatctgcttcctatggagagattcattcagatacttagagtctgttacttattttgaaacttggtgttttttttgcgcaaaaataatagtgttttattgaattctgttgaatttttcagtatgaatataaatttaatttaatcgaacattattacatggtctggagaaatgcagcttattggaagtgagactatagctttagaagcaaactagtttgcaaagttattggattggagctattgattatttaaaaaataatttgtagaagagtggaaagacctctaaatcgggcaaaaggaagcctgggttcttgtcccaatattgtttgcatatgtatgactttgggcaaattgctttattcctttcattctcaattttgtgtatatatatatatgggttggaataaatgattgccaagagcttttcagctgtaatatttaaagattttgatttagttaaattggttagttttggttttgatcattccctgtccccctcaaaccaataattgctaggctgtattgaagaaagaaaaagaagaaaaataatttaaatacatttccatgtagtattttttaatacactaaaaccttcctggtagttcatacagtgctataattgttcaaaatttacatttccatttacagaattacccattagtcttaaggtgaattttattttttggaacttttaccccaacttttattttgaaaactgttaaacttaccgaatagctgtatgaataatacaataaattgccatataccatttacctaaatcctcgtatttttaacattttactgttttttctctctctaaacacacacatagacacatatataggcacatgtgcacgcacacacacacacacactctcctaaatcatttgaaagtaaatggcagatatcatattttagcatttctctcctaaggacatgaacattctcctatataactacaatactgttattacaaatgaaaatattaatcactgatacaataatattatctaatatacagtctatattcagatttccccagtgtaacaaaaatgttctttaagttttgtggtttcattgtttcatttttatacacaacatgggcaataggcctaaactgcaacataattttcagagagttgtaccattgactaggctagaggttctcatgcccaggacaattctagttaaggaaagattgatgaactgttcttagccctttctgcttttgtgtttttgtttgcttttgttttcccattcccttctaaatctggttaatgtggaaagtctatgttgagcccctgaaattttgaaaatgttcaaacccatatgtcaagttaggaaaaaaaaatagaatgaacagtgatatgttatgaacctagatttaccagttgctaagttatgccacatttgccttgtccattccatttgtggccctctcccctctcccaataattatcaaaatgaattttagaatatatgagaaaatgtaattctcagaaactgtatagctcaataaagtttttataagtgactaatgaaaggattcaaataaaaatcaatccagtctaatttattaggttaccttggcctggggaatattttttaactcccagtgtttgttttgttcttgagtttaaaaaacgtttaaatggaatataatgggaacttattgggggattcttttcttttttctttttttgagctttactgcttaatatatttatttttaatagtgatacactcaatacatatttactcactgactaatgataactgtgaaaagatggtaagatagagaggctatggtcctgtgcttttggaaaaatgtaaccttcatataaatgaaggtatcagaaggaaaaattgaaagttgctgaaaaaaagtgggaaaactatccttttcacaggttagtttatgatattgttaggtttgctgaaccaaggaaatgggaggttacctttgaccaaagtgttcatgccaaacctactccccaccccaactgcccctccttcctgcaccaataaacagactctaggaactagagatttgtatcagaggaagaatcaggaggacacattgctctgcctgacatgctggtagttcagttccattaaatacagatagatttattgagctaaatcttgggggttggggaaaggagatacagaaataaataagtttgaatttaaatacaatctcatagacttgcatttagaaaatagagctatacttttaatgctgggctaaagtagcccaggcaaaggggtaaaatatttgactgagacttgggggattggctttaagctacttccttcatggctgttaaattttgtgatattatttaaacaaattcttcaatctttccttttcccattgtaacttggaaataattgtgccttttcttccccatagaatactaaaagataaatgaggtattaaaaacagcaacttgagattttttttcaagtagagatcatttgtaaatccaaagtatatgtgtgtttcaaaaaagcttcagtaacatggtgcattcagaatatggagtactcacagattgaacctggagttgcaggtcatttttctcttttaagagagtgaccattttttcctctagctccttccgttttgcctctgacttggcgagttcatctttggttttctggaattcttccttcatggtggccatctctttctcggtctctgcactcttgaggaggggcttaatcttgaaaaagagtttcatccagggccagtgcttgacgttcatgaaggcacggacattatactggatgcagaaaagtgcttctctgcgatgacatgaaaatatcagtgtagactaatccatcagagccaatgttattgttacttatcacacacaaatttcccttttaatgaatgccgctcacaaataaatatgtcacattctctatatattatatgcaggctttacacacacacacacacacacacacatgtacacacattctcgcgctcacactcatggtcagtagccctcagtataaccactttgctaatatgagtacggttcatattgagcacatcttctgtgttctcaatccctatcaaactagccaagagagtgactttaggggtgaatattttgaatgtatgatcagcacataccatttgacatatgacagtattagtgatttgagggtgggcatggtgattgcatgttgattgtgctgcctgtctgtgggcatatggatgagaactgtgaaatgacataggttgccttctgaatggcccacctaaactgagcgaatgatttgtcatctcttccttgaagttgctcctcttattttgaacaacactgaattatccactctataaactttttttgctagcttcttcagataatacactggcttatctcaaattctttcaagtgcctcagtcttaactgattaattggattgttaatatttgcgaggcattcagcatctgttgagctctaaaatttattttattgaaataaagtgaaaaatagtaataaaaggtacccctactgcaaactatagccatagactggctaggtttgactacttgtagcaatgtgtatgtttcttcaagcttgttaaaatggaaattctatctctataggtccagtttttaagacttgtaactctatgaaagcagataccttgacacaaaccataacgttcacacatgggaaagactcaggaacacttccagtgcaggcctaaatgattacagataagaaaaatgaatgcacagtgtgtgtgtaagtagagggaatgcaatagtgttgggtagataaactgggtgagattagttacagaaaggggaaattaaagttttaaattggtaaatagataaattaggatgaggggagagatgagataagaagataagcaaatgagagattagtagataagcaaattgtttagcctggctggaaaaggctatgtgcttggaaatgatagatgaggtggggaatagagagggccttgacaggcaagcaagcaactagcttgatgaaaatactgcttactgcaaactattcctgtggctgtatgtgagatggctggaggtaggagagaagttttgaaaggaatccaagtgtgagagctgaagcaaaggctgctgtgttgtaggagtgagttctgaattgggtgagaggaactattagccaccaaatgaaagaattaatgaatgaacaagactgattgatagtccttaagggaccttataattctgatattctgaatgattgttacctcctttgcaacatcttctgatattctaccctcattaggaatcccctacagacagcttgtgttcttgttataatttgggctaatttttcatctctcatttcttccagaagacccagaagtccagctttgaagaaaacctggagaaagagagagtcacaaatcatctccatactgcaggagatgcagaaatggcagaaggtacttggatcaggtgtaaataaataacgatataccttggtatgtccaaatttatattgagtatgatcaatatcaatagatgcaagaagtttctcagaagccttcttgctgtcaatgaactgtccctctggaatagcacttgcatttaaaaccttgtatctgctcagttaaagaaagaaagaatggttaggaaaatgtgaccacatgccaacaaaatgacaccaaaaagaaatatcaacaaacatctgagagtagaaataaaagtggaaaatccaactgccgtttaaggacagatagtaaaacaatatgattttctgttgcatgcctgcttcctgttatccttctaacctgttgtattatcctaccaccacaagactatattattcgacttcttaattttttaatacatactaattcacagtgttaatgaaatacatcaaagaagactgacctttgtttgaaatcaccatataagattctgcttgggaatcctttcctacagatgcggatgccttccagcacaccattacacctcagctggtgcaacacaagttcatgttccattgcccctaaaaatatagaacagtacttattagtgggcatttaactttcaaacctgtgcccgtttgattatttcactctctgtgtcttaccaggagttttggtttcattgggaatgatacaccgtacgaagtgagggtgtgtgctcctcagattcgtcatcaatttatttaaattttcctagaaaaccagacagaaaggacttgatgaaaaagttctatttcaggttgttttttgtaattatatggaatgaacctagacagtcctttaactactaggcatgcatctgtgaggcttcaattgctctgtattttgagggtctcaagagttctagcctgccaaataacaaaaaggccaaagtggttggaaggaatgcacatctccaaggtattcctttgtaacaccagggatctgtctcataaacaaattgcaattcagtaaccttgtgatgtacaaggaagggttctcaaccgagaatcacaagacaaaacatgatggctttgctatgccactaatgaactgcctgactgtataaaatccattttttctctgggcattatctgagaatagttgagattgtttgtgaggtctctttcatctctctcagtgctaataattttcacagtagcagtttacagtggtaacctaagttagcaattgtcctaacttttgcctttccttccttgagtgtaatatttcctgggacctcttaccctcttgttttcttttgatttttgaagagtctaaaattgtgaaactggccaggcatggtggctcacgcctgtaatcccagcaccttaggaggccaaagcgggcggatcatgaggtcaggagttcgagaccagcctgggcaacgtagtgaaaccccatctctactaaaaatacaaaaattagccaggtctggtgacgggtgcctgtaataccagctacttgggaggctgaggcaggagaattacctgataccaggaggcagagtttgcagtgagctgagattgtgtcactgcactacagcctgggtgacagagcaagactctgtctcgaaaaaaaaataaataaataaaataaaataaaattatgaaactatataaccttgggttggtgggtgttgggtacctgagactagatatactcttaagaaggcagatttttttttttttttttgacagaatctcgctctgttgcccaggctggagtacagtggtgcaatctcggtccactgcaacctctacctcctgggtgcaagcgattcttctgcctcagcctcccgagtagctgggactataggcgtgcaccactatgcccggctaatttttatattcttagtaaagatggggtttcaccatattggccaggctggtgttgaattcctgacctcgtgatctgcccgcctcagcctcccaaagtgctgggattacaggtgtgagccactgcgcccggccaagaaggcagattttttttcccacagctcagttaaccattaggaaatgaagaaaataagtaatgtgagttcctaattttgaaaacatgtatgaaaacaagttgataaaacaaaagtctatttggtaagataatgcaaattggttgtgagaaagaaaaagaacaagagtagttttcttgtttagatcataggtcgtatgtcgtgtctgtattttagttttataaggaatgagacttagccatacacattttgattaaaaagccattattagtccatatataagaacaagtttttaagctacataggaaaatcacattactttgtagtgaaattattattctttaatctcaagagatatttcgtatcttaatgatccatttaagtcactgggcttggctttagatgattttcagctgtaatgaaaaattaaattcacctcagaggacaaagatatgttttggtgaaagatgttatgaagagtgtatctgaggctcattctcaaagaggaactcaggaacattttcaaagggcagcattcaaagcggaataagaatatgaccttccacagggacagctttgaagtttagctatacttctttagaaatcagcctcattatataatgagaaagtttctaagggcattttggcaatcctgaatacattagataatcgtaataaggaataatgggtaaagcatccgttcctacaggagtagtatttctttggctatactctgacgagagctgatatttgaagtgattcctattaacattttattgcctcataattttttctaaatccttaattatgataattcatagaaactgagtagatatttcaaattaaatttgtactttaccctgaaaagggcagacacagtctggaaagaagagccctttttcttagcacctttcttcgcgctgctatctgaggtaaaaagaaaacccgtgaataagaatagaataccagaggcttatatgaacatgtattataacattatgtgagaatggatttaatttagattaaggacacagaaagtacctgcttcagcactagcatacgtggaaaagagactggctagagtcttcattgcagacttctggtacagcccaaccacagtatcattcagggggtccttatttttgtccagccagccagtaatgttgtagtccacagtgccagcatagtgaatcagagagaagtgggcctcagccttgcctttgaccaccttgggcttctggaagttggcagacttgcccaggtgctggtcatacagcttgttcttgaaggaggtgtccgttgccttagggaacatgcactcctcttccaggatggagaagatgcccagtggctgaattcagaaaagtaacattggtgtcaacctaacttctctcaaaagatagagacatggtggctgtcatttgattgaattatgagcaccccaattaaatatatgtatgaaataaaccagggtcacagctcgaagaagtcccttgttatcactagaatgacttttccactattcttctcacattcaatctgtagcattactttcaattaaaagaatagctggatacaaacttcctcaacaccgcatgttaaaatgttatgtattattatacttttttcctattcagtgaataaatctattgtcagagtttttcttcgttatgaaaatagcttactgacttatgatgttgactctatgcagtaattaaacagtataaacaaccaaattttattcaagatattttgggtatttaatttctttaaaatagattataggctgagcacagtggctcatgcctgtaatcccaacactttgggaggccaagacaggaggatcacttgaactcaggagttcaagaccagcttggggaccatggcaaaacaccgtctgtacaaagaatacaaaaattagctaagcatagtggcacatgcctgtggtcccagctactcgggaggctgaggtgagaggatcgcttgagccttggggttgaggcttcagtgagctgtgattgcaccactgcacttcagcctgggcgacagagtgaggccctgtctcaataaataaataaataaataaataaaatagattatgaagtagcgtatgcagtttgacttcttgactttgaacagattggctttcatgaaagcactaactgtgtcatgtgtgcattaatttttatatagaaaaatatttttattgtggacatcatggatcataatggagatagatcaagaactaatgaggacagtagttgtagtaaagcagaacatctcaaatagagttttcagtgctgtgttaaagttggatttgatccagtgtcagaataagaatggttagaacagaataaaagtaaacactgtcagatctttcttatgtagaagttaaaaagaggaagtaatttctaaatagtaattttccagtttgttcagatcacaaaccatttgagattacagtaatactttctagaattgcttaagatttctggaaagtgatcctcacagtctgcccttctttggaaaccaaaccgaccttctcaatgagctcaatgcaggcagccaggtccatcccaaagtcaatgaacgtccactcgatgccttccttcttgtactcctcctgctctagcacaaacatgtggtggttgaaaaactgttgcagtttctcgttggtgaagttgatgcacagctgctccaggctgttaaactacacaaaataatagagatttccaacatcaaatgagttttatagtagtaaaattcattactgaaaaaattcttttattgaaaaaatgtggaatgtagtaatgagatacagttaaaactaacgttgctccctcaaaaaatgatcattggccgggcacggtggctcacacctgtaatcccagcactttgggaggccgcggtgggtggatcatgaggtcaagagattgagaccatcctggccaacatggtgaaactctgtctctactgaaaatacaaaaaattatctgggtgtggtggcgtgcacctgtagtcccagctactcggaaggctgaggcaggaaaattgcttgaaccctggaggtggaggttgcagtgagctgagatcgcgccactgcacaccagcctgggtggctgggcgagaccctgtctcagaaaaaaaaaaaaaaaatcattattcacgtgagcctttctcatgaatcccaggcattgttgagggtcccagatatcaatgttagaacaagaattctggtagaatttaccttttctcctctaagattgcatgggcaagaatatactttaaaagttcaaccatggtcctgtgttatggtttcgattcaaaggtaaaagggaaaggagttgattggaaattctcacttctttcaccactcccactctccaattcaaaataaagttcacattttcacctttggctgttacattattaaggaaagctgatcttaagacctttaatataaaggtcttggtgtataaagtgaaatcattagggtaatttctcttctatttatatcagacatttagcaaatccccctcgtcaggtgtgtgaaagcagggacctgatatagtatagcagttgaagatctaaaaggtctttgtaataatttactcctttattttatagatggtgaactgatgccctggaggtaaaatagtttatgtaagacaaatctggaagaggagagacagactatcatctgtctctaggcttctacctttgggccttttcttctctatgaagaagccttgtgtatggatcaaatgctgtagatctgggttgctgtcctggatttgtcttatgcacctgtgggatctttagctagtgttttgatttccctgcatcttagtttcttctatataagttgggggaatattagctactccttgggttgttttgaagattaaatatggtaacgttttgaagtccctagtgtacactgctggcccagtgagcgttagctattattagtagtacattatgttacctcctattttggagataacctttgttctaggtgcagtgttggagcaagtaatatggacgctataaatgtggatgaataatgataatacctaatatatcaaagcccacaattgcctccttcttaattcttgttaatataactcacatcaaagatttcaaagccagcaatgtccaagaccccgatgaagtactgcctgggctgcttggtgtccagctgctggttgatgcgggtgaccatccacaggaacatcttctcgtagacggctttggccagagcacccaccgcattgtacaccttcacagatagagtaatgtttgttggtattgttaaagacatgccatgaaggcctgagatgtgtgtgattcattgaggtcatgcacttacctgctgcacagtctggcctttggtgacatactcattgccaaccttgaccctagggtagcagagggctttgagtaggtctgcagagttcagactctggagataggctgccttgtcagcgactgcagagacacagttcaggacatgttgtttcatgaaggatatcctcttttacctaatctttccatttttctccaattcaatctattatttaaataaaaagcttaaataattctataaaaggccaaatgaggttttctaaccttagagcatgtggttgccagtaaatggttgattggttatactgatctttagtgatttatttcaagtagtttttaagaaatttttcatcaactgtaaacatatgtagtatttattgccgtcttgcagttttttgtaagtaaaagccatagtccctgtttttaagacacattaggtgtagttggaaggataagataaatattcactgttagagagggtaaaagtcagaatattttgattcttatcttagtttttcacctccctattaaaccttgctggattaatttctttatctacaaatgtggagattaaaatttactgcatgatccctacagaatccctttctaaaattctgtcggtgactataacgtaaataaatgccacatgtcaggtacaccagtaactgctgaaacatttagaggaggaagaaagaatgtcaattcgaggtggtcaggaaaggctttaaggagcgataactgtctttctggggtagatcctgtatattgcgtgctctttccatacgtagaatatatgatcttttttctcaattcctttttttaactcttacttgctgcctatattgtctatggatttatatacagacaatacacacttgcttacagatgactctaggggtatctttctccccagccctgtatttgggcagattctctgctgtcagttcctagggtcttcctatctagtgctgaaatagagcagtctacagttatctacatatacccaccttcgttgccaaggccaaccaggagcactattatatctcattctatctcatagtttgtgcttataagtggctattggggtttgtttgtgacttatttgggctggatggaaatgatggagacatggagatgtaaggaagagagggggtgaggaaagcatgcagtgtgtgtaaatgtgtatatgcccttcacaagtcgcaagtccagccacaaaggagatgtgagtgtaaaataggatttttttttttgctacattctctcattaaacccagataaagtttcatttggtaccttctgtgccatctggctcagcttgctcctcacgctgcttttgcttgaatttcatgttcccataatgcatcacagcccctgtgagtttatagatggacactttctcttcaggagtgaagcccaggatgtcaatggcactctaccaggaaaaatgagaggacaaaagttagggctgaagagactaacttataagagaatttatacatatcctaaggtaaccacacctacagtagtttgctattgtcatttccatacataatggatttttaaaattagtgtttttgacttacatcagtggccatcaactcttcttggtcatcaatactgggaactgtgatctccccctgactgacgaaggcatagtcatatgggttggtggtgatcaggagcatttctgggtcacagaattcagggcatacattttacattagacattgttaataaaaatattaacttctatctatgactttaagttctttcttaccaattagatctggcttcttattggaagtgatctgataaaaaatatggtagcttctttccgcctttagctggaaagtaactctggacttttctaaaagatctggagagggaaatagatatcgagtttgaaaaaagtatcaatgcttctgagatagtaaatgaacctcacgtctttggtcaaatttggagcattacatttggctccaatgagatttcaacttgatgaccaattgcagatagacagtgattctcactgtctaagggcagcaactgaagcatacctgctctaggacaaatatatttttcacatgaaggatccatgacctctgtattttagttgatccctaatatcccctccttctttggatcacctaggattcactctgggtggtgagggcctaccttggaaacatctaccaaaactcagatcaggagcaaaccacagagatgtattggaaacccataagtagcccagtttttgtcctggaaaaaaatcatagttgcttctgaggcaggaatttctctaggatgtgttacagaatcatcaagtctgagattgagataaagggagcactcagtggattatgggtaagcctagcattagcttacaggcagtactggcagcagactacccttttaacaggcttcatgcacagcaagggtggcaaaatatccctgcaaatgaaatcacttgtctctctgttttgattttcaatggtcctgttactcacatgtttctatatcagcagatgccagcttccctgtagtaccaaagtggattctaatgaatttacccttgaaaagaatatttagtattagaaaactgaaacacaaagagagatgcaaatgaaataataattcagacgtggctactctggaagttaggggttgagaccaagagactcacaaagcgagaggagttgtcattcctcacagttttggcattgccaaaggcctccagtaggggattggcgctgatgatttgatcttccagagtcccctgcaaaggaaggagcagttctcacatctgggactccagatgtctgagagccttgacagaggttttgactctggctatcagacctacctgcattttgccagattcatccttcttcttctctccagtaactgcaattgttgcaaagtattggatgacacgcttggtgttcacagtctttccggcaccagattctccgctgtcaaacagaaatcagagaagagatcagagaactatggcctgcattgtcaacatctaagacaatccttgcaaatcagagaagaaaaaaaatcacatacgtgatcaggatggactgattctctcgatctgtgaaagaattcaaaatcatccgttaaaaaatgcatatttaatatgaagagtattgaatcagttcagatcaaacacagcttgttctttttaactttttgaagatgtcacctttggttttgattttgtgtttatcctccaaaatagccaattgcttctcagtgtaaaatttgtgaaaatgaaagcaaagaatcatctcttcctttttgtatttattaatttttaattgcgatgagatacacataacataaaatttaccatcttaaccatttttaagtgtagagatcactggcagtaagtacattcataaagttgtaaaatcatcatcacccttcatctccgtaattcttttcaccttgtcaaactgaaactctgtgtcccttaaactcttaactccccatctcctactcctcccattccctggcgcccaccattctactttctgcctctgtgaatttgactactctaggtacctcatgtaagaggaatcatagagtatttgtcttttttgtgactggcttatttcactcagcatggtgtcctcaaggttcattcatattttagcatatgtcagagtttccttccttttaaaggcaggatatcttattgcatgtatataccacattttgcttatccattcatctgttgatggacacttgggttgcttccatgtttttgctattgtaaataatgctgctattaacatagttgtacaaatgtctcttccagaccctgcttccagttcttttggggatatactcagaagtagaattgtgggatcatactgtaattctatttctaatttgttgaggaactaccatactgtttccacagtggctgatcattttacatgatcactaacagtgtacaagagttctaatttctccagttcttgtcaaaacttgttattttctgattttttgatagtaaacatcctaacgagtgtaaggtacatatttgattaatttttaaaacatttattatggaaaattcaaacatatacagaagtagagacaataatataatgaatccccatgtgcccatcatacagatgcaatggttattaatatttggccaattttatatcatctatacctcatcccaatctcactgaattattttaaagaaaatcccagaatcttataattgtatttataaatacttcaattagaattacagaattttgaaggcataaaagatcttagaaattgcttaggccaactcttacatttaagggataaagaaactgagacctgtaaaggaggaagtgacttttctaatattaagtacatagctagttaaggtcaaatatatcctcctggcctcttcccagcttttgatgtcactagtttgacttctggcaatactaaataaggaaggggtctggaattgtgaatatttgtgttcatctgttttattttccttttaatcttatatgcatttctaaataataaaaacaaatgtcactaattatgtgactgatatgttgtatttacatcaatttgctgatttgttaaatctctaattctatagtgttagattatagattttagagaattctaaaacctaaaaatctattcagggaaaatagatataaatctggatgttatttagatgtagatatagacatagactttagaaaactttagccttctcttcagggaagtcgatgcagattttgcatcctattcagatagatttgttttctagtataagtaaaaccgtggaagattatatcacatctagtggaagcacagatgagaaaacaatgttctggtctcttggcaatgctaaaataacactcaccagctcaaaggctagagctctgtaccattttgtacaaaaatcatgtttgggagccataagtaaccttgaatttggagcagccccaaaccctggggagcggggggcttgctgagtgggaggacaggggtggtgtacatagctgtgtaaatgcagctgttgagtattaaaacctctgaaatgagccagcgtttggataatttctgggaggtagttagcttctgttgacaatcaaagaacagtttactggcatagaatccttgtagaattgatggccaatttgtaatgggagattcctattttattccttcctctttattctccccctcgaaaagacaatttaaaaacaagtgcaaaaaaacaaaccaaaaagaaagaaaaaacaccttagtttccaaaattccatggaacaacaggaaactcaggaatagaaagtatttccaaaggcagtgcatttggtgtgtgaagataaaaggttttaatgctgtatttgggcctataatgcgtatcaaagctggttgtttatgccttgataaggcaggagtaacagactttgatacaatttaaacatttttctcagaaaagattttttcctttcattgtaataggaaagtgcttcaaatctttgggaggaaaatcatagctttctttactcatgttttacccttaaaggctggcaatattagctgtgtcattcaaaaataaacataagaattcacaaagttttccagctgtggctgataactcttttcgttgactgctgtgagcctgggtatttttaaaaagtctgtttgaacacttttttctatccaaattggaaagtaacaaaatatggaaaacaataaatatgtttacagtggtctagtaattgtttcagctaggcttccacttaactatctgtgttagcttgggaaggacagtgaattcagtgagcttcactttactcatctgtaaaatggaggtagctgctgggaagagcataagatgtcacagctgtgaaagttttttgaaaacagtgaagccccatgtggctagaatgtattatcataacataaagaggctcggaagaggtctgtctgttctgcaaagattctatttacacatttctgtaaatagatgcctcactcactcaccagtcaacatgaactgataggcattgtcagagatggagaagatgtggggcggggcctcctggcgctttttgcctctgtaggcagccaccacctcgggcttgtacaccggcagccacttgtaggggttgacggtgacacagaagaggcctgagtaggtctgggaagatcagaacatttatcatttggatctcgtttttactcagagagagacatgaaataaaaaggtgtttacagacactcacgtagatcatccaggctgcatagcgctctttgaggttgtacagcactccaggctcgtgtagatgagtcatcatggccatgtcctcaattttgtcatatttcggagggttcatagggaagacttggtcttccctgacagttagagtctggtgagtaagcaagaaaccagttcgtttttgtttgtttgtttgagatagagttttgctttttttgcccaggctggagtgcagtggcgcgatctcagctcactgcaacctccgccctcctgcttcaagtgattgtcctgcctcagccttctgagtagctgggattgcaagtgcccatcaccatgcccagctaatttttgtatttttagtagagacaggatttcgccatgttggccaggctggtctcgaactcctgatctcaggtgatccacctgcctcagcctcccaaagtgctgggattacaggcgtgagccactgcgcctggctaagaccagttcgttttaatggttggaggtagggtttatgtttgcctgtatattttggtacaaaactataatcacacatacttctcattatattatttaatgtcctcttaaaaaaggcatgaaatatattcatttcagagtttaatgttaagaaaacctgtttcctatgatgagctaggacactatctttttaaaagattttttcctcccacattctcttatcccagatttatcagtttatatcctttttttcttattttagtaggctaaatttttatttttttctttcattcattaagaaacttcatgtttttggaagtaatggggatattaatacattatttaactaagtaaatatttaacttctgataggaggagcttgttttcatttccctcaagtttggacattcagactaggaagtggggaattgaagggaaatggtgaaggccatacatagtggggtgaggtcctgtgcgaagttgggaagggaagacatgaaggtactgctgtgaatttcttttgccttccacatctaatgtctcaacactgactagaagggtgtttgcattggcaacaggcttggagattcccagtaagttaggcttcaacttttgaaccaagaaataaaatggggagtattttctccctgttttcacttactgctccaccttcagtctttacggttactttccctccttctttgctttgtatagtgctcttcacataggattccttgggctccgccacaaagacagatgttttagcatcaaacggcttgttttgggcctcaatccgctccttttctgattttcgaaggtagggagcagcttcgccaaaaacagccatctcagcgtctgagctcgcactcatggctgcgatttatttagcaaaggattctgcctagggaggagagaaacgggagagagagatataaaaagcagaagtcacaaatgtgagttaggatttgaaatgaaagaaatgttgaacatagcctgtgctgtaactattcctccaaactggcactccccagtgttctaacatagtctaaaggacaagtatggagtgagactgtaatttgagatttcatttttaggactgtgaatttccttttcagatcacatatcttgatcctcagggatagggtacctacaattgaattagaatgaaacctctacagctaaaactattgatggattgttttatagcaactgtcattatttaatttcctctcctctttctgcataatgtttgtctatgccatatgccaggacaatcatatggtgagaaaagaaagtttgtcttgttcaaatgaaggttcatattttcaaagctatcaaaaaatctttgccttttaagatggccattttctctcataaagcaaataattatttttaacatctttatgttgatatttggtgttgtatctctcagtggattgttagaagaacataatacattctaatactctggattttttgtaatttgggttgttcccaacagacttagcattgccttgattccaaaatcttttttgacatgagagatttcagctgtcagttaacagatctaaccacagaggaatgagagcttcagcacaaaggcccttcttcccacataaattccatgggtttcttttctttccacccagaaaacagagaaaaaagttttaagagtacatcacatgcatgtaagccattgtcttctgattaatagataggcctctgcaatgtggacatgttagattggttgagtttttcctttattttcaattagaaagttacttagggaagggcaggattcctcttaaattagtcatggtatttaacacccggtggatgtaatacttgcgacctgttaagtaaataataataagtctttctaacaacaaataacaaataatcaaaggtagctaaaatatttatatttatatttctaggtaaaaatctttctggagtctttaaaaatgtctataaaatgtcctaagtcctcaatgctttgccatagaagaagactggcatggactagtctattgccactggacagttctaagcacagctgagaactcactgttgaagctaattctgtcctaaacggtctttgaatcttggaacccaaatgaggatagtctctgagaagaagacattttgaaaaagttattttctagcatttataaacactcactcggaaacactctttcctgatataactgcaaaaacatggaaatggtgtataattcaggattgttcacagcttcattagactatatcccctctgtcatcaataaattaataaagccaagtcttacctctggagttccagataaaaatgcaggttcagaagtgttccactctgtaaaacaacaagcttcttattagtgatgctccgaaattccaatattatagttacagaattgttattatagttacagaattgaagtttccctaccccaaagcttggttctatgaagacaaaagttaagattgagagagcagtttaatgctcacagataactacgaggtcagctcttttccccacctggggtttttcgagttccaaggccttcatcacttacctctgggttcttggtggaaataaggcacaaggggcagtcctgcttatataggaactaatgtgctgatgctgcaactacctcctctttgttagggcaagacatttggcaacatgaaccctcagcatagtttgtagtgacatttgtcatgtttggatataattagaagtattcatatcattttgtgtatgcaaaccaatctcctataaataatttgacagagaccgatctgccagcagagaatgctttctagtgtgctgggaagggaatctttgacagtgcctgatggggcctcagagtaagttcttaagagctatattcaatttggcaaactctttcatgcacgcctgtggtagccaaatgatcagatacccggggcacacggctgtcagggccttaagcacgtttccttatttgctaccacgggaaccccccactgcattcccttgggccactacagatgctcactcttgaagtccaggcttagacagcagagattctaccttgagtctccaccattgggccagtgcccactcatctaactttgaaaaacattattagtagaaaataatatgtttattacagaaaaaaatacaggtaagtaaaaaaagtctctgtaatctctaatgcagaaataagatagaggcgtataagtgggatcatattatagatgcatatatagtacatgtgtgccttgtaatatgctttaataattaatatatcatatcactaatgtaatttataccctattctttaaataaattatgattttttttaattaaactctttcctttttttaaggtcagatatattgaggtataatttacatagagtcaaattcacccttttaaagtgacagttttatgaggttttttgcttttatttttaaaaatttttaaactttataataaaatttacttcttttgttgtatgattgtatgagtttttatacacgtattgattcatgtagccaccaccacagataggatgcagaacaattccaggcctatgggtttgataaatatatgcaggtgtgtaacctcttacactgtaattacataaaaattaaagccttagagattaggctaaattttccctttgatgaacactcacaatgctggtatctcccttttctcccaaggtaactacggatacccgtttagtttgtaatattgcagaccttttctgtacatttacatatgtattttctgggaaaatataaattagtaaaactggtctaaggaaattgggccatagaaaatttataatatataatatagatgtttaaaatatagatagtatgattatttatttacaaactttcttttttcattctacactcttggatcatttgccatgttagtacataaataataatatgaaaacatttcaaacatatgcaaaagtagaggggatagcataatgaacctagtatattcatcatccagcactgataattatcagttcatggtcagtcttgtttcttatatattctcaccattccctctatcactggattattttgatattactcatttttaaatttctgtgtaaaattccgtaggtttaagattgtaataattttgtttatacaagttctaaaaagtttctcctgatttaataatgatctttactatgcgatctcaatcttctagaagttttacatctttaggtagtcagagttataaaaaattttcttttatatttttggttttttgtgtgtattgtataagaaaaactttctctaactcaagaactcagagtcatacatatattcttctgtattttcaagctaatgcttatgaaatagtgagatgtgtaatcctgtattttcaatctgatgcttaaaaaatagtgagatttgtaatccagctgtgtgtgtgttcgtgtgcatgtaatctgtttctggattccatattttgtaccgtatttctatgccaatagcataggttttgatgaccagtagggccaattttccctaattattcaaagttgtcctgttaatttttaccttctactatatgagttttagaatcatgttcttcaggttatggaaaattctattgggattttgattttgattaaattgatttaatagattaatttgataagagttgatagctttataaaagtgagtctttcagtttataaggatgatatattttcctgtttattccaagtccttttcaaaaatactttttagtcatttttaaaagttttttccataatgatcttatattccttgttcggtgtattcctacaaattttagagttttctgttgatatgttgaataggattattttttctattacactttctacttggttactactggcacgtggcagacaagtttgcataatcagagcttcacttttgtttgtggcagtagtatgccaaactatatattattatattcagactctcagcatagggtaaccatatgacactgttttggctaatgaaatgcaagcagaagttgctgggtggagcttccagaaaagctcttttctaaaagagggtagactttgctcatactacctttttctttcctatctctatctttctcctacgtagaacacagatgtaatggctagaactatagccttaaaagaaaggtcaagagatttttggagaccttagccttgacacctgtgagctgaatttcattgtgtgaagaaaaaagtaaagcactaattttttgaggcattgtttactcaggttttttttgttacattcaaacacaatccctaacatacacggcgtttcagaaagttactgacttttctgtgttaaccgttatctggccctcttgccgaactctcttaccacctctaataatttatttgatgctcttggattttcaatgtgtcatgcgcaaataatcacaatttgtgtcttctttctcttgtcatttatatgttatttttttcccttctcttattacattgtctatgacatttaggacagtgttgaatagtattaatatagtattaatacagagatacttgtgtacatatcctgtgcaagataagggcatccttatcttgttcttgacttttattggattgcatctgatgtttcaccaaacataatatttactgtatactttgtatctagtttgctaatcattttgatcataaaaatgagttaaatagttctatttctaggtatatgcccgagagaattgaaaacatgtttatataaaaacttgtacataaagtttatagcaacattatctataatagccaaaaagtgggaacaatcagatgtccatcgggcaacaggtagataagcaaaatcctgtttatcctataatggactctattaatgcaatgaaatattattcagccataaaaaggagtgaagttagatgctactatatgggtgaacctaaaaatattatgttaagtgaaagaagcctgacacaaagggcccatatttgatgattctgtagatctaaaatgcccagaataggcaaatccatagagaaagaaaatacattagtgattgccagaggatgtggagagaagagaattggggagtgactgaaaatggacatggagtttctttttggggtgatgaaaacattctggaattaatagtgatggttgcataactttgtgaatctaataaaaaccactgaattatacactttaaattgtgaattttatggtatgtaaattatgtctacaaataatgggttgaattttaccaaattttttatatctgttgagattactgtttttctcccctgacctatcaatggagtgaattatatggtaggtttttctcacctttaccaccctagaattcatgaaataaaagctattgatataatattgtttaattctctgctgctttcagttttcgaattttttattggaattttaaaatctgagttcatatatgactaggtcaaagttttcttgtgctatcattttcttgttttgatattaggatcatattagtcttgtaaaataaactgagcagcttcccatttgtttgtgttttctataacattgcgtttgagatgtgaattatctgttccatgatggtttgatagagttcctccatggaattcttttgacctctagcctttgtggaatataatttttttactcttattgagttttttttatgattattgattagtctttgtagagtttctacttgtcttttggcccatttggatgatttatattttcctataaaattacttattttgtgtgagtttttatatttttgggtcttttttgtgcatatctctataataaaaaatctcagtttagtaatctgtttcattatttatattaattttgttcttctttttattttaaatcatatttgccaaagttttatctttttcatttagttttactgatagcttttattttctagcttattattttcttttagttttatcaattgctttatttccttagatttgttttgattaattataattagtttaaaattttgattcttgtttcaactcccaaattatttaaagcattttgttttttaaacttccaggtgtatgaatttgggtgttgggcaggcggatttcatctagccgttaattatttttatcttttgtgagtgtgtgtggttgtggtgtgttcatatcctagtacgcccaatgggaatgaggattatggttcctgtgattgtgtttgtgtgtgtggatgtaagtcataaaacaattcaaatagtatccaataccccacgaaactctcatgatcttctgtattataactcatattttccttccttaaaaggttactatgaatttatttttatgataattatttctctgcatttcttaatgttttaaaatttgtatatgcatccctagtttagttttgctggttttgaacttcatgtgaatacaactgaatttattttttagtatcttacttcttttgcccaaaattattgttgtgagatttttccatgaagttgcatgtaactgtgttttatattcattgtgtacagtattaccttgtctgataatatgattatttattcattctactgcagacaaatttttgggttgttcccagtttttggctgtagtttattgattgattgattgcatgatgaacagtgactgtcacctgtatgatatctcattttagaattagttgacatttcttttgtggctttgttcatagatcagggtattttttttaaacatctttatttaggtagaattttacataccttaaatgtcatccattttaattatacagttaatgaattttagtaaacttataaaattgtgcagtcatcaccacaatctagttttagaatacttttatcaatccaaaaagtttccttttgctcatttgctgttaattcccattcaaccccaaaccttggggaaccactgatgtgctttttgtctctacaattttgccttcttaagaaatcgtatagaaatggaatcctacaataggcaatttttcgtgtctggcttctttcccttagcattttcatttcaactcccaaattattttattttttaaacttccaggtgtagaaagttggttgctggggaggcagattttatctagctattaactttttatcttttgtgagtgtgtttggttgttgtgtgttcgtatcctagaaggaaattcaattttttgaatttcatctatatgctgttttatgtgtcagtaattcatttctttttatgaatgtatatgtggtagtccattgtctagaggtaccacattttgtttatccattaaccagttgatggacatttgaattcttcctagcttttggcttttataaataatgctgttattaacattccacataagttgttgttcagacatttgtttttattggtttgttttccaggaatggatgttggatattataagaaatggccagactgggaaatagcagacaaaagatattgcatctattctggttggagaattgcagtagtggagttctaagtaaaagaaagcaagtttccaggaataaaaagcttttaccacccaatgaattaacaggccatcctacttgacatcaaaacacatctttaaaatatgggattaaaacaatatataattaatgtagataagtataagagtagaacataatatagtccagaaatggactcttgtatgtatagcaagttagtataagataaaggtgcatttctgattcactagaggaagggaagaacaattcagtgaattaaaattgagacttaacaatttgaaaaaaaattaaattacttccttggctgacaccatttataaaaataagttctagatgaattaacatcttaggcataaaaacaaagaagtattgaagaaattataggagaatatattgatactgtcggagtagggggagatctttaataaggcaaaaagatcagacatttgaccacatcaaaatgtaaaacttctcaatgattaaaaaaatctacacaaacaaattgaaagacaagtggcaggcttggacaaactattagcaacttaaataaagaagttatattcaacacacacacacacacacacacacacacacacacacacacacacacacacacatctctttcaaatagaaaagaaagggagatacaagcaagtaggaaaaaatagccaaaagatagaaatagataattcatggaagaggcaatacatatggctaataaacatgaaaacatgctcaatctcaagaggtacaaaataaaataacaaagagctagtgtattttacccatcaagttggcaaaaaaaaaataataatggtagcaaatggtggtgcagagaggtgaatgtaatatgttgtgagtaaaggtgtaaatttccagggcaatttgttatatcttttgaaatttaaaattgcagtgatttcacttctcactttctttcctgcagaagcacactgaaataggaaggatgctcaagagtgtacatttaacatttcttctaatagcaaaattttggaaacaactgtcaattcagttacttgtaagttaattaagtggccacctgttaagtggtggtgctccgatgatgtggtcagtggttgaaacttgaaactcgccttaatctaagatttggatcagcataatgcattttccactggttctctttgagatatactgaaaactgaaaatcttatttaaaataacaataaacaatgaagtaaagagtttttataggtaacatatataagaatactaaactgggagatatattttgctaaagcctaattattggtatatttcaacccttctgtaatgtacagatatctcttctaccattcttgtgtgacaactcatttattttaacttagagtaaaggcccttccaagggtctggcttacatcccttgtccttgctcttcttcgctagtatccacttacaattaagccgagggtgaacattaagttaccgtatccaatgacccttctgctctaagagtccttgccagaaattagcttacaattcctaagatttcctctgccctaagagttcctctattttctctctgcagtgagtaaaagcagatgaattacagccactttaagacatctctaccttttctaaaactctgtaattatattctcttcaaccaaaggaaacaactgacctttcatatgactcatgccaaagaggaatgttatttagattcatccacattcttgcatgtatcagtagttcatttctttttattggggagtagtactccgttgtgaggatgtaccatattttattcatctgttctcttgctggtatatattttttatctttttatagacatatctttcatttctttcagttaaataacaaggagtggaattgttggatcaagaggtaggtgtctagtaactgtactgttttacatcctcgctagtgatatatgagcaatgtggttgctcagtgtcattagtctttataaatttagccattcttgttggtttgtagtggaatctctttgtggttttaaaatgtatgtccctagacaatgatattgagcaacttttagttttgttattaagctttcatatattctcttgatgaaatgtctgtgttttgcccatttttgttggattatttttaaagaatattgttttgtttgtgttctttataagtcattttttcagtatatgtattgcatatattttttttagtaggtggcttgcctttttgtgttcttaacagtactttgatgagcagtagctttaactttgaagaggaccagttttatcattttttctttcatatttagtgcttgctgtgttctgtttaagaaattttgcacgagattacaaagatactctcctatattttcttctaggagatgtataattttagtatttacatttaaatctgttgtctaccttgaattaattgttgtgtatgcgttattatttttttccatacagatgtctaattgatccatcatcatttgttgcagagacttttctttccacattgaattgcattagcaacttagtaaaaagtccactatatacatattggatctatttccagactctccattctactctattctgttccattcaagtattcttctacccttacactaataccacactatcttaattactgtagctttgtaataaattttaaagtctgtagagtaagttctccaattttatactacttactttttaagacttctttggctactgtaggtactttatatacttatatgcattttaatatcaaactgccaacttctaccaaaaaaaaaagcttgataggattttgattagggttacactaaaactatagatcaatttgtggaaaactgacagatttacaatattgagacttcagtccaagaacatggtgtctctctctctcctctctcttttagtcccattttttgacagaaagtgttcactgttttattattaagcaagatatcttagctgtgctttatttgtaggtgcctcttactagattgagaaagttttcttttattgcttgtttgctgagaggtttttttttcatggatgggtgttggatattgtcaaatgctttacttcatctgttgagatagttatatgattttcttttttattctgtgaatgttatgaattacctgatttttgaatattaaacctaccttgcattcctgtgataaattccatttggtcatgatttattattattattgttgttgttaatattgttttcatatatagtaggcactgcataatgacattttggttgacagcggactgcatgtattatggtggtcccataagattataatactgtatttttcctgtaccttttctatatttagatatgtttagatacacaaataccattctgctacagttacctacagtattctgtacggcaacatactgtccaggtttgtagtctaggagcagtaggctataccacatagcccaggtgtgtagtaggctatactgtctaggtttgtgtaagtacactctgtgatatttgtacaatgaggaaattgtctaatgatgcatatttcagaacatatccccattggtaagcaacacacgattgtattgttagacgttgttggatttgacttgccaaaattttgttaaggatttttgcatctattagggatattggactataattttctatattgtttttctattctcgatttcattaatttctcctctagcctctattatgtcctttcttctacttgctttagatttcatttgtttttcccacctgctgtgccttaggtggaaaattaggttattatttgagctctttcttctctctttatatagacatttacaactgtaaagttctgtctaagcactgctttagctgcatcccatatgtttttgtatattgtatattgtatcttcatgttcattcatctcagagtactttctggtttccctttcgattttttctttgacacatgattatttaggagtgtgttgtttaatttccacaaatctgtgattgtctcaatttttttcctagtattgatttctaatttcattccattgtggtcagagaacatactttgtatcatgcctatccttctaagtttactgaagtttgttttatagcctagcatgtggtctgtcctggagaatgttacatttgaacttgagaaggatgtatattctgttgttactgggtggtgtgttctatagatatctgttaggtctatttggtttatagtgtttttcaagtcttcctttttttcttattgatcttcattaattgttacatccattattgaaagtgggttattgacatcttcaatcattattgtggaattgtcagtttctccctttatttctgtcagtttttgattcatatgttttggtgcctctgctattaggcgcaaatatatgtataagtattatgtcttcctgatgggcttatccttttattattttttcattataaaatgtttctccttatctctggtaacttttttttaagtctgttttgtctcctatcagtatagccattccattttattatggttcctgtttgcaagataatgtattttttcatctttttacttatatttgtggcttctgtagacagcacatagtttgaccatatatttttatacattatgacaatctctggcttttgattggactgcttaattcacattcacattgattcacatttagtgctgttattggtatagttgtaattatttcttgtatgtcccatgccttttttgttccacttttctttcttactgcttccttttgcattgaaaattttctaatgtagcattttaactttttagtaattctttcactatatttttattttattttgaaatttttctatagagatgggttctcactttatttcctatgctggtcttgaactcctggcttccagcaaccctcccgcattggccttctaacatgctgggattacaggcatgagccaccatgcccactcctttcactgtatttttttaatagataccctagagtttaccatatactgtaaaccttaacttatcagaaccagtttcagattcatactagttttattctagcgacatatagaaaagttacttctacatagctctactccatttttccccatttttgtcatattactgttacctgtagcttttaatgttacaaacccagcagtacattgttaaagttattattttactatttatagtcatttccttagcccaatacagctttgttcccacacaactcctttatgctgtattggcaagtatgttacacatatattacatttctttatgttacaggcccaaccatacaatgtatatgtattattttatacaattgctttttaagtcagttaagagaagaaaggagaaaaaaatatgcatttatactgtcttgtaattacatacttacattttctggtactcctttttttgtgtggatatgaattcctgtctggagttacttgccatcagcttgaagaatttcctttagtatttcttatcaagcaggtttgctatcagcaaatactctcagtttttatctgggaaactgtttatttcaccttcacttttgaaagatagatttgctggatataagattttttggttgatgtgtgtgtgtgtgtgtgtgtgtgtgtgtgtgtgtgtgtgtgtgtgtctttgaccactttgaatatgttatttctcctggcctctattattttggctgagaagtcagctgttaatcatactgttctcttacaagtaatgagtcatttttctctcactgctttcaagattttctccctgtctttaattttcagcatttttactatgatgtatctatagatctatttgcatgtatcctagttggtgttcatcgagttatctggatgtatagataattgtttttcaataaattcagggagttttcatccgttatacatttgaatattttttctgctcctttctctttgtcctctccttctggtattctcactgtgtatatatcggtgtacttcattgtgtcctacatttctttgaggctctttcattttttattattcttttttccctcactgttctttggctttcataagctttatcaatctctcttcaaattcacttattctttcttctgccagttcaaatttcctgttgagctcctctagtgaattttaaaatttcatttattatactttcaactcgacaattctgttttttttaaagtaatttctacgtttttattgatagacattatttgatctgacattgtcattatgccttcctttacatctttcatcatattctctttatttttgtgaaaatgtttatgataactagtttgatatctttttctgttaaattcaacattgattgctgtcacaagcagtttctgttgcctgcttttttcagcgtatggattatgctctcttatttctttgcaggtatcataattttttgttggaaactggacattttagataatgtattatagcaaccttgggtagtgttgccctctccagggatcgtcagttttattttcttacttatttgttattaaacaatttctttattacctttattatttttaaaaattttatttttaaaattagtgcataatatttttacatatttatggagtacatgtgatattttgatacacgaatacactgtgtgatgatccagtcaaggtatttgggatatccatcacctcaaatatttatcatttctttgcattaggaacatttccatttttttattctagctattttgaaatatacagtatactgttgttaattagagtcagcctcctttgttatcaaacactggaacttattcttgtcagcacaagaatatttgtttttaactggctggtttattttagtgaagtttgtttcccacccacagtttaaagcttctgatattgctcctcagggaggtgcagctttggtatgcccacagccaccctgtgatgacagtggttttgagagggctctcttcctctctttctctgaccacacccagatgtcaaactccactacttggtggccgatagctttattgattttaataattcctttgggcataaattgttctatgaactaatccaatcaaattctgcctcctttgaaaacataatttctgaggtcagtgtttaatatttgttttgatcccagggggacttctcccagctatcttattacctggttctctcctaaaaactagctggcatacagtttagcctatatctttaattgcatggcaatttgtttttaccacaatgtgccctgttgttgaaagtgcacttgggttttaatttctctgccttctgttgcaaatgaaatcagttcctttgggcaaagattaggagctctgttttatgactcacttctcccctcaggcaaaatccgagccagggctttggagctggtggtggagacaattttaatcttctgattgacacctccattctgggaactgagcacttggtggggatgagcagcagcctaaggcccgcttggcttgtctctcctggtgtggaacctccacctcataagtcaggtcaagggtgatcagggccccaatattctcagcacccggggtagagcttctgttccctgagtggtagctgggcagaaaagagagcctaagcctttcaatcacatttgctcgggtcttagcctcagaaacgggtagctggaggtagatgaaaaatattaatgtcttgtgctttttagaaagaaagccctctgactgggagctcgagggaaaggaaatcctgtggttggctgtagcaatctggagtggagtcccacctctctgtgctgggatggtaagaggcaggaagtgattttggttcaataccacagaacctttcctttcttactgaatttgcatggattttcttgatagatgttttttccttttctgtttctttagaaccatttacagagactttaaatgttgttttgtttaagataattttcacctatttcactgggaagaggatcggtggagctcctcatgctgtcatgctggaagtcaatcctccttatagcacgtgtgtgtatgtgtgtgtgtgtttctttgtatgtcatttttagtagtttgctttaggtattacattatgtgtgtctcatcactgtcttctgttgtcatgttatcagttcaagtgaaacatagaaattttacctccctggaagtccttttaccctcccagtttgtaattgtcttaaatatttcctctgtatacttttagaaccacaccagaaggtgatataatttttgtttcaatcatcagacataatttaggaaactcaagaacaaaaaaccttttatacctacttttatttttgcttatatatttttttcctctttgatgttctagggtttctttattcacttttttcctttctgcttagagactttcctttagccattcttttagggtaggtctgctggtgacaattctcatagtcttgatctaagacttaggtttaagacttaaaatagtcttaatctaagaatgtcttgatctccctttcattcctggagcttattttttctggacataagattctgggttgactttttttttcagctactgaaaaatattgtaccatttatttctgtccttcatgatttctgatgagaaatcccctgtcatctaaactgtttttctcctataggcaagatgtcatttttctctggctgcttctaagattttgctttacttttagtatttagaagttaatgatatgcctgggtgtcgatttctttgagtttatcttgtgtagataaactccttcttgaatctgtaggtttatgtttcctagcaaatttgtaagttttcagccattatttctttaagtacttttcagccccaccctcttcttctagcactttaatgagtgttagatcatttgttttaaggttctgtctactatttttttcatctactgctttcagttgttcaggttggattatttcgattattcttattccaactcactgatttctctgtcctcttctttttcctgttgagcccacccactgagctttttaattcagttattgtatttttctgttctaaaatttccacttttttaaacgtcttctttttatttgctgaggctttctgtttttccatttgtttcaagcatgttcatagttgctctttgaagcacttttgttatgtctgttttaaaatctttgtcagataatttaacatctctatcatcttggttttggcttttttaactcatttatcttcttttcattcagtgtgagattttcttggcataatgagtgattttcagttgaaacttgggcatttttgtactgttcttggaatctggatcttatttaaaccctttaattggctttctattacacttctctaataagggaagtgatatggtttgctgtgtccccactcaaatctcactttgaattgtaataatccccacatgtcaaggtcagggccaggtggagataattgaatcatggggttggtttcccccatactgttcttgtggtagtgaataagtctcatgagatctgatggtttttataaatgggagttgctctgcacaaactgtcttgcctgctgccatgtaagacatgactttgctcctcatttgccttctgccatgattgtgaggcctccccagccacgtggaactgtgagtcagttaaacctctttcctttatgaattatccagtcttgggtatgcctttatcagcaatgtgagaacagactaatacaggaagcagggctggtgatgctaccttactgcttccagatagagttgaaagtccagtttcccttctgttagcacttgaatggggagtatcttttcattactgttgcatgggggtaagctcattactactgagcaacagtgaaagtgctgactttcctctaggcctcctctgatggtgggaaggacaaggggtgccttgttactcccagtgcatgggagtcaaagatcccaatgttgtcactactgatatagagtaggagggcattactgaccagcagggatgaaaatcccattttcctgcttggttggcatcatcatcctctagtgcaggtgttgggcatcttattatagcctcctaaaggcagaagtataggctttccactcatcttttgctgggggtggggaggggtcacagtcttattctcttttctttgattccactagagaagctattgtctaaaaagctattgtctaagttttctgtcttgctaggctgcctgtttctttgtcctctggctaaagagaaaggcctttgttgggctttaaaaatcttcatccacttgggtttctctattgtctgcttcttcagttccaagtctggggcatataagtcaaaaagaaaactcagggaatttatgtcattctttgggtcctaaggtcctgtattagttcatcctcatgctgctaataaagacatatcagagactgggtaatttataaaggaaagaggtttaattgactcacagttctgcaggattagggcttgcaccctctgaagcaacatccttagctgtactttggctccttttagccatggctggagtgactggcgcactgggcactaagttccaaggctgcacacagcagggccctggacccagtccaggaaaccatttttccctcaggaaacttacaattgtggcagaaggggaagcaaacatgtccttcttcacatggtgacagcagggataagtgctaagcaaaaggaggaaaacccctcagaaaaccatcagatctcatgagaacccactcactatcacaagaacagcagcatgggagtaaccacccccatgattcaattacctctctcccatggcacgtggggattatgggaactacaattcaatatgagatttgggtggggacacagccaaaccatatcaggtccctggcttttccatcttttctccatcttccagaatctcttatgtaagttttatgtataatgcccagggtttttttgttgtacttaatgagaggaatagggaaaagtacaaatactctatcttcctagaagtggaagattccttgtagattttttttgtagttccatcaattactgaggaaaaggtgttaaaatatacactgctttaggatttacttatggatcgtatgtgtaagatacctagcactgtgcatggcacaggttaagttcttattattcattcacccaacagatatttcttgagcaaccattacatgtcaggcaatgttcatcagatattcaacagtgagcataacaaagtccctgcccttatggaacttatattttagcagaaggagacagatattaaacaaataaattactagttaagtggtgccatggacagatatgaaacaaatcaaggagataagaagcataactggcagggtagggagaaatggttgtttttttatactgggtggccagggaaggtctctctaataaggtgtaatttgaccagaatcctaaagacattaaggagcaagccacatggatatctgggtgaagagcctctgctttggtgaaatgacagattactgaccttatttgtaagggaagaatgtcatcagaaccttttgcttgtcagggtatggtggaactcagaacagtgtattgtttccagaaggaagaattagatgatcatgccctaggtctggctttcgcatctattagtcatacaacttttgacaaagcacaatcttctttgtacctcattttccaaaggattctgttatctcacatggttgtgagaattcagtgactgacaaattgcacatgaaaaagcattttacaaatgaagcaaagggttctatagatataagatattatgattgcatcattattactgccagtgctatctaacttggaatcaaaaacatttagattagattttagagattatttttagctcaacctcctaatttcatggctaaagaaacaagcccagaggagctgcagcctaatttatagatgtaaatgtggggctatagaatacagcatctgatttctttgtgaaaaaaaatggtaatataaagctgtggttttcagaatgtggtccctgcatcagcatgacgtagggaattgttagaaatacatacacattctttggctccagtctatacctactgagtcagaaattctggagatggggcccagcagtctgtgttttaacaagccctccagatgattctggtgcttgctaaatttaagaaccattgattaatagggaggttcacaaaccccttcactcataaagaatgacactggagaatttaatgcccagggtgagccttcagcaaaattgtgattaaatggcctttgtaggggcatttaaaaatcttccctcttttcctgcttcagggttaccttttcttcaggcacatctcaaggaacctctttccttagatgctttcttagttgtttggccaataactctagtcagggtgttagttgaaattactacatcttcagattaataagagagtaaataaaatgaccatcctttagggtcccaagaattcagattctaatagatttggatataagacacatagaagaggtaatgctctggagtagaaggatcctgagatttctcctattcttaacacctgtttggttatttgaacacttatgaatggagtggaaagaagatttatgatatttccagtatcagtcacagaatttgcttctagtaaccatggtttttaagttctcagaacatagagaaaaaaagggattggccttattacagattcttttttttttttttttttttttttttttgagacgatgtcttactctgttgcccaggctggagtgcagtggcgcgatctcggctcacagcaagctccacctcccgggttcacgccattctcctgccttagcctccgggagtagctgggactacaggcgcctgccaccacgcccggctaatttttttgtatttttagtagagacagggtttcaccgtgttcgccaggatggtctggatctcctgacctcgtgatccacccgcctcggcctccaaaagtgctgggattacaggcgtgagccaccacgcccggccaagatttttaggttttattagcgtcatgatgcttgacttaccaaaaacactagggtgtggtcatctttgcctagttctctgtgtgtacactttaaatagttttatctgtaagttagagaagaagtcccttgcttttttttaacatttcaaagtctttttccagtctcgttttctttctgtcacactaagtgttagtgttacaatcaggtaggaattgaacttaaactacctctatttgtcctaattcagacttgtgtgttcttggagacagcctctgccttctccttgcatgcatcctgtttaggttctcagatccagcagcactagattagaaacagtcaccaaatctcactaatacctcgtatcaattaaaggaaagttgaagagtgctataagctgtcctagattattatgtgtggctttattttagtagataaggaaatacgtctataaatcagctagtctgtgaggaagatgaggaagaatattgaccagaataactgtgactctatatgcttgctcctttaatcaggaaacccgtaataattgacccatatgtaatagaatacactcttgactctctacataagcaattatttaagttaggagtcagaataataaagcaattgcccagtgcttttgaggtcagtagattaactctacagagcttaattaaaaagcgataataaatgcttgctctagggaggatatttcattagtcttcatcatggcctgggtgaagtattcctgataattattttctagccctttaaaattctcctcttacgaagcaaacttctcactactagttaggattcccacattggggaaggagatttcccaaagcagctcctccattagaaaagactaagtttgaaaagacagcaccactataaagaataaattggtattctcttatttttggaagaagcaaaattttaaactaagaaaatatcaaagaaaagaacactatggcaatggctatgataaaattttggaaatactgtttttgaaattaagaattagatttcctttatggttcctccttaaaatatgcaagatactgagaaaagtcaggctccttttctggagcaaaaatggacagaactttttggataaatctttctgttgaccttctaattctacataccgttagatttttggataaatctttctgttgaccttacagtaaacagaacttcatcttcatcatggcctaggtgaagtattcctcataagtaagcagaactgtatgtagaattagaaggtcaacagaaagatttatctaaaaagttctgtttttcttgtagaaggagaaagttcagaggaaaataacttcttccaaaaggaaatgaaatctgtaaccacaaagtaactgggatgtttgaatgctgtgaaactgtttaacttcttccattctttcaagcccttttctttatactgtgttagaactgtgctttccttctgcattcttgtttatttccatcaccatcatctctaattttgaccattttaatagcctcctaaacagtctttgaaggctttgatctttcccaccttactcattcctccatactgctgccataattgtgtcaattctcctcttcaagaaattggaccaatttgatgtgtgtccttgttccttagcactacatatgaggacatacccttcacaatcaggccttatcttccatatctggcctcatctgctcccctttgctcatgaagcctgtgctaaaactatgctgaaatctcatgcttgttttcttttcttagaatgatcataattttttttctctttcacctgataactgtctggtcctcttttaggaatcagctcatagtctcctttgagaagcctttctggatttccaaagttagcagctcactctatgttattgccacatttgtttttcacactcatgtcagagtatgtatgttgcacatacatacagcgtatatctttttgaactgccgtcttccacactggattgaacttctcaaagacagggataactgtcacatctttcgtgtccatttctgtaccagacatatagttgatactcagtaaaattggttgaatggaattgagagtgcgtttgtcaccttcatgtcttctcagagcaccttatttcatttaccttccattaaagttgggttcactgcctacattcatttttgttattatctctgattgcacatattaggaactccacaaatgttgaataaaggaattagttctaatagcactaaagagcttataattaagagacaaatgtatttttagatgcaaaattatctaaagattttatttccttgatatacaggacagtgacaaagaacttcacatttcgtgcatttctttggtcacattttctttcattagaatgaattactcttcacttatgacttttgtgtgaacctcccgactcttcactctcagcttgttgacttgggactcagcaatgtcagcccgttccttggcctcctccagctcgtgctggagcttgcggaacttggcaaggttgacattggattgttcctcctgagaacagagatgcatttgagataacaagaaaattggacatttcctgattgttattgcttttgttacttcaggatttgcctcatgaatgagaaagaaaaaggctccgttgtccaggcatggtggctcacacctgtaatcccagcactctgggagactgaggcgggtggatcacctgaggtcaggaattcgagaccagcctggccaacatggtgaaacccccatctttactaaaattagcccagcgtagtggtggatgcctgtaattccagctactcaggaggctgaggcaggagaatctcttggacccaggaggcagagattgcagtgagctgagattgtgccattgcactccagcctgggcaacaagagcaaaactctgcctcgaaaaaaaaaaaaagaagagaaaaaggctttattatttagtaacatagttatttgagagcaaggcatcccacaaactcgcctatgtaaatgaatgtgcttatgaccctcctcaagtctctctctcacttgactctctttctggcaaactgaagaggctgcagtgataactggaagaacaaagtagcagggatctgaattcaatcttgtttctaaaaaagaaactttaaaaaataggtgcagtagtggcatttggtgccaagaaccctaaggaaggtttcagaattaacagaatgaaaaagataactgcagccaaattgaaaaaaaaagtcccaagatggatttatcatgaagttaaatgaagcttagaattcatactctcatttgcacaggtccatatgagtgctgggggttgtagaatgttctagatagggagggaagtggattgcaactaagaaacatttgtatgttaacatgtctggaaaattgcttaaagaggtctcagaagaaataaactcaaatctataaggctccagtaatttatggttcatttttctcattctaaatattcatgttcatacctaattatgtattcccaatttaaagaaaaccccctaaattctataaactttaggccccaaaaaacctggatgtgcatctgaacctttcatttccactgtggagatactcacagcctcttcagcttgtctcttgtaagctttgactttggtttgcaatttgtccaccaagtcctgcagcctgagaatattcttgcggtcctcctcagtctgaaagaggtgcaagtagatggtgccattattttaaaacaactcatgattttcttgaaaactataggcctggaagatatgaaaacactggtcacctggtaagtgagttccttcactcttctctcatgtttgcgaagacccttgacagcctcaacattgtgcttctgttcactttccacctcactttcaagctctctcacctggaagggaacaaagacgtttaccagtttggctgtaactggccacaaggaattgagtgaagttgtggagacctaccctggcctccagtttctggatctgcttcttcccacccttcagcgccagctgctcagcctcatccagacggagctgcagatccttcacggtctgctccatgttcttcttcatccgctccaggtgggcgctggtgtcctgttccttcttcagctcctcagccatcatggcagcctagttagcaaataaattttgaaaataatgaattctgatgatagcaggcagcatgcatgtgtcagtaagacaaatgctcatcttgcttacatcagtgatggccttcttggccttctcctctgcattgcgggcttcctggacgatgtcctccatctctccctggatttgggaaatgtctgtttccagcttcttcttggtgttgatcaggctggtgttctgtttcaaattaatgaaagagaagagaagcacatttacttataacaactcacattgtcattttacctagtgtacacaggcaaaaattattgatcataagaaatgtttagaataaaaaccaaattagaagataattctaagtttatgccttttctcctttctatatatagctctttaatcaaacttctaaatttaatttttgatgtcaaacatattcaactattaccattgccatttgtaagcatgaaacacagcccacaaaactcaaagtgctgtaccatggagcaccacaccacagctcatttaaaatgaatcagtaatttttagctattaactcatgttggttgactccatatttataaatgcataaatagttgtcttgttggctgggcgcagtggctcatgcctgtaatcccagcactttgggaggccgaggtgggcagatcacggggtcaggagatcgagaccatcctggctaacacggtgaaaccccgtctctactaaaaatacaaaaaattagtcgagtgtggtggtgggcgcctgtagtcccagctactcgggaggctgaggcaggagaatggcgtgaacatgggagtcggagcttgctgtgagccgagatcgcaccactgcactccagcctgggtgacagagtgagaccccttctcaaaaaaaaaaaaaaaaaaaaaaaaatagtagtcttgttgggataaaaatgagccaagaatcccttctgtttttggcaagttgatggtgtttggaatagtcaacttcagatactgttaataagaaaaatgttgcatattaatttgattttaaaattatataaagcatgcaattttaacacttctataatagttatgtttatatagtgcaactttctgaagtatacagtactatatatttattgtaaaagatagtagaacatacaaattagcagacaagaaacaaaaaataattactgtgctctcaccagagataaaggataaacttttatttatctttctggatgtttcctatatgtttatacgggaaaaaagatcacacagcctatattatttttaagttgcttttttaacttactataatataaacatcttcccatggcaataaattcatactacagtggttacatattagccattgtgaggatataccaccatttatttaacaaattcactatatacaacaaatgctaactagtattaataatggcctccatgaatttgaactaaagagcttctctttgtatcccatgaggttagcattctgtgcatatgtgatacgtaaatattatttagtggctttttgtttttctcctctattttatttgcctatctttttgtagcttagagttgcataagacaagacagctacaaatgttgtgtgtatgtttatttgtagatggtcttctgtgctttttaaataaaagtttctagaattccagattatttcaactcaacatgattatgccagcccataaatatactcgtgaaccagctaggtcccagtaaatccttacagcaccctgtacattttccagagctccaggaagggacgaagattactttttactttataaacaagcttatcttctcaaattatcttcagcttcagggagtacattttctaaaccatagtcttgaacctcacctgagtgtgcagaagttgcacacgttcactggcatccagaagctcttgctctgccattttcctgcctctctcagtccgttccagggatgccctgagctcttcaacttcagcctgcatcaggttagctctgcgctcaaccattgccagttgttccttaaggtcatcttggcctctgatggcatcatccaaatgtagctgagtgtcctacacagaaagagaaaaagcctcttactcatgctgcacttaaagcaaatgcaaacttatggtcatgtacactctttgatcttaatgacttagagtatgattagataggagcaatcggcaagtacctttaataataaattctttgtagctgagggttgcagttctactcaaaagaacatgatgttttattattttagaccctgaatcattaaaaaataccatggctagctctacaaaattttggatcaggaaagtatccttagacttcagcgagtccagtggtgctattttacatattaagcaaatgaagtccagattaatgaagtgatttaagcagtggcatgtagccaaactctttcatcacttcctctatctccctacccctcaccacagtgcttctctgcagataacaaagcaaactctgtcctgggccttccagaattaagctctttttcagttgtgtgtgtataactttgaactttgaactgattaccatgttgcttaggtgatttatgacacatagtcctcgtaaaacattaaaatttgagttacacagtagcactgagactgtacaacactatgtgtatttaccccagcataccttcagtattccttgtgtgtttctaagattccttagtgcctcagcagcctggcggttggcatggttcagctggatttccatttcattaagatctccctccatcttcttcttgatcctcagagcatcatttctgctcctgatctcagcatccagtgtactctgcattgactccacaactctgagatggttcctctttagctgatcgagttcttcatctttttcagcaatttttcggtcaatctcagatttcacctgatttagctcaagttgaatgcgaagaattttgccttcttcatgctcaagagatgccttaataaaagcaacatttatttaggttacctaaagagctttttatttctttcacattatgataatttccccaagaaggcattaaaaaacccataaactatcatacgtcttaatgtagcctattagctctgcattctcaaggtacaattcagtatttttcactgaattacttgtgttattccctaaagatttgcaacatgatagagatctcagttgctattaattttcaatttatttataatgcagagctaagcaaatgaaaaatgtacctctgcttcctctagggaagtctgtagttcactcttctcatgatcaagttgtttctttactttctccagttcatggatatgctttccaccctctgcaatttgctctgtcaggtcagaaatctcctctgtaataataaagtaccaaatttcagttaagtagaaagaaaaattgaaaagatgtctccctaccatttttgaaatagaatgattacagtgactcacgttgtaagttcttattctctcgctttagagtttcaagatgatccagggattcctcgtaggcattcttcaccttgaacagctcagtgctgagagaacgcgactccttctgggaggcctcaagttcagcctgagtttcctcatacttctgtttccattctgccagaacctggaagtatatagaaaataagcctttgaaaccaagaatgatgtcagtttcccccaaggggagctggtactgtggaccaccttgtcaaagtttctttgcttcttatcgagagctatgcaggcagcattagatcgttccacatcaatcatgaggtcctctacttcattctgtagcctctgctttgtcttttcaagagaagcacatttggaattcacagcttctacatgttcttctgcatcctgcagacgctgggctagcttcttcctgaaaattgggtcagtatgagtgaccaagagcagactcagagtcaccacagtgccctttataaagctgctgactaggaaagcatatttccccaagagttgtctacaagttgttgaatttttctaaacattttcactctcttagaattctgttttccctgttgagttcttatttttatccatctcaggtattgccaaacatatttacgaagcacctgtgtgtgtgtatgtgtgtgtatgagagaaagagaatataagttagcactagagctgagtgagcaatgtgaaaatttgctcctctttctttgtttttatttcactaagctggccctctatagtgtggcacattttcttgaactttgcctggggtgagaagtagaaaacaggaagagacagtacatttctcttttgaaacctgggatttagagatctgtaactacttgtggaaaagggctgagttttatttactttgaggaagaaatggcaaccatgaacaggaagcatatcaccaaggaatggtagcattgagtagtatctttaagcattttctagtatggttctgtttattttgcaaatgaggaaactgcggcccagagtgatatgttcaaggtcatacaatgaatcagtaactttctggatttggtggcctttgataataaatattactgcattattgcatttcccaaatttcctctaaaatcttgtctactactcttcaccaacctatgtaattcatgacctttcccagcccacactcttatctagaactctctctggaaatgcttgctacaaactctttcatcctgtttaattctaacaactactgagataaattaaatttagaaaggcttctttcactaggagtataatgctttttttccttctatgtgtaaatctgtaaatctcatgacttgtagtccgcaaacagtacgtgtaattagtgaatacatccattgatataggttgttagttgaaataatgacagcatatgacaaccttaatataaacattcaatactccatctgaggaaaaactgattattgttaattgtaatactcataataatttaccagagagtctcaatgtctcaatttttccttctattaaaagatactaattctatttaattcataaataatattctgataattaataatccatcttggtggaaagaaatttaagatgcttctggacaagaatgggtggagggatctggtctcattccattctccagtggacatacactgggctttaagaagaagaatatggtggaatccaccaacctataataaaataagctgaagtctttcatgtgtccccaagcccggaatattctctttcttctatttttccttcactgcctttacttttatttcttcctgctcccctgcactaaaagcacatacttggcctcctccagctcctctgtgcgctggatggcgtccgtctcgtacttggtcctccactgggcaacctcactgttggccttggacattcccctctgcagctcagccttggcttcctgctcctcctcatactgttcccgcagcaggtcacagtcatggcgggctgactgcagggcatgggccagagtgctcttggcctagaccaaccaaaaactatgtgatataagtttatcttctgatcattgaaattctctatgcaaagttcaatagtgtgttatgttgcacggttcaagtgattgaaagtatcagctggagaattctcaccttagtctcctcttctagctgcctctttaattcttcaatctgttgtgtaaatgcttgtttgcctcgggatagctgagaaaccatagcatctttttcatctagctgtcgtgaaaactcacctgtggaagacaaaacatcaatgatttagttctgttgtctaggtaaacaataatttaaagaatggaataacattgtaaccctcttatttcatatgatgaaaaaacccctcaagattttcagtgatgttgagaaggttatttcttgctttttaaaaaatgtatgagttttctttgatattttagaattcgagaacttttgagtaatgctgagtcacaaaaaatctcctgagcccagggagcttaattcttttccccaattgtcgcttagaatcattgcattttactgtctcataataaaaagatggaggaataagtaagacatgataaatgaatgtacagagcttgagaaattacttgtatttgataggtaggtaaaggcttgtctttcattcgtcacctctccgaaggttgatgctatttatttactgacctgattctgtgtgtaaacgtgccttctgggctgacaactcatttattaagcgttgttgctcttcttcctttgtttttatttcactaagctggtcctctagggtgcggcacattttctcaaagtttgcctggggtgagaggtagaaaacaggaagagacaatacatttttattctagaggctgggatttagagatctgtaactacctgtggaaaggggctgatttttatttacttttctatcaatcttgcatggtggctataaagtagtagaggcatttaatttggctaaataatgaacacatgattatcaaaattatattctctttgaaagtgtgaacatcatttaaattctgcatcatttagagtatggtttttagataaaccttttttgtaattacattttttttcatggtaatagtatcaaaggttaaagtgttttctacaaagaagttaagagaacttaagtgattcaatacaataatgtgtactaggagtaagtttaagcttcagatgccatctaatgtttgtgtaatttggctaaaaatagtcatatataaacttggtcattttgaattgttgcaaataaagatgaaaagggcacaagttaatgaagaccttggctttggagacagtctccatgttactagcaaggtcattgatctccatcttcagctcactcttttccttctccagcttctgcttgacccgctgaaggctgtcaatctgctccccaagctcagccacactatctgcgtgcttcttccgaagagcagctgccgtggcttcgtgctgcagggtggactcttccaggtccctgcgcattttctggaactcagcctcccgcttcttgttcatctcaatctgggctgaagtggccccaccggcttcttccagcctctcactgatctcctccagctcccgggagaggtcagagcgctgcttctctgctttggcccgggaggcccgctctgcctcgatttcctcctccagctcctcaatgcgggcctggttgtgatatgtcaacattaatgtgaatttatgtcagttttgtttcctgtaatgcccagaaaaggtggaggttataacttacctgtaattctttgatcttcttttgtagctgtattgcaagggcttgttcatcttcaatcttgccttgcagattgctcatttcaaactctttcctattagaagagcaacacattagcttataatcacttctcttaccaatcttcttttctatgtataatctaagactttttttatactgctggtgttgaaggagtgagtagtacaatgttttacagattaataattgtattagtttaattaaataaaaaggtcaaagatgtcattatttttttccatatgtcatgatgtaacattttggagatctttttagcgtatgtttcatttgcattgacatacaacaagcaggttatagctgaattataccatacttactttttgagtttctcattaagttgctgtttgtcattttctgtatccattgtggattcttgggccaattttaggtcaccctccagttttctcttggctctttctaagtccatgcaaagtttcttttcttgttccagagatccttcaagctaaatttatgatgcattttatttatttcagctcttaagcactgaaccctatgctagtagccttcaaagatacataagaaaaaaatttaaagatacaacaaatagcacaagaactttattcacagaccaagcgttaaaggcttatgactatcagtgctggtttcatgtcacaattgtttatttcattgcaaggggaaacattttctttttcacacttacatcgtccacttgctgttctagcttggttttagctttggtcagggtgttgactttgtcctcctccatctgcaggtcatccagggtctgctggtgggcctcctggagagccttcttctccttggtcagcttagcaatggtttcatccagacctgccatctcttctgtgaggtttttcacctttagattagaacagatgaccagaatgtcaatgacaacgtattatcttgatgaaaaacatgatgctgtagtatcttaggataatgtcagcgtaagatggaaaatgagaaccaggagctaacccaggcctataatggctgaaaaaataggaggtaaaggtcaagtaagtacattgaggtggtgaagactaaagagatgaaatagttatgacagtggtattttttatattcaatcatcttaagattaaatttttaattaaaatacttcagtatcaaggtgcttataaatattctaaaatggatcatgatttgtaccttgttctctgtggcatgtttctccttctcaaccttggccagtgtcagctcaaggtcatcaatgtctttcttgagctctgaacattcatcctccagtttcctcttcttggctgtcagctcagcattgatctcttcctcatcctcagctctttcagttacctctttgattttggcctcaagttggattttggttttaatcaactgatcacatctttcctctgcatcagccaaggcatctgcttcctaaagggagaaattaagcattttcatttgtctgagctatatctataagcacacaataatttattataaggtggaaatttcagtgactacctgtttggtcaacatgtataccagttgctaacttttaaaatgaaacagacaaaatgttaatactgttatctactgatcaagtataataacaaatttccttcagatattcatgtgtggcaggccaaatcaggaaaactagccctttggcaaaaatctgccactttactaacctttgcaactttggaaaaatcgcttgttcattgtaggactcagttttctcacatttaagaggggattaacttagccatttctctgccctgataaaaacaacataacttctattttatgcacaaaaatacactaaagaaagaataatctgatctgagagaaagttccataaataaaggaaaatgtctattgatatttttatgaatttgctcactgatgaccaaactgtgtgtgaatgcacatatgaacgtgtgcagcatgatatgtgactttgcatctattgcttctttatgcccgagtcttggtgtttttgaacagcaaacaatcagaacaaatgtttcagtggaaaccattcattttaaaacgttaaaagtaataagatgtggctgaactgcaatgtataatacttacagcttgaacttggagttgtaagtcatttttctcttgcattagcgtcaccatcttttcttctagttctttcctttttgcctctgtcttagccagctcttctttggttttctcaaattcttccttcatgttggccatctccttctctgtctctgcactcttgaggaggggcttgatcttgaaatacagcttcatccagggccagtgcttcacattcatgaaagcacggatgttgtactgaatgcagaagatggactctctgtaggaaaagaaaaaaagatgcaaatggagaataatgtggaaagtgatcatcactcaacaaaagtaatgactgcagtggattcatttatgaaagtgtggagcaggaagacttgtgtgtgggctctcacctcctctccatcatctttctgaactccactctcatcaggaaccctctgcatatggcttgagtgcgcgtgatgagttgagctagcttttcatctcgcatttcctctagagttcccagcaggccagctttgaagaaaaccttatgaaagaacaagttaaatatgttatttccacttacaggaaagtctaaaagtgatagaattatgacagatagaaatttggactggtgataccttggtatgaccgaatttgtactgggtgtggtcaatttcaatagaccctagaagtttctcagaagccttcttgctgtcaatgaactgaccctctgggatagcactcgcatttagaaccttgtatctgtcagaataaaaagaatataaaaatgtggtttttcttcactgaaaaaaacagtagaacatttggtagctatcattgaaaagatgatagattaagttttggtgaacaaaatgccatttaaaaagtcagtgctttatttaaaacttcggaagatatgatgaaaaacttatgataatataaacctaagcttctttcttttatgatcaattttcaaataattgcatgtcatttttcaaggaaaagtttaaaaatgttggaattatatagtgattttgtgtagactaagacattggaagggaaaaataatgagacacaaacctctgtttgaagtctgcataaaggattctgcttgggaagcctttcctgcagatgcggatgccttccagcacaccgttacacctcagctgatgcaggacaagctcatgctccatggcacctaagagaatgaatccacatgccatacttcgtggtctatcgcacacacactggagcttgtctggatatcagaaatgtcttaccaggagttttagtttcattggggatgatgcaccgcacaaagtgggggtgagtgctcctcaagttggtcatcagcttattcaaattctcctgtggaaccatatgaaaagttttaaaatcatttctagttgcatcgacatgagagtccctatcaatatttgtctttcatttcacattttaatgagctgtctcaaggaaaaacaaattatcataacagagaggaatcatataagtggagcacaggtaggaaattacagattacacaaaatcagttaatttcagtttgttattctcaagcaccaccagtcagagaaactttgtattgcgatttttgtcacatgaaggagatgtaattgaatacagtggttatttttaaaagagcatttgatttcatgtgaaatttgtacaataccagatctcttggatgtagggctcaggggcaatggttcacgtatcataaagattgatgtgaagagatatgtagtttgtttttttgtgctaattttttttcctaagccatttaaaaagtttacaaaacctttagtagtatactaaaaagtatactgtactactttattcactttcaccataaatatcttttaaaaaattttctgttttgatggtttagttttttaatgaaagtatttatctgtaattcaagaatatactgtaccctgaaaagagctgacactgtctggaaagaagaacccttctttttgccacctttctttccaccaccaccctctaaaaaacaaaatgggaaaaataaagttatttgcaactgccttttaagtactatccataaacatcaggactgccaaaattccctttagaatttaaatttgcactcattcacttgcatcattcctattctttccatatctctcctccctcaattgtagattaagaaagtctaagatttggctgactttatagtcattcatgaaaaaaccaacaacaaaagaattgtgagtgtaaggggtagatgtgggtaggggatgggactcccctactccaagtcagcaatgtctgttctctgaaggaagggccaaggagacagagtagtaatgccttgttagtgcaggcctcacttggacaacaggcagagttgcacacttggtcccaggtaggtgagcctctgctcacctgcagggaaatcctggctcccatttgcctgtgcttccatggtgttacttgcacatctggtcttagaacacttaagagaacagaacttcagttccccaagcactagggccctgacaaaggatttccttatctccagcctagctggagaaccttgaaagaaccaatactattaaaatgatagaaatgagttttatgatcctgagcaaatcacttaacctctctgagattcttgttttctcatgagtgaaatcaggctgtgggctaaatgctccatagtgtcacttagctctgaaagtctgtgactgtaagactgtatcacagttattaaatacactttctttcattaggcatgtattggccagtgtttttgtgtcaggttttgctgtaactacatttgtctctgttgaacagtgtatatctattttgtgactcttgtaacatattagtgctattaaacatgacctgcttcagcagtttgtgccccagagaagaggaaagccagagtcttcattgcagacttctggtacagccccaccacagtctcattcagggggtccttgtttttgtccagccagccggcgatgttgtagtccacggtgccggcatagtgcaccagtgagaagtgagcctcaggcttgcctttggcaggcttgggcttctggaagttgttggattttccaagatgttgttcatacagcttgttcttgaaggaggtgtctgttgccttggggaacatgcactcctcttctaggatggagaagatgcccataggctaagaataggaaaaaagggatgataatgatgagtccctcagaaagttatgctccatgtaattgatggaaaactgaaaatacaatgtttcaaaagaagactttgaatgataaattaaataggcatgacatgtgaagcagtcattatgtacccagaacatatgggaaatatacttgctagaaagactcagttaaaaaaaatacatctgaactatttggcacactttatgttcagtgtataaaatcagattctgaaaacatcacttcaaaattgaattctttattccataaatgtatatatctgactactttctttcctactgacaatataacttcctttacctcgaatctagaggtgacagaagtatgaagggaagagagattatgtgtaaggactaaaaatgatccattcctaggaggaaattgcatcttatattgtatcattaaaattctgtactttaacctatattctctaccactgtggagttaagtgatagtaatttggttttgctttctaagagtttggcttttttcttaatgtatttgataggaaagactgaaagaaaattcaacattgatgatttaacaaattcacaaattgtacccctaagactattttggtgatacagaaactgaaatactagagaataaaataaatgccttttctgaagaccataaagttttcatgaatagtagagatattatatcaccagattaacgtatcttttccccaaattgtgcagacctagtctgcttttaaactcttatctttcatatttttgtgaattttaacctgagtattttaagttttcctaggtggcaattgcatttacgcttcctttcccactgcttagggtagggttcacacatacactttattgatatcaataagtatatgacaagctcccaagatacttttggaagtgtttaacgattgcttgatgagtgttaacatatctagatctgatgtaactattgcttcacccccttagtaatggggaattcagggcccattttctaggtaagtgatacagaggtttggtgtttattcagtagttatcatgaacggggaaagacttaatgactgcaacagttgaaggactaaccttccaatctttaagacgtgttgacatagcctgccttgttacacatgagggatgatgataaatgcacaatacactgtcatgggtacaccagggttaattacacaacccagaggaatagctgtaatttcatccctttctcccatatgcatgaaatagtgtaggaagaaaagtgagggagaattaagtttttagagggataaatgcgaatccatatgtgtgtgagtgataaacatttttctacaaactgctctacttattaataacagatcacttggaacatacctcacaaccaatcagaatatacgagtgtgtcaggaaacagcactgcttgttctttgagaacagggagtgtgattaagcacagggaggcaagcaatttggttttcatgttttgaaagctagaaaagtcatatgaaccttctcgatgagctcgatgcaggcagccaggtccatcccgaagtcaatgaactcccactcgatgccttccttcttgtactcttcctgctccagcacgaacatgtggtggttgaaaaactgttgcagtttctcgttggtgaagttgatgcacagctgctccaggctgttgaactacagaacaagataaatataggaaattacgcataacaagtattctatctacagagtatctattagtattttcttctgaatttaaggcattttggtttattaaattataaaccttcagattgttttcctattatatagttctaaacaaagtagaattgattctttgaatacttattttccaagtaactgcatgagatcatgcatactaggcaaaatactgttaaatgaggactctgaaatatttccttagagtaattttaaaaaggtgttctcatgctcatctgcttggatccaggatagattttgactattttaacctctcagggatcaacttttgagacttctagactcaaaagaatagaattttctcttttcctatttatacctatttacttttcatatcttttcaaagactcctttcagtaggaattacatttgtatattttgtaaggtacattttgtaaatgtgattttgtatgctctaacaagaggatttgcactggctaattttctgtcagttcactactcacatcaaagatctcaaagccagcaatgtccaagaccccgatgaagtactgcctgggctgcttggtgtccagctgctggttgatgcgggtgaccatccacaggaacatcttctcgtagatggctttggccagagcacccactgcattgtacaccttcaacagaagtgatagtttagttttttaaattgaaaacagtgatgaactcctgagtcacttgcggttcaaataaatcagacaatttaagtcatgtttacctgctgcacagtctggcctttggttacgaactcattgccgaccttgactctgggatagcagagagatttgagcaggtcagcagagttcagacttgtcagataagcagctttgtcagcaactgtgtgaacaaggtgagaatggtgaaactgaccatggcttacacaatttaaaatgtaaatgatgatgacaaagaaaaaaggtttcactcaaaaagtaagatgtgcaaatgtcattgaaaccttttcatttgttcatattgcctcaaaagcattgccaccacttgcactaattttagtcatttcttgtgatgataaattggaggttggggaatcgatgctgtctgtgatatttaacctggcaaaagtagaccacagataaaaataatttgagaaaccctaacctagaggagtagtgacagaaatattcagatctctgtttctttcagtgcctgtgggcacacagattatcctgaaataaaatatgttttagtcaaatagcaaatatgagcttatgaaaagccaatgaataatggaatgagcagaaatcacaaatctgctaaataatgtaaaacgtcaggcagtgtgtaatttccttctcgtaatacttttgcccttcacgagctaggtcagagaaagtaaaaacacggtccctgcctctgaaaagttcactatgtcagctttgtcaagtggaagataccaacagggggtggtaccttccgtgccatctggctctgcctgctcttccctttgcttttgcttgaatttcatgttcccataatgcatcacggctccagtgagcttgtaaatggccaccttttcatcagcagtgaaacccaggatgtccacagcactctgtcaaaagagttgaatttgctcatccccaattagcaccatggaagaatccctcagaacaccggggctgtctcccacttttttctcatcacgccttgccttatatttgactagcactttgccatcttcaaaaggtactcatatgctttaccttttgatccacatggcaacacgaagaggtatgcatcagtctttccatttgagtcatgagtccatttggtcacagcatatgatgtgacttgtccacactcactgaaccaggactaagagccatgacttttgatgccaaggccagtgctttgccccttttctccaccccagcccccctttgcttctcaggcacatgctcctcttggtcttttggctatttttgtttcttttctccagtctcacgagtctctctgttgctccttcttctcctatttgtcctatcctaatgcataatcccagtctaccttcccctgctaatgggcatgagtgataaagttggaaagagggtatgaggagaacagcaatggttgtgagtctttctccacatgcctctctgatagcaagccacagctcagcgaccacgagatgcctggggtagcaaactttacctagttatttatttctcatgcagagaagagacatttatgaaaagaaggaattttgccatttagtataatatttctgtgtcttttttctctatcgaattttgattacctttttagttgcccacataggctttgaaaaggcttataaatgggggcaggattcagagcaggcagaggaaaatatgtttatttaccattcttacctaagactctttccccagattattgacttccacttccagctcactaactctacctatttacagaaactagacattattacggaagtcttagagcaagactgctacatttttttaacctcgcagaccagggtgtgtttcttaactccctatcacttttggacatacaaagataataataagttatagagagttaaagctgatatttataatataaagccacacaaatgaattattgacttcttgaaaataatattttaatagaaaaagcagttttgcaagcactgtcaactctaacttgggggtattgggatagtcccactgatattaaagttaaaaataaggaagattattcagaaatcaaaagaaagcatgaaatatacataaagtttacatataaagaaagtaagccaaaaagcaataatccttaaaaaagaggtgatggtggggagagagtgcgttgtttcaaaaataaatataaaggcttatggagtccccaaaatgagtgtttttgaagtagacaacccacttcttctaatgctgcttagggagtagagagggatatatcattggcccacagaggtttattcaaaataaggcttatgtttacatgtgactgtagaagaacagtgggagttccatgtttagttgtaataatattgcagctccttcccagaatcttgggtgtgaggtgtggcataaaatagcagagaaacattaatattggagcataaatatcaaccaaaaatgactaataagaaagatagaatgaaaggagcctactagctaaggaatactaaagacccaacatttattacaggcagtgaaagctttttaacacatgtagggggagggtattgaaatatcctacaatttttttccaaaagtaagaaagcccaaagggttgtattacctatttatagtctttctgccactgctttccaccctaatagaggagagtgttgtacactggaaaatgaatttactttttactactttgtacctattacttacatctgtggccatcagctcttcctggtcatcaatgctgggcacagtaatttccccttggctgacaaatgcgaagtcatatgggttggtggtgatcagaagcatttctgaacacatggaaaagaacagtatatagacagcattgctttggtcatcaaaaacatttcagagaggcttcttagaagggctgttattctttggtagaaataaatcaaagatgtgtcttaccaatgagctctggtttcttattggacaggatttgataaaatatgtggtagcttctttcagcctttagctgaaaagtaactcgggacttctctagcagatctggaagtcagattaagctcatttaaaagaagatgccacagtgaaaaattaagtgtttgaaaatttcacacaacagaaataagtacaagattttctaatatgtacccacaaagaaaaagattctcaatcactaatatttattaacttacatgtttcaatatctgcagaagccagtttgcctgtggcaccaaaatggatcctgatgaatttacccttaaaaaagaaaaggagggattattatacacattaaaatcagaaactatttctttagctgtggaccaaacaggtggaaaaaatattgacaccacatgcacacaagaatcagtgctgatcctcaagaaaatgaagatcaagagacttacaaagcgagaggagttgtcattcctcacggtcttggcattgccgaaggcttccagtagggggttagcactgatgatttgatcttcaagggtccccttaagagaaatgaataagacagacaaagaaaaaagttgcagtaaataatttcccattgacctctttcccttccccattgcccctgcacagtattctgtaactttgggaaaggctttctaaaatgagttaaaaagaaggtaaatcgggaaggggagtgggacactccagtgatgtggtcttgatttctgcatcccccaggcccagaaaagcacctaaaaaatgattgtgagaatttttgcctattatacttgccaatacattgccctattcatctcattctcatgagctcttccaagagttattttccaaattctggcatcacttgcaattggctgctatgattttgaagcaccacagtcagttaaaaaaattaacctttattttggattcaggggatacatgtgcaagtttgtacatgggtatattgcatgatactgagatttagggtatggatgatcctgtcatccaggtaatgagcatagatagtacccaataggtagttttttggctcttgcctccctcctacccttccccatctagtagtctccagtgtctattcttcccatctttatgcccattcatgctcaatgtctagctctcacttataagagaacatgctgtatttggttttctgttcctgcattaattctcttaggacaatggcctcctcatgttgctgcaaaaaatatgattttgatcttttttaaggctgcatagtattccatggtgtatacgtactacattttctgtatacagtctactgttgatgtgcacgtggttagattttaaaatctgttattctgtccttagatgaatatcatgcccacctgcattttgccagaggcaggttcctcttttttcttctctccagtaactgcaattgttgcaaagtactggatgacacgcttcgtgttcacagtcttccctgcaccagattctccactatcaagttcaaacagaagaaaaggtcagaatctaaggtagtagtagccactacaatgatcaaaacagaaagaaagtaacgaaatctacatacgtaatcaagattgactggttttcacgatctgtaaaagagaagccaaagataatatttagaaaaacacacttaacacataggtcaacgcagtacttataaactcaaaattgtcttttaaaactccccatttgcaaaaataactatatgaatttgtgctttgcttctcataaggtttttctaaaaataagtatcaaagatgtgctaattaataatcccattacctttctaatgtatagactatgtaatgcatcattttaccattttgtccatgagaataatctatcaatatcagattaataacaattttgtgtcccatccagtcacctggttcatagtacaaaattatgtcaatgtccaatttaaagttttgtactgtgcttgtgataacttgtcactgtgagtcttcaaaacttactttttaggagagattatgtattatctataatccaaatgcagagttgatgcctaaatttaattaattttgaggtggaactagcattagttaatttggattttagcatagaaatctaagcaaaatttcctctatttttggaactagtgcttagcatagaaatctaagcaaaacttcttctatgtttggaactagtacattttattctaaatatatttccctaattttattatttctgttatcatgtttgtgctgaacagttattctcagaatactagccctatgttttttctgatatcagtatacaactattttacaaatggctatggaaattgtaattctcactcaccagttagcatgaactgataggcattgtcagagatggagaagatatggggtggggcctcctggcgctttttgcctcggtaggctgtcaccacctcagggttgtacaccggcagccacttgtaggggttgacggtgacacagaagaggcccgagtaggtctgtgggaaaggacggggttcctcgatcagcaatcaccttgtttatctatcttggaaatactgtttaagggcaagtagagcaggacctaagtactgtgttagttctcataaagtttcattcatttgttgcctccttccatcattgctgctgcacaaaatgcttcagtttttcttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggtgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccagtttttcaactaattcagttaagtaaatggttttccacatgtacattttaaaacatatcagagtttacaacattaaccaaacaattggtcataaaagaacagttcaatagccaaatgtattgaaaccccttaatttattttagctaacatgtgtagaatgtggagtgagtgagaaatagcgttgaaagggtgctcacgtagatcatccaggctgcgtaacgctctttgaggttatacagcacagcaggctcatgcaggtgagtcatcatggccatgtcctcgatcttgtcatatttgggagggttcatggagaagacttggtcttctttcacagttacagtctgttaagaaaagaaaaaacaagtgcatatcaaataagtagcagaaaaagccaggtcaaaaaaatatcacctaaattaacccaaaatgaggcagagtctaattagctccaggtgtttttactcacagctccagcttcggtcttggctgtcaccttccccccttccctgctctgcactattgctttcacgtaggactccttagggtccaccacaaagactgatgtcttggcatcaaaaggcttgttctgagcttcaattcgctccttttcagactttcggaggaaaggagcagcctccccaaaaatggccatctcagagtcagaactcatggctgcaggttattgatggcagtactggactaggtatacctagaggaagaaacagagccaaatgatgattcagggttggggtggagaattgttctgttgatttcatattaatgtgcttaattttccatgcttgtttcctcacccctgcctttagggaccactcctgtatactatgtcaaggagctgagagatcagctcattgatttgaaagcactatgttgatagcttaatttttgtgatactttaagcctaagttccatcctctatgttgtaaaccttagttgagaaatgtggaggaatcaacattcaatcagcaacatttgtgatgctccaagcatgttcagaattttttctttttcttgctacttttcttttctttcttatttccaacttccccctcttaacatcgtgatgatacaaagaaatggacaataactgtttccactggctttacaatataaatgaacctgtcttaaaaactcaaatacagatctttatgcaaattttcctctcatcccaaattattaaaattggatgtcagatttactaaaattgaatgtagacagatacacctgttctttccggacataagtccagatctaatcattacaaataaacacctagttaactgacaggtattaggtaagtaaaggaaaaaataactacaatgaaagctgaatatccaacatataattttgccctaagttaaaattaaaatctcctttattagttttgaaattgtttgaaagtcagaagtagtatctaaaccaaaaacaactttaaaagattcttggagaaaaggaacttcttaatttttaataaaattttatagtgattgtatgtgttgatctgtatttctctttgtttttagttggatttcaacctaacatattttaaaatctgattcttattttcttaggtttataatctcgttctttcttctcctctttttaaaaataccaaccagtcttctaaatatttttctgaaatggatagccagtataaagtttcaagccaaaatgaacttaaaaaattttccctactgacaaattaattatgagaaaataaaataagtcctgctgtcctgatggcaaggacagggtgagtggccagaataaaagaaggtgacctctgtggagcagaagtgtcttggttgccaatgacaatgacagcaatgatggcgacaacagcaatagccaccaccttctgtaggctttccagagtcttgatcttttgtcatcagcattaactttccctcaacttaaaatgttagctatggaatttccacatactctattttcaaaatcagtcttatctgtaaaagtgtcctgatgacactgtgaaacttagacatattttcaggggatatatattggaacatttaatgtcaggttttttttctttgaagaagaaatgttatttatattacattatattttgtttctgtgtttgtttttacaccaggcaacttgaattaacaacacactaccacgtggaggttactataatgcagtgtatccaggaaacacagaaagatgattgctacccttcccatctcctgtcttattatagattaattgtttcccaacttggggatcaagccccaatagagcctcaggttgttgcagggggttcttgaatccacccacacagtgatcattgcctcaagtttaaggaaggaacatttccacatgaacagtgttttctgttcttttctaaatgaatatagctgctatgttaaatataaactcatttaaaataattcttaagtgtagaataggttttcatgattatatatatccttaacatcatactaaaagtacatgtctccacatgaacaattagcaggattccattagttttgattctccattagcagggttccattaaatgttttgattctgtggaggagtccttgaaaaccactgacgtcaatcacagttggcaagagctggaaggaccttagcagtcaatagaatccagcctcctcgtttactgatgaggaaactaaggcctagaaaggttcagggtcattcagtgtcatagtggtgggtgataagtggcggtactgggacatgagtcctgttccgctaaatgcaggtttgttaattccacttgcaacacactgtatttcaagatacataaaggctaactggcttgacccaggcaaatagaatcagtgaaaagcctggattggcacctagaaatatcgacttccagataaacacaccttgattttatcatgcggtctctctgatatatctttatgggttaagttggagtagtagttcacattaaatattacatatgatggctgcattctttctgtagttctaacaacatgtgaaagagaagtttcattaagttttgtttgattaagtggcctgaaaagtcaaaattttatgagaaggcatttttaaagaacagctgccccgatatcctattcccaatactaaactaggaaataaaatggtagctcattaagatgtagcaatatagagattcctttgttctttagagtgtaataataaattattcttacctcttgtattatcagatgaagaaggtggcaggctcaaagcagacaactactgttgaaagaaaaaagagaatgtgggatgcttttttttccccatttaatcacaaaatactagtaactatattgtctacaatgtcgtccttaagaatgttggaaagaataattaaaatttgggaagcagtagacatcccttaaatgaaaaatcatcatcatcaggaatgtaaaagtaagtgttcttccacatatacataccttcaagaattttgaggaaggatgggaaagaggcatctcagctccacttttatagagaccattctgcaaacacagcagccacctcagctgtcctagctgggaacctacttggcaaaaccgtttttggcaatctctttgcacaatattcactgactgtggctgtgaatggatataattagaaatatttcttgacacccataaataatttaacagaggatgatctagggttctttataggcatttgataggggatggggattcagggcttctaacactgtttctccagtttggctgttgcatcattcatcacagaattcaaagccagattcccacttactcctctgcctataaaattggtccaacagaatgagtctgatgtgaggaatttaggattaattaatttgttggttcttagagccattaaggagtctggaatgaattttagacctgacactatgattggaagcagtgagcgatggattttaagacaacattcctagccacagtctggattttagaaagactggcgatagattcttttaaagtctgaaagtctaaatatgaaggtgaaagtgaattctcagattaggcagtggtgatggaccactgggggaggcataagggatttagaatagatataaacacttctgttctttttctggaggactttccatggatatctccagcttgtatgttttcactgaaggaacaacaggatgctgtgtgatgttccatgcatgtttcctctgcataatggaaggagacacaaacatgcattcctagttcatgggcagactctcatgactagctatagctctaatgaggtgggaaccacatatttttatttaaggtgggaggaaagtcatggtatccacgatattctccctgtggattgaaaagatggatgggccatcacatatgcccataatactcataaattggcttttgatggttttgctacatacacagctgttactgaatatggcaggaaatatacctactctaagtgtgaccctaactgagctctggtgagatattttcaactatcattagctggcttaaattaccaattaatgagatcactgtttttataattctgttgacttagaatttatctttgacacattgatagattgaatcttttatactttaaaaatttattttgataaaattctatgaaataggtcatcaggcgttaaaaacaaaatctccatgaaaataactcaccgaagtctagcgacttacccaaagtgctaggctctaggccagaaggaaacttgttctattttttctctcagattttcacaactcatttatttttacttcttttggaacttaacatctgacttgcagacataataagtatgtattatatttactgtatttgaagttgaaagatgaaagaagaaaatatgaatgagaccaagatacatagatgagttataggattacagatagtgaggactctttacataatagttaaaactctgatcaattacagatagactgatcactcagattttgaaagctctgaaacaagaccataatattctagtgggacccctattatgggccaccaggagtggatcagagaaccttgcagagcttggacaaggagagaagagaagcagcactgggtgagggagtacacatttcccttagacttgcctcttaaaggattgtctacatagaaaacacaggagattaatgcgaaggcttttgtatttgtatggttctttgtgattagatatgagtgggaagaatggctccaatctaaataaggagaattattttggaaactgtctttaagcagtctgtgtaaaagctgctcgctctctactttcctcagattaggaaatattataggcttctataaccttgcatttccttatctattaaaaacataaatgtggtgaaaatcaaatactgccttcaccttacggggttgtatgaattaaattagattttatatatataggtatcagaaattatattattatatcacatatgggagattatgtatactttattatatgcaatcttatgtaattcatacatgcacgtatgtaaactgcttaggatagtgtcaccaggggcagctgaagcaaacatttcttcactagagatgaaggtcacaatggcttgctggtatttctcccaaatatacccagggagttaaagtggtagtaaagagctgaagacagatggtagataggaaatgtctaatgaacaagattattttttttcttttaaaaattttgtttaaaaatacagttgggacctaggttggagatgttcatgtcttagcttctatagtgtccagtgtggcagcatgacattaatttaaaaaacccttaagattcagcaagtcagactggtgtttgtcttcttttaaatttctctgagactccaaagggccatcactactgaaaagaggttgtatagtcactttcaagtcaactacttttattacattctacatagttatatttcatcatgtgggtaggtcattgactcacttgtttgctcaatacatacttacagagtgtccgctatgtgtcagctgttgttatagcacaggggataatgcaaaaaactggcaaagccctgcccttatggcaatttcagtcagcaggggtggatatacataaacaaataaacaagtaaatatgtagtatgtcagatggtattaactactataaaaggaacaataaagcagagtaaggagtaaagggaatactgcaccaaggggagtgacctggatgggcttctgtattaaggtgtcatttgagtagaagtttgagagaagtgaaggagcaggccatatgaatatctggaagaagaattttcagacagagggagcacaaagtaccaagtctctaaagtaggagtatgcctaaagtgtctaatttgtgataacacgtatgaaccttgagaatattatactagtgaaataagccaggcacagaaagacacatacaacatgatttcacctataagtagaatctgaagttgaattcacggaagcagaatagaatagtgattaccagggattgagggttgggagaaggaattagatgttgattaaacgatatacaatttcagttaggaggaataagttcaagagatctattgtactgcatcataactataattaataacaatgtattgtatacttgaaaattggtaagaaagttgattttaagtgttatcaccacaacaaataagtatgtgaggtaatgcatatgttaattagttgaattaagctattccagaatgtatacttattttaaaacatcatgttgtacaccatgatatgtgtaaatatatataatttttatttgtcaatttaaaaaagcagcaagaaaacctgtaacaggagcaaaatgggcaaagaggagagtggcaggagatgagttaggaagggtcaggtaatgtaggtccttatgggactatagggactttttggcttttaatctgagtaatatgggaagccagtgagaattttaggaagagaagcaataaaatctgacagaatgtaaaaatcactctgctttctatgttgagtgtagactgcaggcatcaagggtaggccaacagtgggcagcagggccaaggatagataggcattgccacaatgcagatggaatagagtaatggcttggactgtgtcctagtgactatagctgcataacaaattacccgaaatatggtggattaaaacagccattttagaaggcacatgcattctgtgggtcaataatttggaaaggacacagtgttctctctgttctccaatatctggggcccctaagatcccaaatcctgggggtgattcaacacctagggacaagtacttataataatgattagagaaaaaaaggattgttgagaaggataacaaataaatgaagtggtatctggaggcagacatggggtcaagataggaaaaactaagcatattgttaaaagatgggcaagattaaatatatttgtgttggggagaaaaattctgtgagttaaacaaattgataatgcaaaagatggaggggctagaatccagaggctaaatggaagggttggactctgatgggaacaggaacactttgtgtattaggaaagaagactgagagtgaaggcaagttttagcttagtagatttgatgctgaaaagatgagggagttggtacttatgggacagtagggactttggcttttaatctgagtgatatgggaagccattgagaattttaggaaggaattctgcttgcttctgttttctcagtgacgtacgcagcaaagtcattgactgagtggaaggcaggggaggagatgtagtgggtatatagagagaagatgtgaagtgttcattttggagagtgaaaggtatactacatgtccccagagtactgagagataatcatgaaattaaagtgagacctgtttagcaaagttacatgcttttttcccacaactttgtttgcttggatgtgtccacagaaaagatgaatatttgggtttaaccaaggtaagagtttatcgggtaagtgcaatagagggagagatgggcaagggagctaagaatcttttcaagtgtgtaattgtaataatgttccataaaatttaagcttgaataaggaaggaagtgagaatatgaggggacacaccagaacaatgaaaaagtggaggggcatcaatggatagaaggtcttgatgatatcaaagaaattgtagggatgaaaatctggagtaggtgagctggaagaacagaaggtattggatagagattgattgtaataaatcccaattggttgagatgtgtaactctttttatacactgttggatttgatttgctaagattttgttgaggatttttgcatctatgtttatgagagatattggtgtgtattttttctttctcataacatctttatttggttttggtatgggtcatgctggcctcaaagaatgagtcagaaaatattttctctgcttttatgttcctgaaattattgtggataattagtattatttcttccttaaatgtttcgtggaattcgccagtgaaaccatctgagcttggtgcttttttagggaattcttgattcaacttctgcaatagatatagtcctatttagattatctgcttctccttatgcaagtttgtgcagaggctgaatagtatgattgaaattgaggttttggagaaggtacacacatagtgatgatgattaagtcaaggatgactatgtgctgaatctaaactctggggagtcccagaggccgttttctatacatgcaaacacatttttgtgcacacatatatagtgtatatatttatacaaatgggattgtattatacggatggtgtttatacaaatgggattgtgttatacaagtgggattgtattatacaaatgggattgtattacacggatttttttttcattatactgtattttgagcttctttccatgttagtattcactcgttcaattggtatttattgagcagatatacaatggtttaaaaaccaaagtgcttgctctgatagaacttacattttgatgggggtggtagtggagacaatatgctcataaaaatacttaaagaagaatttcatattccaagtgctagaccatggaaggtataaattagagtaacgagatagagattgatgtggggagaggaccacaagaggtaggcttctttcagctgtgacttgaataatgtgaaataattagccatgcaaaaatctaaatgaagagcattccaggtagggaaaatttgggggaagtgagtgagaaaaaaatagctccgtattttgaatgcctactacaaaccgtgtgtgtattctaaacatttgatatacattgcttcatgttatcctcacacaaacccgaagagtagaaagtactattattaccatatactgaaaaggaattgagccacagtctgagtaagtaaattgcccaggccacataactctggtgtgtggtagagttagtgctcagctcaggcaggtttatcccagagaccatggcatatccttttttccctcccctcccctcccctccctttgcctccccttgcctctcctttccttccctccccttcccttcccttcccctcactttttttctgagatgggctctcactctgttacccaggttggagtgcagtggcactatctcggctcactgcaacctctgcctcccaggttcacgcgattctcccacctcagtctcctgagtagctgaccacaggcacgcaccaccatgcccagctaattgtttgtatttttggtagagacagggtttcgccaagtttcccaggctggtcttgaactcctgagctcaggcaatccacatgcctcagtctcccaaagtgctgagattacaggtgtgagccaccatgcctggtgctttgcctatccttttactgtatggcctctaagggcccttccaactcaaagattctatatttatctaatgtggtattttattgacacagtaaaggcaatgccagaagtaaaaagctaacaggataataagtgagggacctcctgtaaaatgacttacactttatgaaaacctacatgtatgggaacttcatgtgatgttatggtatccagttgttgaacataccataattcttatccaccagaagcagacatattcaaaaccaggatgccacaaataaattaaaatcatgacacatagaaatatggaaattacatgactctgaaagatagaaacgtatagagacttatgttttctttactacaggatataagtagagacttgaacctgtttttcaaaacttctatcttggtgacatattcatcatttggccccaatacacgaaacagttttgctcactcaccacttacccctcctggctgtctacacctttcctcttacttcttccattgtatgaatagagaagtgtaaatgtgatgttataataactcagaggcacacattttcttgggcaagcaagtctcagtgggaaaaaaattggagagatagaatctttcaactctttctagttattctgtgttattatttaggacctggattcccaagggtcgatacttatttgtgtggcttactcttattttccttccttgttgttatctgacatttctaccctaaggtatgaaaaatcatatgctagctccactgctcaggcaacattaatacttactatttgagaatctgattttccaagtattgatgaacagtagtacaaataaatcagtggacaaatttaattatatcttcgatttccttaaattctcacctcttcctcagttccagttagagagcaagacttgcttaggcatcttgctccaggaggtagacttttatgttaaaagtcatgcttcctttcaagaattttatttgtgttcaagttttgggtatggcgctaagatacctttaatcaagaaaagaagtaccgggaagtcactgctgttcctgccaacagctagcatctcctgtagagttggcattagagataggaagagaatacactctgtttccaagttgtgggatagcaatgaaagataactgtaaaaagataagaggcagttatgttgggaaaatggattaaatgttttctttttcatgtactagttgtttgtgagtactttggatttttataaattttactgggtaaacagtagcctgttgattttgacagtgttgaaactaagagaaaagattgaaaaaaataattgtttcttaaacataggttgtagctggggaaaatgcagaagtaaaatgtggataaatacagatatttttctttgaacaagtaaaatgaatgtatcaatctgaaatctggatttgccttgagtaacaggagaaataagacaggatgcaataattgaagaggagaggcaagtcaggatgcaataactgaaggtaaaagataagacaggatggaataactgaacaggagggataagacaggatataataattgaatgggagagataagacaagatacagggattggagaggagagagaagaaaggatgtgataaatgaaaaagacaagacaggatgtaataaatgacagggagagatcagacaggtacaacaaatgagagagaaagagagagaagacaggatgcaataaatggatatgagaggtgagacaggatgcagtacatgagcaggtgagataagacaggttacaaaaatgagtggaagagacaagatggaataactcaatgcgaaaggtaacatgacacaataaatgaaaaagagagataagacaggatacagtaagtgaactggagtgataagacaggatgcatgtagtaaatgagcaggaaagataagacaggatgaaataactaaataggaaagataagacaagcaggagtaactggtcagaagagataagacaggatgcagtaagtgaaatggaaagataagataggatgcaataaaagggcaggagaaataagaaagagtggaatatctggattggaaagttaagacaggatgcaataactaagcaggagacataagactggatgcaataactgaacaggacagataatcaggatggagtaaatcaataggagatgtaagataggaagtaataactgaaagggggaaaatattagcttattacagacagattctccttcctactagggaatgctttctgaagctggtaacattgaaggatgagtagggtggacttgcaaagaggaggaaaaagcattacaacaggagaaagaagaatatgactgtgatattaaaatatgggaaaggcagcacttcagtctacctgggtatcatagaatttataaaagtgaatactttgatgcctacagaaagcatgaaagttgggtaaaaattggagacattcatttacttatactttcaaaatacaagtattgagcataaactgttcaaggcacaatcccaagtggaaggatacaagaatgaacaagtaagacccccaatttacactcatgtagcttgtattttaatcagagagaaagacattattatagttattataagtaataaatgatgatatcatataacagggacatcttaactgttctggagggactaggaagtgaagagtatcacaaggcgaagcttccaaggtgcgaaaggacttctttagggttttggcctttatgctaagagcaaagggatggttttaagctacagagtgttgtgatcagcctattatttttaaaaagctctctctgcctgcagtttagaatagatttgtgaagtaagaataggtatgtggaagaccaggcagtagatgatagtagtttggacaaggaagatgacagtaaagataaagagaaatcgatggtcttgaaagatgtttaggagtagtaaaaaaaagttaatgattgattggatatgggggaatgaaggacatgtagatttcaaggctgattcctagcttttagcttgagccaactatgtagataatgttgccatccactatgatagagtggtatgggaacaaaagcaagttttaaagagaggagggtaaggtcatgaattcgtcttggctgtgttgcgtttgaagtgcctattagtagtgagattgagtctgactctcaagggagagaattaggcttgggatataaagttggaattcataggttatgaatggcaatagaagctaagggagtagatgaaatcatttagggagaaaatgttaagtgagaagagatgggggtctaagatgggaccttgagtcatatcacattgagctcacataaacacttgaaggttatagagaggaagttgaactgacaaaggagagagaaggagagactagatagccaaagctctgaagaaaaccagggcaggaaaaagtcttggaaatcaggtgaagagatcaatttcagaaagaaagaattgtcagatgtataaaatgtaattggaaggttatgttagttaaggcttgagaagtgtccatttgatttagcaacaaatgaatcactgaatcatagtgagatccatttcagtgagggagcaaaaactattttgaaatgaattaaagagtaggtgggaggtgaggaaatgaaaacagcgtgtatacacaattcttttcagacactttgttgtaaagttgagaagtgagacaaaatctggagaaagaaataggatcaagagagagtttaagaaaggatccagtacagtgggagatattggggatgaaaatgaaagagaagtagtctattatataaatcttccaaaaaagaaaggagggagggagggagatttagtgccaagcagagaagatggccttaaattggaggagacacctcctcactggaaggaggaagatggtttgacagtgtaaatgtgagtccatttccttttgagcaagatggcttggcagtataaacgtgagcccatttccttttggtgacatctatttttttctttttttaatttaaaatatttaattgacaaattgtatattttcaaggtgtacagcttgatgatttgctatacatatacattgtgtaatgattacatcaattaaattaacacatccatcactacccatgctgtatgttagatctccagcatttagttctcttatatgtgaaattttttaccctttaaccaacatctttttgattccccccactctcagcccctggcaaccactgttttactctctgcttctgtgagttcaactttttggattccaccatataaatgagatcatgtggtatttggttttctgagactggcttatttcacttagcataatgtccttatggttcatccatgtcattgtaaatggcaagattatcttcttttatatggttgaataacatttgtgtgtgtatgtgtgtgtgttacattttctttatccactcacccattgatagacacttaggttgtttccatatcttggctgttgtgaataattctgcagtaaatatgggagtgctggtgtctctttaagatactgatttaatctcctttgtacgctcagaagtggaattgctgttttatttttaattctttaaaggacctcaatactgttttccaaaatggctataccaattcgcatgcccaggaacaatatacaagggttccctcttctctatagccttgccaaatacttactatctcttctctttttgataatggccatcctaacacacatgaagtgacattgtggttttgatttgaatttttctgattagagatattgagcaccttttcatatattggttggccatttgtatgtcttcttttaagaaatttaggtcctttgcccatttttaaatagggttatttgttttcttgtttttgagtagtttgagttccttttacattttggatattagctccctatccaatttatgatttgtaaacattttatccctgtattagtccattcttacactcctaataaagacatacccgagactgggtaagttgtaaaggaaaacggtttaattgactcagttcagcatggctggcaaggcctcaggaaacttacaatcatggcagaaggggaagcaaacatgttcttctttgcgtggtggcagcaaggagaagtgctgagcaaaagggggaaaagccccttataaaaccatcagatctcatgagaactcactcactatcacaagaacagcatagggtaaccacccttatgattaaattacttctcgccaggtttctcccatgacatgtggggattatgggaactacaattcaagatgagatttgggtggggacacagccaaaccatgtcattctgttcctggcccctcccaaatctcatgtcctcacatttcaaaccaaaatcatgcccttccaacagtcccccaaagtcttaacttattccagcattaactccaaagtccaagtccaaagtctcatctgagacaaggcagctcccttctgccgatgagcgtgtaaaatcaaaagcaagttagttacttccttgatacaatggaggtacatgaattgggtaagtatatctgttccaaataggataaatcggccaaaaaaagggggctactggtcccatgcaagtctgaaatccaatagggcaggaattaaatcttaaagctttgaaataatctcttttgactccatgtctcacagatataagtgagacttatatcaggtcacgctgatataagtggtaggcccccatggctttaggcagctttgcccccatggctttgcaggatacagcctgccacctggctgcattcatggcttggcattgagtgtctgcagcttttccaggggcatggtgcaagctgttggtggatctaccattctggggtctggaggacaatggccctcttctcacagctccactaggcagtgccccagtgggaactctgtgtgtgggctctgcacccccatttcctttccatgctgtcctagtagaggttctctatgagggctctgcccctgcagcaaacttctgcctggacacccaggcatttccatacatcttctgaaatccaggcagaggttccccaatttcaattcttgacttctgtgcacttgcaagcctgacaccatgagtcagctgccaagacttggggcttgcatcctctgaagcaatggccaagctgtaccttggccctgttccctgtttagccatggctggagctgaagcagctggaatgcagtgcaccatgtcctaaggctgcatagagcaggggggcctgagcccaccccacgaaaccattttttccctcctaggcctccaggcctgtgatgggaggagctgctgtgaaggtctctgaccttccatggagacattttccccaatgtcttagtgattaacatttggcttcttattaattttgcaaatttctgcagccagcttgagtttctctccagaaaatggagttttctttactattgcatcatcaggttgcaaattttccaaacttttatgctctgcttctgcttgaatgctttgctgcttaaaaatttcttccaccagataccctaagtcatctctctcaagttcaaagttccacagatctctaaggcagggtcaaaatgccactagtctctttccatagcaagagtcacctttaatccagttcccaacaagtttctcatctccatctgagaccacctcagcctggacttcattgtccatatcactatcagcattttagtcaaagccattcaacaagtctctaggaagttccaaacttctcacatcttcctgtcttctgagccctccaagtctctaggaagttccaaactttcccacattttcctgtcttgttctgagccctccaaactgttccaacctctgcctgttaccgaattccaaagttgctttcacatttttcgacatccttacagcagcacccgactctctgtggtaccaatttactgtattagtcaattcttacactgctaataaagacatacctgagactgggtgatttataaaggaaagaggtttaattgactcacagttcagcatggctggggagacctcaggaaacttacagtcatggctgaaggggaagcaaacacgtgcttcttcacatgctagcagcaagaagtgccaagcaaaaggtggaaaatttgcttatgaaaccatcagatctcaggagaactcactatcatgagaacagcatgaaggtaactgcccctgtgattcagtcacctcccactgggtgccttccatgacgtgtggggattatgggaactacaatgcaagatgagatttgggtggggacacagtcaaaccgtatcactcccaatctgtgggttggttcttcacgccattaactttcctttgctgtacagaaaagccttttaacttgatgcagtctcatttgtttatttttgcttttgttttccatgctcttggggtcataccaaagaaatcactgcccataccattgtcatggagattttttccccatgttttcttctagtagttttacagcttcaggtattatgtttaagtctttattccattttgagttagttcttctataaatgatgagataagggtctatttcactcttatgcatgtggatactcaatttttccaccactattgaagagactatcctttccctattggtattcttggcatctttgtcaaaaatcaattgactatagatgtgcaagtttatttctgggctttctattcttattccattggtcagtgcatctgttttcatgcaactaccatgctattttgattactatagtgtatttgttcattttcacactgctataaagaactacctggaactgggcaatttatgaagaaaagaggtttaattgactcagctccataggcttaacaagaagcatggctgtgaggcctcaggaaacttacaatcatggcagaaggcaaaggggaagcaaggacctttttcacacagtggtaggagggagacagagagacagagagagagagaaagtgccacacacttttaagccatcatcagatctcatgagaactcacttattatcacaagaacagcaaaggggaaatccacccccatgatccaacacacttttaaactatcagatatcatgagaactcactcactatcatgagaacagcaaagtggaaatccgcccccatgatccagtcacctcccaccagctccctcctccaatttgacatgagatttgggcagggacacaaatccaaaccatatcatataactttgtaatgtattttgaaatgtggtagtgtgatgccttcaacgttgttcattttgatcaaaattgctgtgactatttggggtcttttgtgcttccatacaaattttaggatttttttttctatttctataaagaataacattggaatttttataggaattgcatcgactctgtagatcactttgggtagtatggacattttaacaaaatttattcttccaatctatgaacataagatatcattccatctatttgtgtcatcttcaatttctttcattaatgttttatggtttttggtaaacacatatttcactttgttggttaaatttactcctgtattagtctgttctcactctgctataaagaaatacctgagactgggtaatttacaaagaaaagaggtttaattggcttatactttcacaggctgtacaggaagtatagtggcttcttctgaggaggcctcaggaaatttacaatcatggcagaaggtgatggggaagcaggagcgtcttacatggctggagcaagaggaagagagaggtggggaggtgctacacatttttaaatgaccagatattgtgagaactctattacaaaacatgaccaaggggatagtgcttaaccatttatgaaggatccacccctcccccaccaggccccacctctgacactggggtattacaattgaacatgagatctgggtggggacacagattgaaacctatcaggggaaccagcccccgataagtcaacataggttcttttctattttctctaagtgtcggctggtctgagaaataaagggaaagagtatgagagagaaattttaaagctgggtgtctgggggagacatcacatgttggcagattccgtgatgccccctgagccataaaaccagcaagtttttattagcaattttcaaaggggagggagtgtacgaatagggtgtgggtcacagagatcatatgctttaagggcaacaaaagatcacaaggcagaaggtcagggtgagatcacaaggtcagggggaaactagaatcactaatgaacttccacatcccactgtgtacgcattgtcattgatagacatcttaacagggttcaagagcagaggaccgatctgactagaatttgccaggctggaatttcctaatcctagcaagcctgggggtgctgcaggagactagggcgtgtttcatccctgtctacatctgcataaggcagacactcccagggcagccattttagaggccccaccctgggaatgcattcttttcccagggctgttaattattaatattccttactgggaaaagaattcagcgatatttctctgacccgtttttggtaataagagaaatatggctctgtcctgcccagcccacaggcagccagactttaaggttatctcccttcttccctgaaaatcgctgttaatcctgttcttaaggtgcccagatttcatattgttcaaacacacatgctctacaaacaatttgtgcagttaatgcaatcatcacagggtcctgaggtgacatacatcctcagtttacaaagatgatgggattaagagattaaagtaaagacaggcataggaaatcacaagagtattgattggcgaagtgataaatgtccatgaaatcatcacaatttatgttcagagattgcagtaaagacaggtgtaagaagttataaaagtattaatttggggaactaataaatgtccatgaaatcttcacaatttatgttctgccatggcttcagccggtccctccatttggggtccctgacttcccacaacagaaaccatattaacttctatgtgtatttgtttttagatgctattgtaaatgggattatttcctaatttttaaaagatagttgtttgtgtacagaatcagtggtatacactgctgatttttgtatgttaattttgtatcttgcaacttagcagaatttctttgctagttctaacagttttttggtggtatccttagggctttttatatataagattatgtcatcagcaaacagagacaatttcactttttccttttttatttagatggctttttatttttttttacttgcataattgttctggctaggacttccagcactatgttgaaaagaagtagtgagagtgggtaaccttatctcactcttgatcttagagcaaaaaccttcaacttttcaccattgagtatgttagctgtggggttgtcatatatggtcttaattgtgttgaagaacattccttctatctatatctatgtcattgtttttattatgaaagaattttgaattatattaaatgctttttctgcatgactgagatgataatatgattttaatccatccttctttctgttaatgtagtatgctacatttattgatatgtatatattgaaccatccttgaattataggaataaatctcagttgatcatggcatatgatccttttaatgtgttgttgaattcagtttgctagtattttcttgaggatttttgtatctgtgttcatcagggatattgacctgtgattctattttcttatagtgttcatatctggctttggtatgagagtacggctggtttcaaacaaatgagattggaaatgttctcttctcttcattcttttggaagagtttgagaattattgccattaattgtttcattgcttggtagaattcacttgtgaagccatctggtcatgggctattctttgttgggactttttgattactgattcattttccttgctcattattggtctgttcggactttttatttatgcttcagtcttggtaggttgtctatttctaggaatttatctatttcttctaggttattcaatgtattgactatagctgttcataatagtccctatgatcctttatatttctgtaatatgagttgtaatgtttctttttcatttataattttatgtatctgagtcctctttttttcttggttagtttagctgaagaattgccaatgttttttatcttttgacaaaaccaagtcatagttttgttgaccttttctactctctttatagtctctgattcattatttctgccctaatctttatttctttctcattccttcttctgactttgaccttagtttatttttttctgatttcttggggtgtgaagttaggtagtttatttgaagtctttttttttcttaatgttggtatttatcactataaatttccctcttataactgctttttcagcatcccataaatttgagtatgttgtattttcatttttatttgtctcaagatatttttttatttccctctttgatttcttttttgatccattggttgttcaggagtgtgttgtttaactttcacatatttgtgaatttttcaaaatgttcttgttatttctttttagtattataccattgtggttagaaataatacttgatcttaatatttttaaacttgttaagacttgttttgtggccaaatatgtaacctgtcctggaaaatgttcaggtgcatttaagaagaatatatattctgttgttttgggatggaatggtccatatatgtctgttagacccatttggtctatattgttattaagtctgcagtttcccttctgattttctgtctggttggtctatccattgttaaaagtgggatattgaagtcttctactattatattgctgtctatttcttcccttagttttgttaatatttactttatatttttaggtgctctaatgttgggtgcatatataattacaattattatatcctcttaatggattgattcttttatcattacatagtgacctactttgtttcatgacagaatttgactgaaattaatataagtgtagccactcatgttattttttggttaccatttgcatggaataactgtctatctctactttctgtctacctatgtccttcagactaaagtgagtctcttgtagacagcatatttttggatcttgtcttttaaatccattcagccactctgtttctttcgattggagaatttagtctatttacattgtaagtaattattgaaaggacttactattgccttttaattggtaattgttttctgattgttttgtagatcttttgtttccttcttctttcttgctgtctttgtgattttttgggttttcttagtggtacatgttgatttttttctatttatcttttgtgcatctaccataggggttatttttgtggttaacatggggcttacataaccttctctttttagtggataacaactttaatcatatacaaaaactctacacttttatttttctccatgttttatgccacagtttacatatttttatgttgtgtataaaatttatatatattagtttatattaaattattatagctatagttttaaaatctttttgtattttagcttttatactagaattggaagtgaaatacacagcactattacaatattagagtattctgattttgactgtgtatttaactttccctatgagttttatactttcatatgttttctcttttccttccttccttcctctctcctattttctttctttctttttcttttcttttctttctttctttctctctctctcttccttcttttcttttctttctttccttctcttctctttctttctttctttctttctttctttctttctttctttctttcatctttctttctttcttgtcttgctctgctgcctaggctggagtgcagtggcatgatctcagctcactgtaacctctgcctcctgggttcaagcgattctcctgcctgagggagaatcaagcaattctgctgagtagctgggactataggcacaaaatggggtttcaacttgttggctaggctggtctcaaactcctggcctcaattgatccacttgccttggcctcctaaaatgctgagattaccagcgtgaaccaccatctccgacctcatatgttttcatgtcgtacttagcattctttcatttcaatctgaagaattccctttagcattttttgttaggcaggtcttgtagtggtgagctctctgagctcttgtttgtctgggaatgtctttattgctttttcatttctgaaggatacctttgccaagtacagtatttttgcttgtagtgttttatttcagcactttgaatatgtcatcccactcctttctgacttgcagggtttctgttgagaagtccactgttagctttatgtaggttcccttgtatgtgatgagctgcttttttcttgcttctttcaaaattttccatctttgactttcacaattttattacaatatcttggaatattctttttttgggttaatttgtcttgtgattctatgagtttcatggatctggatatgtatatccttttcaagatttgggaatttttagctagtatttctttaaataagctttttgtccctttttctctcttctccttctgacactgtcataatttatatatttgtatgcttgatggtgtccatagtcctttatgctttttctttttccttttttgatcctctaattgactaatttctgatgacagatctttgaattcactaattctttcttttgcatgattgagtcagttgttgaaactttttattgaatttttctatcttttatagtattattcagctccaggatttctgggggttttttttgtctttactatggtttctatttctttgttaaacttttcactttgttcatgcattgttttcctaattttgtttagttgtctattttggttttcttgcttctcattgagcttctttaagattattatttgaattctttttcatgcagtttatagatctccatttctttggggttggttattggagctttattagtttcatttggtggtgtcatgtttacatgatcctttgttatctgtgtagtcctgcattggtgtctgagtttattcaggtttagttctttccactcaaatgtaatagggtatagagaatggcagagaaatttagggagttgtcaagagaatggctataaagataggttatgaattttccttaaatgggaagagaaataaagataaaaaagaggctgatttagttaagaagtaaagagaccaaatattcaggtgctaatggggttgaagaaatgttatgtcgggaatagtccaacaagtaaggtagaaaatcagaaaggagatgctttatgtagttagtttggagaatggagattgggcagttttgtgatattttctagagtgagatgagactatggaagaggggtagtggcagagaaggtagtcgaggtggaagttagtatagtctatgaatcatccatgtggacattgaaatctcccaggaatgtggtaaggattgggtggaaaggaaaagcaggtgccaaaatctttgatgaatgaaaagttagtaaatgaccacagtaggtatgtggaatagctaaataatatgaacttcaaagaaggaagagtcttctataggaggataagcaacaaggggaattgagaggggtattatttctagcttaggactaaggagttcttgaaccatgagagaataatggccacctcttaagaagacttacagggaaggatttttatcagggggaggcagatttcaatttaaaccaagaagtgggttgaggggaatattccaaagagcataagagatctcatgttttccaggagggtcaatattaagtgagggtacagctaagatttgctaccataatcagatccttccatcttttcctgactctttgcttaacatatgcccatttatttatcgtttttctcattgtgaataaccaaaggaaatggcaatgtgtaattcgaatattaggatataaactttgggagaaaactggatattaaagtctattaaaattattttaaagtccaacccaagatatagcattacaatagcgagttgtttccagtaatcaatagaaaataagtggaggtgcataatgacccagagagaatcttccccaggaactgaggtccagagatgtatgactggatattttaacctactggatcataagattagaaacatttaattgtatattgttccttttaagtagactggttactattctccaagacctttgttatgtctttaatggatgagatacttgctattttacttgctcatgttgtatgaaaaattgacataggtggaaggcccatgctaccctcagtacaggtaaacctgtagtagtaataccatggttacaacaatgatgacaataattgccatagcactgtagaaaggcacaatacagacatctaaatataaagtaatgagagtagggtagtgactttaaaaaatatgaagtgacctattgctatcaatatacttacaaggaagaaatccttgtaaaatacagaagtagccaaagagatagaagacataatagaaacatatttcttaacaatttttaactcttggttaccatttgattgtgataaccaaggagggggcacaatccagcaaactaaacatctgtagataacaaaaaactaaaaatctcttgtatttacaaagggccagaaaacctacagaacatgcttccctctcaagggattctaatcccaattaaatggttcatatagttatagtgaagagtttgcattttaaatatttttgacagtactttaatctaatttttaaatttttctcattttatgtaaataacatgttttaatttatttttactcagccttaggatgaaggatttcctatcattttatgaagaaaatcaataatttcattgacagaaactagctatgttttgtcaagtaaggtttaccaaatattctatgttttatggcttgtggtatacctttaggttcacctacttcctatagggacgcatatggtggcacttaccgggtctgcctagctgctctctatcatgtcttaatattggtgactaagcacttttctgtaaaatgtaaccaaaatgttgagatgtttttcttttctcagtacttctaaagacaaattgacatagaggggaaaaagagactcacaagtttttggcagataaattttttatctccaaaagtcataagtacaaaatggagtgacaaagattttcacattttgtgcatttctttggtcacctttcagcagttagataaattactcttcacttatgatttttgtgtgaacctccctgctcttcaccctcagcttgttgacctgggactcagcaatgtcagcccgttcctcggcctcctccagctcgtgctggatcctgcggaatttggagaggttgacgttggattgttcctcctgtgaatggaaatccatttatgagggaagaaagttcagaatttttccattcttaggtcagtggatcttgaatttcctttttacttaaaaatgattcactctagcagatattttaagaaacctagagaaatgctcttgaatttttatttttttttatttttgcattagcttcttgaactcatagataacaaggaaggacaggtgacctttgtatctgaacttttagaacagcagaacatcctagagctactactaaatatgccaggtgtccagctttgtttttttttttgtttgtttgtttgtttttttcagaatcctgagaatggaaccaaaccttttaagagtgcaagtatgcaatctataccaaaccaaaccattaagcttgaatataagttattgccatgtgagtataaattattgccacttaagtttagaaattaagcaagaagtttgtttcctaaaatagtctgagctgtctctgattatacttaaatatatagcagagaatttgagcaggtcagttctagtttagtctctggtaatcattcttatttaaaagtctcagtaagaacctccaaaatgtggcattcaaatttagaacagacataaagcttagaatcattaaatagtatagcttgagaaaaaacctcagcttttcctcttacagatgaggaaagtaggaactggagaaagattaagcaatttgtccgaggtatggacagtagcgtgtgtgtgtgtccgtgcacacaagtgtgtttgttttctctccctccctcattcccctccattcccatctttctctctctcttaccttagatgtcaggggtaaaataaaaaccatcaatgaacagaggaactcatttgtgatatgtaactatgaatatttatatgtaggaagttgaaactatttgattattaatccagatgaatcatgggatacggaaatgagataaagtggagtgttaagaatctactgatttgaacataaccaagaccttctgagtttcagaatcttatatttaactatttacttgacatgttcacttgtgtatatatggtattatgtatctaaaacagaattcctgtttctttcttgccctgcaattctgttcttccctttgttccccacttaagtgttacatcatccacttggttactcaaaccataaacttgataaattactcttaattgcctttctttcatctcccaagtgcaacctattagcaatcttgtagtttctacctccaaaatatgtcctgaatttctccacttctctctgctccactctcttatccaagccacagaaccgacctgaaaagcttcctaacatgtctctctgcacccacttgtgttacccagtaaccgattctttacatagtatcccaaatgctctttttaaaaaatatagatcaggtagtgactgacccacattaaaaccctccctggcttcccagtaccttattgttcttaccatggcctggaagaccctatgagctgcctcctgcctggctctccagtcccagttgtggtgctttcctcctttttttgtctgcttcttgagccagactctttcccactcaaaagctttgcatttgctcttccccatctctagaacatcttctgctggcttgtcaggtggttggttttacctcagccttggacctccatgtagccatttgttttcttttgatccttcctcattttactcatcttttcttttgtcactttaactaaactggcctggtcatgtctgagaaaaatcaccccaaggggttgtgaactcaccgcttcttcagcttgtctcttgtaggatttcacctttgcttgcagtttgtccaccaggtcctggagcctgagaatattcttgcggtcttcctcagtctgaaataatgttttcaagagtaagtttcttgaaagtacaaatattacattttgtcatacatatgacttttaatcccatgtggactaaagtgaaaacctagacaggccattttccttacttggtaagtgagttccttcacttttctctcatgtttgcgtagacccttgacagcttcaacattgcgcttctgttcactttcaacttcaccttcaagttcacgaacctacaagaagatggacattttaaggacattcatttgacgaatttctacttcttcacatgacccacatacttcttctactctgctttatatgtagtttttaatgccctagttcagttttccttattatgagcttttgggcatgagggaatagctctccctcatctcagtatgccccacatcatctagcagtgctaggtattcagaatcgtgtgttggattggaatgagatagaaatacatgctgattaggagacccaccctggcctccagtttctggatctgcttcttcccacccttcagggccagctgctcagcctcatccagacgatgctgcaggtccttcaccgtctgttccaggttcttcttcatccgctccagatgggcgctggtgtcctgttccttcttcagctcctcagccatcatggcagcctaattagcagtaaaacagaatgggttaagacagctaagacagcacattaagatttaagtttgaccaccactgtgttacccttcactcacatcagtgatggccttcttggccttctcttctgcattgcgggcttcctggatgatgtcttccatctctccctggatttgggaaatgtctgtctccagcttcttcttggtgttgatcaggctggtgttctgtttaaaatgtgaaatttagaaatattaggcacatgagagaaaaattaggaaacctcatgttctaatgaaccataaactaattaactaaatgaattcattaatattcctccttgtttcataaattatctgagttgacatatgtttaaaagacaatcaactggccgggcgcggtggctcatgcttgtaatcccagcactttgggaggccgaggcgggtggattacgagatcaggagatcaagaccatcctggctaacacggtgaaaccccgtctccactaaaaatacaaaaaattagccgggcgtggtggcgggcgcctgtagtcccaggtactccggaggctgaggcaggagaatggcgtgagcccgggaggtggagcttgcagcgagccgaggttgcgccactgcactccagcctgagcgacagagcgagactccgtctcaaaaaaaaaaaaaaaatcaactatggatgttatagttcagataagaatatagataatcaaaaaaataaaatattttaaactttatccttcatgaaatcttataaatagatttcttaatagtaccacgatttcagcaagaatgtcattttcatacccttgtatttgttgctattctattattacatgcacctgggtgtgcaggagctgaacacgctcactggcatccaggagctcctgttctgcgattttcctgctcctctctgtctgttccagagtggcccgcagctcctcgatctcagcctgcagcaggttggctctgcgctccaccatagccagctgttccttcaggtcctcctggctccggagagcatcatccaggtggagctgggtatcctgtggaacaaaccgtcattgagacaccatgtattcagggttgcaggcaccccaattgtcctgggatcatctgttggacatatttaccttgaggatggcttgggtgttcctatagttcctcagggcctcagcagccatgcggttggcatggttcagctggatttccatttcattgaggtctccctccatcttcttcttgagcctaatggcatcattcctgctcctgatctcagcatccagtgtgctctgcatggactccacgattctaatgtggtttctcttcatctggtcaatttcctcatctttttcagcaattttcctatcaacctcagacttgacttggttcaactcaagctggatgcgcaggatctttccctcttcatgttcaagagatgccttaatgacagcaagaggtgacattagtagagtaatggaagtgtgtagtattctagagataagaatgatttatcattcatgaaaccttatttataaatagatttctaagtagtagtaagatttaaacaagagtgtcattttcatgcctttgcattttcttgctattctctaacacacacactgtctgcctttgtgctgccatcatacatttttattttgttgttttagacatttctacaaattattgaatgttattgttgattttatatgcttttatctccctaggtagattgtgcccttgaaagcagggcctttaactgattcatctttgtttgctcagtgtgtagcacagttcctgacatatggttatgttggttgtatgcatgatcagttctccattctcatccctagttcatggagcaaaaattatttttcgtttctcttgattcaccattccttacatttaatagaccccaattcctcttctaattgttttagagtatgcaataaaatgcttacctctgcctcctctaaggcagcctgaagttcagacttttcttgctcaacttgcttctttattttttccagttcatggatgcgctttcctccttctgcaatctgttcagtgagatcagaaatctcctctgttggtgaacaaaaaatatagaaatttgtttatagttggaaaagattctttcaaatcttttattgttaaagaaaaggtaaaatgttctcacgttgcaaattcttattttcccgtttcaaggtttcaagttggtctaaagattcctcataagcattcttaatcttaaatagttctgtgctgagtgagcgggattccttttgagaagcttcaagttcagcatgagtttcttcacacttctgtttccattctgccaggatctgaaggtcaaggaatggacaagaaatttagtggacaaaatttgatgagataaaaaccatctattctagcacctctcagagttgaggtgttctgggactgaaaaaaaattatgaatgagaagaatagaaaccataggagcacttcccctctccacagacagctgctgatgggttaagagctactgagaacagccctcagatggtttgaattgggcacactgaaggtagcaggctattgttaattctgtgttgaaagttgaagcaaaaactggagagaataccttatcaaagttcctttgctttttgtccagggcggcacaggcagcatttgtcctctcaacatcaatcatgaggtcctcaacttcattctggagcctctgcttcgtcttctcaagggaagcacatttggcattcacagcttctacatgttcctcagcatcctgcagacgctgagccagcttcttcctatgaaatatgggcaataaaagtgaatggctgtcaactgaattgggtgtttcaaagtgggtacaagagagtgaattccacaatcagacttctttaatactttgcttctcaagcttgttttgtaggtccagttctatattaactcattcccattatcctaccaccaaataccaaaaacaaccccagttttggtattgccatacttcatagagtggctttaaggccatccatgacaagcatgagctaacactttacccttccaggtagctggtttattcctcttctgtagaatattaatatctaccttgaattactggtttgtttttctgtgtctccacataattttaatccccagagggagagtctgtactgtactaatctttgtattcttgtaggctgtccaacatattaagggctcaaatgttggataaattgaattcaaatgaaatatacttgattttgtctgtctaattgtatcccttatttgtgctagtttttaattaatccattaataataaagaagctttcccacatcaatatacattttgcatcgagaactcctctcagaatctcttctaaggcatctaccaaaacattaattccaacaatatggctgtatatggtcccagaatgttttttccctagtttttcatatgttttgggagcaaggaaacttatagttccattttaactaagtctggaacatacttggcctcctccagctcctctgtgcgctggatggcatctgtctcatatttggtcctccactgggcaacctcactgttggccttggacattgctctctgtagctcggccttggcttcctgctcctcctcatactgttcccgcagcaggtcacagtcatggcgggaggactgcagggcatgtgccagggcactcttggcctgagaacatagagattgatgacttaattttatatatttaaagtgatgtttgattcctgatctcctataggccaccagaagaaagtctgtaaaagtaagcgaaaaacaaataacaagaacaataatgacaagaatgacaagtggagcttacctttatctcctcttcaagttgccttttcagttcctcaatctgttgtgtaaaggcttgtttgcccctcgagagctgtgaaactagtgtgtccttttcatctagctggcgtgaatattcacctgtaaaagaccaagtccagaaaactcaaccttactttggaaattaaaactctaaaataaaaacttgagcagggaaagggagccaagtttgaaacttgatggagggcatgggtgacaacaaaccaccaacatccgctttaaccttgataagcagatccatgtaaaaattagaagcatggagaaatttgaggcagattacatgcttgtgaacagcacaaaagatttcaagagatatttacgattatttgatcgtagtcaaaattgatgaagaaacatgaaaaaaatgtaaatcaagccaacaaaatattctagtactttttattttatgtaaggcagtagtgttgtctaatttgccttccattgaaagttggttgaaacaaaggatttatactgtggaaaataagagactttgggcaatgtcttctgtaagtagaaatgatagtcaagagaaattctggaaagatttttatattaagaaatgattaagtggtctcccatccccagaatgaattggtttctggataagtactttccaaactaaatggcatttacacatgtcttcaattttttaagcaccataatgcagaaaatgcactacattatgttagaaagatagtaaaacttttccacaccatttttatactagttatcttgaactttatctctggcatttaataagaattataataaatatttattctgaactttgttatagaaagaatagtatttgaataccaaaagtgtagagtgattttccaacactttaacctgcctattactttaatagcctaaattacccataaaacaatttccattttgttacctctacctggggagatacaactctggtagaaagttggacacgtcagtaggagggggaataaatgcagagactttccaatttctctaatcaaaaatctacaaatcttacttgaatgcttctcagctgggttgtggtcttgaatatttccctacttaaccgtgttagttaccagtaattggcaagacttcaggaaaaagactggagtaaacattcttggacaagttgcttcatcactaccataatccactgtctttaaaatggggatagtattacacagactaatgaggaaaataaagtaacacatagcttgcgaaagcattttgaaaagtgaaaagaggtactgtaaggatgcactttgtttttgataactttttgattaaagccaagtctcccttaaagtcttcaaaaatagaagggcctgattctatttatctctctctctctctttatatatatatatatatgtatgtatggatatatatacaaatatatatatggatatatatgtttcatatatatacacatatatttctctcgtatatatatgaaagaaagcaacctcatgccagtggtcaataatgtgttcatattagtggggatctcccagggaggtagtatatgacctcaagtaaataaatgcagagtttttcagtggattacacatgcagggtgaatttgtcattcaaggtcagtactggtacatggcccacctgattctgtttgcaggcgcgctctctgtgctgtgaggtcattgatcagccgctgctgctcctcttccttggtcttaatttcactcagttgatcttctagagcgcggcacatcttttcaaggtttccctgcattcaaaaagtggtagaaggcatctcaagtaagtagttggaccaaagaaagtttcagtaatctaaacattccatatgagctgcagtactcatttattttgagaagaaactatctttacaaacaaaaccagcaaaggtcttagatagtgaatggaaagactaataagatacatagtccaagcatacagccactgaattacttgttaatctaactactttactaagttgtactatacgtgatatgagaaaaagggtgcctgatttagttcatgagacgtttttgagatacaaatcatatttgtgctaaagggaaaaacaaaaaaccaaataatcaatgtgaagtgttgattgtaccttggctttggagacagtctccatgttactagcaaggtcatcgatctccatcttcatctcactcttctccttctccagcttctgcttcactcgctgcaggttgtcaatctgctccccaagctcggccacactatctgcatgcttcttcctcagggtggccgccgtggcttcatgctgtagggtggcctcctccaggtccctgcgcattttctggaactcagcctcccgcttcttgttcatctcaatctgggctgaggtggccccaccggcttcttccagcctctcgctgatctcctccagctcccgggagagatcagagcgctgcttctctgctttggcccgggaggcccgctctgcctcgatttcctcctccagctcctcaatgcgggcctgggaatggtgaaaaatattaatacgaactcaacttcttggtgtcagtaacttttcgatgttaaattagcctggcgaaaatcatttaacgtacttgtaactccttgattttcttctgcagctgcataccaagggcttgttcatcttcaatcttgctttgcagaccgctcatttcaaactctttcctattagaaaagccctttatgtcagtctcagaaatattaagagtaatttccccacaaaactgttgacctaaaactgcttactttttaagcttttcatcaagttgttgtttgtcattttctatatccattgtggattcttgagccaattttaggtctccctctagttttctctttgctctttctagatccatccggattttcttttcttgttccaaagatccttcaagctaaaagttaataatccatgaatatggttcttagaatggtagcaccttttgtcccagatgaaatttttaaacattatatctatgcagcaaactatttttctatgaattaggcagatttgtcccattgattccattctccttggtatttacctagtcgaaaaagtcatcgtttaaaaggtaaaatgtgcctctttgtcacgttgttacaataagttactagtgagacattatgccttctgcatctccccactggaatccaatacttttccagctgggatggacaccatgctaatacttccaaaccatgaacttttttaacgcctcccttactcaggcattttcagtgggttctctattagatatcagatcatgtttaaagccaaatttatcttccacattcctaattctgagtgtcctttgtttctgtgagagaaaaccttattgatcattacaacttctttgctgctgctatgctgccttcttagaacaccctccctcttctttctttttgcacatagccccttgtctttcaagcccagcgaaagacctgttttgcttgtatagcttttctttgtgaacacattaaccttcctttccatcaattctttttacccgtattgtctattattcacagttaactttctttattgattttaaaaactttattgtgtgtacatcttagaccttgtaatagggatgatgttccatattcctcattcataggaggcacttgataagtactcactatatcataacgacacaaacttatgcttacttagtttgttacaaaatttaaaaaatcatttttatataatgttaggcttacatcatccacttgttgttcaagtttgattttagctttggtcagggtgttgactttgtcctcctctgcctgcaggtcatccagggtctgctggtgggcctcctggagagccttcttctccttggtcagcttagcaatggtttcatccagacccgccatctcttctgtgaggtttttcacctacaaaggtgaagaaagcagcttagttgctctaaagcacctttgttgggtggcagaacctctatacagtactgtagaatatgattgataccttgttttctgtggcatgtttctccttctcaaccttggccagtgtcagctcaaggtcatcaatgtctttcttgagttctgaacattcatcctccagtttcctcttcttggctgtcagctcagcattgatctcttcctcatcctcagctctctcagtcacctctttgattttggcttctagctggattttggttttgattagctggtcacacctttcctctgcatcagccaagctgtcagcttcctgagaagaggcaatagatattttagattttatgaaaattcctagacattttcagattttattaatattttgaaaccaaacaagtaaattgttttaagccttcaggttaatttttattagctttctaccattcagtaaatattgggcacttatgagtccggtaataaaaaaaggaacttaagtcatagttcctggtgaaattatgttacaattatatttgttataacatatataatatgttggtatataatttcgggtcagccaattttctttatttaatatttattttcaggagcattcaatatatgaaaaaccaatagacaaaaggattgggtttctagcaggttgctgggagagaagggtactatcagaaaagtgccttaacaggaagaaatgtcatccagtgacagagtagacaaagggaatggaacatgttcaaggtgatgcttagagaagtagcaagcatatttctcataagaagaaataggagttgagataaactgtgagggaaggaccatgtctctcattcaaacttacatccctgtccgggacttcacccaatatttattagtggatagttgatagaatattgttaaacagaagttttataatactatcctcaaaggagaggagtattcttggatagattatctcctgtttcttgaaggcacgatgaaccactcctcaatgtggaaaaccctgatctatacaaagtacaggaaagtcacagtaccaacctaggtatttgcaattcatcatactttagattttctaaatatgtgtcccaaacttgtaggcacaatgggactagtcaattccctttctgaattcagagaactgggatggtaacttttaatgtttctgctgttggttttggtggcagcaattgaactgtcttgttatttgtgttacaaaaatgggttagatagtggcttttgatcaaatatttctctccaagcctctggatagttactgggacattagaataagaatatcaaccctatctctcatactttgcataaaaatagacattatctgtggaaggcattgccattatccttacagaaagcattgccattattcttgccataatcctactctttcaggtactaaaagtttctaaaaataaagttgagcacaaagttgctcggggattgtagatacaaaactcagaatattgatttcaagttaatgtgttttcatcaaagtctccttcctcttcactgacaatatttttctttttcacagctcttatttgcatttttcagtagggagaatttagggagcaaagctcactttatttcctgttcacattctgctgtagaaaacaacagaggggaaggaaaaatgcttttatttttcccttcttgacatcaaagaatcctaccacagtgatttttagtaatattgtatagggaattctatagaacattctaaggagttgtggattattaaagattcataatctgtcccttatttggtagaatctagatctctccttagtgaccactgagctgaagttttagcatcagattgcaggaaatgacttcgggatactcacagcttgaacctggagttgcaagtcatttttttcttgcatcagagtaaccattttttcttccagctctttcctttttgcctcggtcttagccagctcttctttggttttctcaaattcttccttcatgttggccatctccttctctgtctctgcacttttgaggaggggtttgatcttgaaatacagcttcatccagggccagtgcttcacattcatgaaggcacggacattgtactggatgcagaagatggactctctgtcataggaacagaaatgtccaaatcagattataataagaagcagaattaaaacacctaagatgatgaggttaagtaaagaattcttattaataccttctttccaccattttctggtactccactcttgccaagaaccctctgcacatggcctgggttcgggtaatcagctgggccagcttctcatctcgcatctcctctaggagccccagaagaccagctttgaaaaagacctatgtgtgggaagaatttcagatcagaaaatttacataaagttcaaagggacaggaatagcatcaggtaggatttacagaatattaccttggtgtgaccaaatttatactgggtgtggtcaatgtcaatggaccccaggagcttctctgaagccttcttgctatcgatgaattgtccttcagggatagcacttgcatttaacaccttgtatctgtttaagccagacaaaaaaatgatatggctgttgccacagacaagaaatcttcctgtctggctatagaaacaacatagccactgggtaatctgaaataaacaagaaatcatatctacccctttatctatcctctgtttattcaaaggacttcagagttttcttatgtcaatatggagtttgttaagtgagtttatcttctcttcaattttaagaggaggtataaaggattctttcattgaaaaatgtttaaaaagtaataaaaacctcttaaaataatttacagcaaaaatgtctgacctctgtttgaagtctgcataaaggattctgcttgggaagcctttcctgcagatgcggatgccttccagcacaccgttacacctcagctgatgcaggacaagctcatgctccatggcacctaaaagaatgaatccacatgccatacttcgtggtctatcacacacacactggagcttgtctggatatcagaaatgtcttaccaggagttttagtttcattggggatgatgcaccgcacaaagtgggggtgagtgctcctcaagttggtcatcagcttattcaaattctcctgtggaaccatgcgagtttatactttaaaaaatgtactgttttctacattcatatttatagacataattattgagatctatgacagtggtttaattctaatgaatagtatccagatgaaaattttcaaagagttatctctggaatttccacattcctaatatgtccccctgttttctgttggtgtgcattagaagcatagttttctacttgctgttgaagtgactgttcgctgctgtttaatttcctagtatatgttttaaattcactatgacactctaaatatatggaaatactctacccattctttttttgcctagatacatggtctgattttactactaatcaatgccttcctctaattctcccacttttttctttgtcttttcttcttcttcttttttttttttctgagatggagtcttgctctgttgcccaggctggagtacagtggcgcaatcttggctcacggtaacctctgcctcccgggttcaaacaattctcctgccttagcctcctgagtagctgggattacaggcacatgccaccacccccagctaatttttgtatttttggtagagacggggtttcaccatgttggccaggctggtctcgaactcctgacctcaagtgatccacccgccttagcctcccaaagtgctgggattacaggcatgagccatggtgcccagtcacactcacttctttctttacctgactttcacttgtatctgtgtgtctatcaaatgtgtattccttgccatagatatagagctgtgtcctcctacttattccacagaaagtggcctttattaatgcctattctgggaattggtagaaaactgacagccatgttaccaagcgtgtaaagttttccatcttttgaaaatcctggtttttccgaatatctacagcatcagttattagagatggaatcagaaatgggattgccaaaagaaaaatagacttttctttttttccttgagatggagtcttgctctgtcacccaggctggagtacagtgacatgatctcagctcatggcaacctctgcctcctgggttcaagcgattctcatgcccagcctcctgagtagctgggattacaggtgtgcaccaccatgcctggctaatttttatatttttggtagagatggggtttcatcatgttggccaggctagtctcgaactcctggcctcaagtgatctgcctgccttggcttctcaaattgctgggattacaggcgtgagcaactgtgcttggccgtaatttttttaaaagtgctatttattatcacatctggtttcttatttccttcttttgactcaggctccaattcccaccactgttctatcttatagctttcaaaatctactcatttcggttctataccaatgtatctttaagcacctaaatcacttggaggctcccaaagcctcaagcaagtctcagctttacttaatcctatcccactggagtcttttaagggttaaatgacctcattctcaggccccagaatcgaattttgccgtctaatactgacttctgcaattcgctttcatctctcctgactcctgtgtcttctgaatagtgaggtatctcttccaaactatcccctcttccaaactatcctcaagctccctaaaactcagtcttaccactaccagctgaactatctcgttgagtcacatcagttctagaatccttgcaaggttagttttttcccccacaccatagagtacatttaatatcctaaatctaattagacagagaaaatgaagtttgtaccctgaagagagcagacacagtctggaaagaagaacccttcttcttaccacctttctttccaccgccagcctctgaggggaaaaagaaagcaatcataggacagcctttctctggttatggttttttttttttgtttttttttgttttttttgacgaagtttcactcttggttgcccaggctggagtgcagtggcgtgatctcggctcactgcaacctccacctcctgggttcaagcgattctcctgcctcagcctcccgagtagctgggattataggcacctgccaccatgcccggctaatttttgcatttttagtagagacggggttttgctatgttgaccgggctggtcttgaactcctgacctcaggcaatctacccaccttggcctcccaaaatgctgggattacaggcaccgtgtctggcctctagttatgttttatacattaggtaaaagattaattatattgataattacctgcttccgctcccgttgccccaacaaagaggagagccagagtcttcattgcagacttctggtacagccccaccacagtctcattcagggggtccttgttcttgtcaagccagccggcaatgttgtagtccacggtgccagcatagtgaatcaaagagaagtgggcctcaggcttgcctttggcaggcttgggcttctggaagttattggattttccaagatgttgttcatacagcttgttcttgaaggaggtgtctgtcgccttggggaacatgcactcctcttccaggatggagaagatgcccataggctggaagaatgaaaagaaataaatgccacttgaattctgtctgcttatagaaataacatttaacattaataattatcccatctgagtaaattcatcctttaattctacagagttaacgaaaactcgttcctttggtcagaagtcattaacttcacaaatatttattgggtgctgatcaggagccacgtgctgtatcaggctctgggatatgacagagtaagacagatgaaggctgtgctcctgtggagtttgtgtctttaccccaaagacctgagagcaatatttctccaagtgtgacttgcgaattagctgcatcagaatcacttgctcaaaatgaggattccgatgtttcatcctacacttaccagaaaatatttctaggggtgagacaagggaaacctgcaattgtaccaagtattcttggtgggtctttcgcacactggattttaaaagcctctgctttaacgtacagtagtagaaattcatactttgaatgcagtaataatgactttaggatgacaaaaaacagtaagtaaaaaatattctagtcagtgcactttttgtaaggaaagatgactttaaatgtaagactttgtattgcaaactgtgggtaagtgttgtgttctggactctatagaaaatatttaatctccttttaccagaatatctacttcagagttggcaaaataaggaattctcctcatgtttttcacaagtagaaatatttagccattgcctatatcaagattttatgattttcttttaaatactgtacagcagtatgatctgtggtctgcaaaaagcaagccaaccttctcgatgagctcgatgcaggcagccaggtccatcccaaagtcaatgaacgtccactcaatgccttccttcttgtactcctcctgctccagcacgaacatgtggtggttgaaaaactgttgcagtttctcattggtgaagttgatgcacagctgctccaggctgttgaactaaatgagttgaaaatacaaattagcattcaatttataatgaaatcttctctttgaaaggggtgtttttttagttagccaaattgccctcttaggatggtatcgttttgtcctacctatacctacacaatgaagtttttgctgctgttagcatacttgttaaaattgtctcttcaacacctgtcaacaagctctgaatgatgctttcctatgcaataaaaaaaagttgtttggagctggaggccattattcttagcaaactaacgcaggaacagaaaaccaaatactgtatgttctcacatataagtgggagctaaatgatgagaacacatggacacatagagggaaacagcacacactggggcctattggagggtggagagtgggaggagggaggggatcagaaaaaataacttatgggtactaggcttcatacgtgggcgacacagcttacctatgtcgcaaaccttcacatggacccctgaacttaaaagttttttttttaaaagttgtttggtttttatagtatttgtttttgttagtcagaggtttcttaatgattatgattatgttgtaaactagctaaatttgctagatctgagccattatggtctgtatgttgtccttaataataaaaattcaacagctaatatttggtgaacatttactctacagtagacactatgctgagtgccttgtataagttactgcatttaatcctcacagctacctttgtaggtggtatcatttgctcatttcatgggtgaggaaacactattagggaggctaagtaacttgtgtaagaccatggtagtaagggtcatggcaggaaccccaacattttgatgccagagccagtgtttgtaactactcctagaacttgagtagacctgccctgctttattattcgggacacctacatagaaacacaattgaggatgcccttgtttaagggcattatcaccatacacaaaagtcaaaggaattctatgagggggatgaatctggcaagcatatgcgaagtgccagaagccagtcacaaagaccacatattatccgattccattataagacatgtccagaacagccaaaaccagagacagaaagtagattaggggtttctgtggcctagggggaggacaaaatagaatttcctgttgggatgatgaaaatgttctgaaattgttatgatgatagcatgtacctgtgaatatactaaaaaccattgaattttatactttaaataggtgaattgtatgatatgttaattatatctcgataaagctgttacttcaaaaaaaaaaaaagaagcagctcaaaatgattgcaagtaccctgtcattagttctcttattttaaaaagtgtggattgctttttctgttcctgcttgatgacagattattcctttctttccacgttggcttggaaatgtctggaagtgcttccgtttctaaaatttcatccagtttcaatcagtccgtacacagataaaagtttagaattgggacctctaaatgagacacatccgagatactgctgtcaagtggaggactgcagtagccctatttcctaagctgtgtagcaggtattcttccttaggcagacaaatttgagtttatttacgatgccatttctatactcaatacctgggtattgcagaggttatcctaataattaaacacatttcatttctcggcaaacagaatctcaaagtctttcttttaaagactttgtcttctccactgctatctttgattctattgttgccctcagtatcttactgtttactgagtgctgcctgcatgcttggggactgtgttaagggctgaaaattcagaaatcttgaaactagcagacagatctcagaagtgaatctgtgatctggaatgttaagtgctttacctacaggtcctagttgaatttgcccaatgatcaatcaggtacaattctcattattacacagctagtaattggcagagcaggagtttgaatccaggtctgtctcattccaaagttcacttcctttcacggtcttttggtgctctttcatgtgtcagttaagtttaaagtgcagctatttttcatagaccctttccataagtgactacaggcatgctatatgactgcagcaacaagcttgcttgttggaaacttttttggtacaatttttctgctaactcacatcaaagatctcaaagccagcaatgtccaagaccccaatgaagtactgcctgggctgcttggtgtccagctgctggttgatgcgggtgaccatccacaagaacatcttatcgtagacagctttggccagagcacccactgcattgtacaccttcacagataaagtttgttggtgttattaaagacatgtcatgaaggcctgggatgtgtgtgattcattgaggtcatgcacttacctgctgcacagtttgacctttggtgacatactcattgccgaccttgaccctagggtagcagagggctttgagcagatctgcagagttcagattttggagataggctgccttgtcagcaactgcagaaacataattcagatacctaatatgacttactctgggacccacagttcaaaggggcatagtattgagtaaataactttgtagaaagtctgtgtgtgggtacatctgagtatgtccatcaggagctcagctgtaaagaagacttgaattttggaatggacatttttgcctatattctctcattaaacccagatggagattcatttggtaccttcagtgccatctggctcagcttgctcctcacgctgcttttgcttgaatttcatgttcccataatgcatcacagcccctgtgagcttatagatggacactctttcatctgaagtaaagcccagaatttcaatggcactctaccatgagagatgagaagacaaagattagggcacaagagaatttatactgtatcttttacacacatatagatggctgttattgccattcccatgcataatggattttaaattaaaattcatgtataacttacatctgtagccatcaactcttcttggtcatcaatgctgggcactgtgatctccccttgactgacgaaggcataatcgtatgggttggtggtgatcaggagcatttctgggtcacagaattcagggcatatgttttacattagaagatagtacagtgacaatcttctagctatgaatttatttcttaccaattagatctggcttcttgttagacatgatctgataaaaaatatgatagcttctttcagcctttagctggaaagtaactctagacttctccagaagatctgcaacggatagtagacatcagattatggggaaaaattacacaatgtcctggagtgatttgaggacttgggatcattagctaaatctcactggcctcttgagatttcaactgaatgttcctgtgaagtaccacatattatgtctctacaaacactattgcagttcctcctgcctcctgggaaaaaagtgaaatatgcttggctcaagatattcacttctcatacagaagatccttgacatttggaatataattgagtcctgagactccctctgcagggtcctgtcgccatataatagagggactactaaaagcaacagtattaaagctcagactaggaataaatcacatatcctcaatccctggacaacttgtttacttctagtgttagttttttcttaaaaaaaaaattgaaatcattctgaggctggaatactttggacatgcccagcagttcctggcagttcccacagaagcattacctcatgactggagtgggtaaagcatactgtgggctatggataagactgacattaaccacaagcatgtttggcagcagactggtgctttacaagctccatgttcagcaggagctgcaaagtgttcctccaaaccaatatttgtcattcttggattctatttaggaggtcctgttactcacatgtttcaatatcagcagaagccagtttccctgtggtaccgaagtggatcctgatgaatttacccttgtaagtaaaaaaaatgatgttatacccaaagcttgaagtacgtagtggggatgccactgaaataattcagacatgctttctctggcatctaaaggcagagaagaccctttggcaaccaagagacttacaaagcgagaggagttgtcattcctcacggtcttggcgttgccaaaggcctccagtagggggttggcactgatgatttgatcttccagagtcccctgcaaaggcaagagcagtccttgcatctggggcttgggaatttcctacctgagagtcccgacagagcctggattctgactaacaatcagactcacctgcattttgccagaagtaacttcttccttcttcttctccccagtaactgcaattgttgcaaagtactggatgacacgcttggtgttcacagtcttccctgcgccagattctccgctgtcaaagaccaaacgtatgagaaattaagcactgtgacaaatgaaactacaactacctcatggctttgtctttatatctctattagagagccttttacatctttcttttcagcctacatatagctcgtattatttcttttgctttgcactggcaagaagtagaaaaaatcagtcattgttcatttaacacgtatttcttgagtgtttataatgtgtcagctttttttctgggtgctgaggcctgggcttgaggggtctgaaaagcagctactcagcacctctgtagtgaatggaacaattagtaggaaactctatgaaacgtgcatgtgtttttccatttcctcggactagagacatggctcaagtttggtctttgaaggaacagacattctctaagtgggccttaaaaatgaaccactagtagtatttccaaactgttgtaccttttgaaggctgtatgctgctcattgcactatactgggttccagcccagctcattttacactttctacacaccaaaaagttctgtggaactttcaagaccagcaaatgaggtgatttagaacattattattttacattctaatgcaatgtaaaccttataataaagctaaaccaatatctagttccaggttgatcattcagtgctttagtagagaacattaactaatttctttttttggtttgtcatttttccagtaagaacaaactgccaataaatctcagaataggaatacatacgtgatcaagatagactgattctcccgatctagaagaaaaacagtggaaaatcagcatatgtatcagttacacaaacaaaactttctatagtgaaacagggcatttgagtataagtgtcatgtattcagtggggtttttcaatatattatggtaaagttatgggtgtgtcctgctggtttaatataaagagcagtattctccaaagctagatacattccgtagttgtcatctgtagatttcaatggcatgctatctgctaattaatgcatatagctgaaaaatgcataatatgctaaaggcttggactattatttaatagattgaaatagtgttaatcaagccatgactgagattttgtttctaaatgtgtcagatgacttcacaaagagaaaaaatttactatcttatggccacagactaacttcaatatagccctaacttcgatcagccttccccaaagtgtaccattgtgttaaagaaagatgaggtaagagaggatgcctcaatcaaaataaaatctttctaaggggggaaaacaatttctgtttatatgtgtgtagccccaaaacatcatcttcattcaaacagaggatattatatctgagatgtactctgataactttaaagagatgacagtacttgtaaaagaatctaatttataattaacaagaaactgaggcaccaaaaggattgaactcctatttttcatttctattcagataatacatgatttatatgattcagttgttacttaatcttggctcttattacttaaatatataaaataaattgtgtgtttccaagcaaggagaccataaacaaattaaacttaatgggatggagtaatagcatggcctagtaaagtcagtgaggtgtaatcaggagagctgtgttttaatacgagctttgacagtatatacttctctgtgctttagtcacctctgctgaacaaccaggggcgtgaattgggtttttttctaaaggtctttttttagttctaatattttgtgattatggatggtaaaataattcatatgaaaaccagctgagccactcaccagtcagcatgaactgataggcattgtcagagatggagaagatgtggggtggggcctcctggcgctttttgcctcggtaggctgtcaccacctctgcattatacactggcaaccacttgtaggggttgacagtgacacagaacaagcctgagtaggtctgcacccaaaacaaaagggaggaacagaattatttgatggggaccttaatcatctactacttttcaaaaactattaactactctcatgagtagaagaccgtgagaaagaactcacgtagatcatccaggctgcgtagcgctctttgaggttgtacagcacagcaggctcgtgtagatgagtcatcatggccatgtcctcgatcttgtcatatttgggagggttcatggggaagacttggtcatctttcactgttacagtctgtccagtcaaacaagagaggccagatcaaaaagtaagtgctaacttaacccaaaatgaggcagagtctaatcagctccaggtgtttttactcacagctccagcttcggtcttagctgtcaccttccccccttccctgctctgcactgttgctttcacaaaggactccttagggtccaccacaaagactgatgtcttggcatcaaaaggcttgttctgggcttcaattcgctccctttcagactttcggaggaaaggagcagcctccccaaaaatggccatctcagagtcggaactcatggctgcaggttattgatggtagcccagttaaggaccctggctgggagaggaagaaaagaaattgtagaaattaagaaactggaccattagattcacatttaaaactttaaaaaaaaatttactgaccaattgagtgcttagcattgcattgggtatgaccacctccctggcttggttgaggataaaatgtcagtctccttgttctgtgccagtgctgacagacacttaatcatgcatttggaaagagactgttgtttctggctcacctattgcagtctcttagctgctttctctgtttcatttgttaggtatattaatctttataagctgcctatcattggcttatagagaacataaagctataatggtggcaggatagtctccagttctttcacttatagtttttatcttcccaactggattataagcaccttgcaggcagggagcactcttctttttatggtatccttcacacctcttagaacaaatgctggacacagagaaaggctcaaagctggcttggtgaattaaaagaacaataggaatatgttgctataattttaggaactattctgtacatgacagaaatattttcattataaacttgggagttacgaagacttcctaatatacaggaaagcagaaatgtgtggctctttgttttgcattgttaaaaaatgttctgttatccatcaatttctgttgtctctgtataataattttgacaaactcaacttcttcactgatctttagcatttcttaaatatttattataaaacgttattacctatgttttcttgctctattattaacatttttataacaatttcacaaaacttgttcttttcaggatccccctcttgccacattagctagcattcattaatgctgtcaataatcttcatgtatattctactttataataataaagataccttttccagggaagctcatttggatacatttctcccattgaaactatgttgactcagataacataattaaaatgcttcatcttgctgaatatgctgacaatcatgtttcgtattgtgtgtgtgtatatatacatatgtgtgtgtgtgtgtgtatatattcgttaatttttattttatagattgtgaaacaacatgcagttaagcaactttttccaaggcaaagattcagaccattctatttatccaattagacatcatctctcataggtttttatatttatagtgctgaggaaaagccatggtatagaaaatttaaattttctctataattgagtaacactttgaaatgttacattgcatattgtaatgcagtcatttaaaagataaactacaatgctggaaatagtgaatgaaattcactattgtgaataaaattcccaaggactctgagaaagcattttcatatattgcgagggatatgagttaaggagaaccagtttctaaagtcattctccattttttaagagaagcgtgatcaaccatgaaatggaaatgattttttttatcacttccctcaccccgcccctcaccactgtccaaaccactgcagaagattccttgcactctgtgaggaatgagaaaaaaaaaaatcagaatcttaccgtagagatgcgaccttaaagtggatcagaactgtaagaaaaagagcaaacctcttctgattaaattataacaattcccgattatagaacaattcttaactgagaaccaggaaatgactgggaagactacaacatctaattaaaattgctacggagtaagctggtgcttcactggcagggctgccagggacagtgggagccaggatgtgtggcatgcacgcgggcagccagacatcccttaccgtcctccagacagagccctgtcctcacacacacttaccttgaagctttatgaggagagacaagtcatactcattccaagggtacttttataggctcaaatatggaaaacacgtaacctcctcctctttcttaaaacatatttggcaaaacatgtttttggcattgaaggtctccaagcctaattcccctcatattaaagatgtttggatataattagaaatatttcctctcatattgggttaagtatatgaatcaatctcctataaataatttgagtcgttggcaatcttaaagttgttggcctttggaatgtaaggtgttgtttcaaagacagctaagttctggaatccctggactttgttgcctactgctcttctgtttcacagagtcgcctgtgtgaagtcttttcaactgcctgcgcagttacagatagtgtactcgggaggaaaacttctgctctttagcagagggttataaaaacgttgctttctctcaaaaagatttcctttttttttttttttttttttttgcaatttattgtgctttttcaaagttgcttggaaatttaattttgaaacttgcttcatgaagagcagccaaagatagcttcttttgtttccttcaatcagtcgcctcttattcattgtcaaatcattccaccggcacttcggacttgctccgaaattgcattgccttccaaacagagatgtcctgcttctctcatttttttttggtgcccaagttgcttgtgaaatcttgtttcctctatgaaactcaacataagaaaatattggaaacagggtatttctctgtctaaatatgcagcatcgatgatttttcctctatcagcagtccatgggatatatttagtattttgcttacaaacaatacctgaatattgttttctattttaattttttaaaaaagtttattttactgtctttgtggcctcacgtctctgtctgtcagcattgtctggctaggactgggacaacatttgcttaatatacctggttttgcacccacatctgtattattgtacttatatctcaattgatttaatggctatagcttgccttatgaaaggagatatctggatatactagttgtaaaggtcacatagttttattaccataagggatcatctaattcatctttctcattttactaataaagcaactgagatccaaaaaatagaagagaatctccacaaatcacacagcagtttagactctggtcatctgacttgcggtccagcgtactcacttgtgacactcttctacctggggtagattaaagccatcaggaagggtattgcagggatgtgcgtctgagagggcctttcctagccatctattagcctgctttgttaccacaggtacctaattttactttcttacatgtctgtttctttactaggcacctgcaaaatgtgggtaatgattttcaggaagataaaacattttaataatgctctcaataggatctgatgggaatcttcagacaaccttttgtcttgctctggataaacttttcaataagtaggaagtaagatattgtttttgtttattactgccacgttataaagcacttaagcaattccacgtgatacaggaacaaagtgaaagaggggcttatgcagcgagaagagcaattccacaccctttctaaggccagtgcgacagtgtgaatccaacttacctgttaaactaccatgtctaatttacatcattttcacacagtgccatttagaccaagatactcttgctttctatttgatgggaagttaccatttagctcttcctttattctgtcgaggaaggttatatttttggctatgcatctcagctgcatccagtttaaaaatcttgatcctctaggaaaacgtctctgagtggtccagattgctatgatatctactttttgtaccaaactcatacccatcattatgtgtgttgaatatagatttgaataacctactttgagatcatattttcttgacacttttagtcatttattttggctctttatatgattatctgggagaccataaagattggaaacataagctaatagctcatggatactacattataacgtaaaaataatattctctatgtctccagatttgatagacaccctgtagttttcatagggagaagagtcatatttaatttaattttgaaacttgcttcgtgaagaacaaggtcgtgtcaaacccattacccagtgcacctactgtgggcatatggtacattggaattgataatgtaaatatccatgggctaattaagaatattttgtatttatattcttgataacagttattcaacaaagagaattaatgatacaattcagtttgaatcccctatgtgagaatatagctagtactatcctgaaaaaggttcatgttaggggaagcaggagctttctaagattttactgtactcagatatcaggaaaggttagaaagaaataaaatagacttccaaatttctgttcattagaacagtctttctggataagtgacatctttacagccttaaagtgttgccgtagacccccaaaaaagtcaccaattgaatgtgattgtttgacaactctggtgactattcaaactttgacatggcttcaggaaagagaaaagacaagaccagtctaaggatattgtttgcaaactaccctatgctttatttcctttgcaacagggtagaatacacaataattacagagggaaatgaccaaagatgtcacattttgtgcctgtcttcagtcattccatggcatcaggacatgatcactcttcacttatgacttttgtgtgaacctcccggctcttcacccgcagtttgttcacctgggactcagcaatgtcagcccgttcctcggcctcctccagctcatgctggagcttgcggaatttagctagattggtgttggattgttcctcctgagaataaaaatggaattgtaaggaactcatacttgcatctttctagactctttagacctaatagaagaaaggacttggcatctatggagaagcaacatctagggattatcattgaaattaattttaagatttgtttattgatgtcatatatatatatatatatatacacacacacatacatacatacgtatctcacattcctattttggcaaccaaaacacataaaatatatgtaccacaagtagaataagaagaaaaatataagcttagagaggaaggcaagaatattaaagtcatagttgttaatgcttgctataagatgatgattttcccttgagttagattttttttatcatattaagaatgaacttattaagtttttaaaaattgaaataaatattggattttgtcatgtatcattttggcacatttcaaaatggttacttttttcctcctgcattggatgtaatgattctattgacagataacctaatattaggtaatctttacattgtaagaattaaccttatttaatcactggaagacaattcctttaataaagtaagacttactacttagtaatttatctttgctgtaactgtctttatgagtaaaattgcctttagtttttctccctctgtcctctcttgggcaggttttggtatgagggttatgtgagcttcttaaaatgaactggacagctttctatcttttcccatgctcttgaacagctacatagctgggggattatctgttccttgaaattttgaaagacctatctggacttgggtccatttccagaagtaattcagccaacttagtaatttatatcctcctagaaaaatcatcaatttttttcagggtttcaactttattgatagatgtgttttatattaaaaaataatcctctatgtatatagcttattccctttctcatttctaatgttgtttatattttctctcttattttccttgatgaaactagttataatacatttattttattaattccccagaagttacaaatattactgaagttatcaaatagaaaatagtatactctaattcaccaatttctacttttatttttaacagtacttcttacttctactgttttattattatttataatttatttattggactgtctgtttgtttatttttacttttggttcataatgaaagcatttaaagcaatgaattagcctcctagcacagctttgactacattctgtaggtttgtaaaagtagcatcttccttgtgattttacttataattaataattatttagtaattatgtttttatttttactttaaaccaagagttatttaagaaagttagtttttttaatatttaagtactcaagaatttttgcttatattttgtcatcactttacaactccgtcatactgtggccggagaatatggcctgtattatttctgcttttaatttttttcaggattcttggtggattgaaagtttacttttaaaatgaagctactgatattacaaatgatacacaagaattattgtacaaaaacaaatgttaaatatgcatgcagtagtctttaaagcaaacagcttgttcactacaagaagtagtaattatttattagcttaatttgaggacttcaatcttaaaaatacttacagcctcctcagcttgtctcttataagatttcacttttgcctgaagtttatctaccaaatcttgaagcctgagaatattctttctatcttcttccgtctgaaagattataaaaagtccaggaccttaattactaaagcacatgactattgcatcattgcatatgagtatttcacataaacttcgaccagtgcttagccgctaaaaactactggctgtacctggtaagtgagttccttcactcgcctctcatgtttgcgcagacctttgacagcctcagcattacgcttttgctcactctcaacctctccttccagctcccgtacctgcaaataagtaggctcttaagaactttgatccaataaggcactgaaagcagatggaaatagacagatattgggagacccaccctggcctccagtttctggatctgcttcttcccacccttcagggccagctgctcagcctcatccagacggagctgcagatccttcacggtctgctccatgttcttcttcatccgctccaggtgggcgctggtgtcctgctccttcttcagctcctcagccatcatggcggcctaaatagcaaataaatcaagaaaaccaagaaagttatagatgtcaggaaatcttactgctaaatcagtggacaagtgtgcctgccactcacatcagtgatggccttcttggccttttcttctgcattgcgggcttcctggagaatgtcctccatctctccttgcatttgggaaatatctgtctccagcttcttcttggtgttgatcaggctggtgttctgtttaaaaagaatttgtacatttaaaaaattgtgttaccaaagtatttattggtaaccacttcttgaaaaaaattcagataaaaatttgcaagtcaaaaaatgccttttaatattaaagaattaaaggattgtgttatgtaatatgattaaataaaatataaatgttatagaatattcagcatcttcaagtgtataggtcacaagcagaccaagtagctctataattttataattatcatttaccaatagaccattcacagggataaaagtataatggactttctcataacattccatttctccagaatgaaatgtgaatattgataatgagggccaataaagatattaacacaatagaatacgggggcagccttagaatattatatgaagcaaatcaacaatagtttttcaaagcaaaacagtgaaagatttctcagtaatgcagaattactattctgtattatttgaaaagaaaatttgatagacatattaggtctagctgtcttatgaaaactcaggcttatctattctgggacatataaaatttactaaggagagttctttgtgctgaatcccacctgggtgtgcagtagctgaacacgctcactggcatccaggagctcctgttctgcgatttttctgctcctctctgtctgttccagagtggcccgcagctcctcgatctcagcctgcagcaggttggctctgcgctccaccatggccagctgttccttcaggtcctcctggctccggagagcatcatccaggtggatctgggtatcctgtgaaacaaaccatcattgagacatcatgttctcagggttgcaggcaccccaatagtcctgggaccatctcttggacatatttaccttgaggatgccttgggtgttcctgtagttcctcagggcctcagcagccatgcggttggcatggttcagctggatttccatttcattgaggtctccctccatcttcttcttgagcctaatggcatcattcctactcctgatctcagcatccagcgtgctctgcatggactccacgattctaatgtggtttctcttcagctggtcaatttcctcatctttttcagcaattttcctatcaacctcagacttgacttggttcaactcaagctggatgcgcaggatctttccctcttcatgttcaagagatgccttaatgacagcaagaggtgacattagcaaggaaccaaaagctttatgaagtttttctgcacagcaataattttgtgctatgtgtctttttattcactctatgcagatgtacctaattattttccagatttttttataatgcacaattttacatgtacctctgcttcttctaaagcagcctgaagttcacacttttcttgttccacttgtttctttattttctccagttcatggatacgtttccctccttctgcaatctgttccgtgaggtcagaaatctcctctgttgtttgagtaaaagacaggtagggatttggttaaacatgtgacataagggagagattcttccaagttatgaatattattgaatatgatagggacttacgctgtaagtttttgttctctcgcttcagggtttctagctgatccaaagattcctcataggcattctttatcttgaacagctcagtgccaagggaacgggcctccttctgggaggcctcaagctcagcatgcgtttcctcacatttctgtttccattctgccaggatctgaaaaaccaagacctgttacctgctgcaaagacaaaagagtagagtaaagagcagaagatgctggaggaattaccttatcgaagttcctttgctttttgtcaagggcggcacaggcggcatttgtcctctccacatcaagcatgaggtcctcgacctcattctgcagccgctgcttcgtcttttcgagggaagcacatttggcgttcacagcttctacatgttcctcagctgcctgcagccgctgggccagcttcttccttgaatattatacatgttttcagagagaagtgaaccataatatgaattatgagctattgccacacacgctgaagagtgttagaaacttcacattaatgctgcccagccacctttcattctttcaacaaatattgatgagccccttttatgaaccagacactggctacgcagcagtgaccaagacaaaaaagatctctgcttcatgaagaccacaaacaagtgagagaggtaaacaataagcaaatcagaacatccgtaataataccttacagatacaagtgcaatgaagcaaaataaaataaatggtgggcaactactctagatattcagtgaaggcctccatgaagagatatttgagtcaagagctaaaagtcagagagccaaagggaagtctgtggagagggtatttcagacagagagaaaagcaggtacaagcccctgatgcagcgatgagctcattgtgcttgacaaacagcaatgaggcccctaattatcagtgtaattatttgctcttctttgttttcttaactagattttaggatcgtaaggcagggaccatatttgatttattcatgtcttattctcagggcctgattgtgactggcacataaaagcagattaatgagcatttgtggactaattcactgaatcttcaaaggtcatgtctttctgattcaatatgcaaagttttctgctcattctctcatatctgtgcacatacttggcctcctccagctcctctgtgcgctggatggcgtccgtctcgtatttggtcctccattgggcaacctcggtgttggccttggacagtgctctctgcagctcggccttggattcctgctcctcctcatactgttcccgcagcaggtcacagtcgtggcgggaagactgcagggcatgcgccagggcgttcttggcctatggaggcagttacaccttcattttactggatatttaaatatttaactcttaactttcaaaaccttttgaaagctggtataacaggctccatgtagaatcagctcatgagggaaaaaatcagtcttagaatcataattacttttatctcctcttcaagttgcctctttaattcttcaatctgttgagtaaaggcttgtttgcctcttgataactgagacaccagagcttccttttcatcaagctggcgtgaaaactcacctgatggacaaaagaaatggcaccattttttaggtgaaaaacaagattctgcaagcccatgttagaaagaaattttgactcttattttcccaaattgagtgctcagatggttgaattctatactgacatcttcatgctcaatgcaggttttcagtttttatggtgaaactttcagatcaatcggaatgaataaatacagcttaaattccttttgtcctttccataactaattctttcagaattatatgatattgtgcaaaatctggtgaggactgtcaaatgagtaagctaaaatgtctaattctacagggtccccattccataggacttttgagagactgggatattcattgccccattctggaagttacttgaccctcatataaataaagagaaacttggcctgaaagagaagccctgaactcatgctggagtaaccgctaatcccagcatcctcgcaatgagcaaatactcaaggccattctggaacagagcttgattttgtcctattgaaacctttatctccagcattgtcccaagatgaccttgcacataggtcaggtgtctgagctgttcagtgaatcagacatgttctcagctgttttattaggctcccacttcaccaaatcagtccgttgttcttaatcacatcctctccaccctgaagctgcacagaagaggggagagttaccagattcagtctgcaggcgccccctctgcgcagtcaggtcattgatcagccgctgctgctcctcttcctttgatttcagttcactcagttggtcctctagagtccggcacattttctctaggtttccctatagaagaaaaagtaaaagaagaaaacagagaccttttaagcgaataataatcacctttgcagttactgtaacttctccccaaaataaaaaatacaatatttatcttaatatagaaaagaaaccaaattatcttatatgtaatgtaatgcagaaaaatttttctttctttctttttttttttttttgagacagagtcttgctctgtccccaggctggagtgcagtggcgtgatctcgactcactgcaacctccgcctcccgggttcaagcgattctcctgcctcagcctcctgaatagctgggactgcaggcgcgcgccaccacacttggttgacttttcttatattttatgaaagctaatcatggagctctgttcaatattaatatgaaaatgttaaggttatattctaattttaagattttgttagaattgtatagtgtacattttctaaaagcatgttctaaaatacttcattgcctttatgtacgatgaaactttccttatttcaatttccttgaaataattggagacctttgttctataactggagacttggagaacacagatggcttatgttcaaaagctggtgttgtcgtttattaatggcgtgatgggtcaaagtgcttggcctctttgaatttctgatcctttatttgttaagttgaaataataaaaaatgctgattttttgtgcttacttccctgaattactgcagttaacaaatgacttaatgtgtaaaaagtgccctgtgcaaactatgatgtgtccataatgcattattttcaataacaatttcccagaatttgtagtaccttggctttggagaccgtttctacattactagcaaggtcatcaatctccatcttcatctcactcttctccttctccagcttctgcttcactcgctgcaggttgtcaatctgctccccaagctcggccacactatctgcatgcttcttcctcagggtggccgctgtggcttcatgctgtagggtggcctcctccaggtccctgcgcattttctggaactcagcctcccgcttcttgttcatctcaatctgggctgaagtggccccaccggcttcttccagcctctcgctgatctcctccagctcccgggagaggtcagagcgctgcttctctgctttggcccgggaggcccgctctgcctcgatttcctcctccagctcctcaatgcgggcctgggaatggtggaaaatacaaactcagcttctttgtgtcataactgcctccgagccagactgatgaaaatcatgtacttacttgcaattctttaattttcttctgcaattgaatgccaagtgcctgttcatcttcaatcttgctttgcagattgctgatttcaaactctttccttttagaaaagtagcaaaggacaacaatttagtccgtatctaatgttggaagcaaatccataagcaattctttcttacttactttttgagcttttcatcaagttgctgtttctcattttcaatgtccattatggattcttgggccaacttcaagtcaccctcaagtttcctcttagccctttctaggtccatgcgaagtttcttttcttgctccaaggacccttcaagctaaatataaattatgttgaatcagaaggaatgcttatcttcctttagaagaaaagaatgtccttgatgataccagacttacatcatccacttgttgttcaagtttgattttagctttggtcagggtgttgactttgtcctcctctgcctgcaggtcatccagggtctgctggtgggcctcctggagagccttcttctccttggtcagcttagcaatggtttcatccagacctgccatctcttctgtgaggtttttcacctacaaaggtgaagaaagcagtttagttgctataaagcacctttgttgggtggcagaacctctatacagtactgtagaatatgattgataccttgttttctgtggcatgtttctccttctcaaccttggccagtgtcagctcaaggtcatcaatgtctttcttgagttctgaacattcatcctccagtttcctcttcttggctgtcagctcagcattgatctcttcctcatcctcagctctctcagtcacctctttgattttggcttctagctggattttggttttgattagctggtcacacctttcctctgcatcagccaagccttcggcttccttaagttggaaacaagatcaaaattgggaagaaagaatgaaatacttcacaatggataagagtgtatgtttctgcatttgatcttttgaatttcctatattcatttgtttactccttcacaaatttttgtttcatgaaccaccctactgtgtacattttccacatgtgggtaagccaaaatgtaccagttgtcattttgttcccctaaaagaatgtattctacagtagattagaaaacctatttcccaaaagctaccattaatgtagaaagcaattagtgacataacagatcagagaagttggatcagagatggtttcatgaaagaattgctgtttgatttgggccttgagagaggggtaggatttgcttttgcagaaatcaacttattgtggagaggagcaggagggttgtggggaagcattctagcaggacaaattcaagatacagctgctactgattttttttttttgtagtactggaggatgctcctgattatgatgtactaaattcaagttgaaacataaagtaatcaagaaattcctggcaacctgctgtttccaattaagggggacagggcaggcgggaaatgaaggagacactggaatatatactcatcagtaatcctccatatcagtctttgactacattaaggaatgcagggtgctatgtataactgtgtaacgaatacagtggtttagtacagattctgcataaatctctggggacaacagaagagaatacagggtagatttggagggctttttccttctgtaatctagaaggagttattatactgctcaacgttgacagagagaccagtcttaacagaaaaaaatatgactttatgataagtagaccaattcaattcactccaaataaaacatagtcttataaattatagtctgaagttgatggaagcagttctaaaatgattggttcaggagagggcagtgagcaggctggatggaagaagagacaattgggaagtaggctgagcaactttggtgctgatgcagcaatgtgggtgtgacatgatgggacactgactgtggagacagattagaaagagggagtctgagtttttgagatcaatatcacacgataattcagtaaaatttgatgagagtgctgtcatatgtcagctgttcctattataatttaagacccgtggacatctagaagttcaaggaagtttccgaaaaatattactctctccatgctatcctccccttcatattttatttgggattgtgtcatattaaaatcatttttatggactgtatttaaagagaaaataagtcaaaaatcttgtggtttgatgaaattgtgtacaatggaaaatgagggatatttctacctcactgccctggtgctggtttgttgggggttattgggcaatggaggaatgtttggaccttttcgtgccattggagtgttttaaccttttccttccaatgagtgtctcccttgcaattacccaactcatggcccacaatggccaaagttctagcacctgcatcctggttagtgataccaagggtgatattccaactcacagcctgaacttggagctgcaagtcatttttttctttcaacagcgtcaccatcttttcttccagttccttcctttttgcctctgacttggcaagttcgtctttaattttctgaaattcttccttcatggtggccatctccttctcagtttctgcactcttcaacagaggcttgatcttgaagaagagtttcatccagggccagtgcttgacattcatgaaggatctgatattgtactggatacagaagatggcctccctgaaatttaattgatgcaaattagtattgtgtggttgatgcaatgggatgaaaccttggcagtgagagttggaggttctgcttcaccttgttcctactctgctttcaaacatgcagatgaaaaaattctatttcgggatgatggtcaaggtcttgctaaggtcactcatttctctacatcactgcttctcaaactttggcatgcataagaatcacctgaagggcttgttaaaatactgactcctgaacctcacctccgtagattcagattcagattcagaagatctagggtggagcctgaaaattggcacttttaacaagtttgcaagaaatgctgatgttgcaagtccaaggagcaccctttgagaagccttgctgtatgtcagtgcttctcaaacattgctactaaaacaccactaagggcagtgaagggggaacacagctctttaggggtatatggggcaggagatattaaaaactcagaatttcttagaaaatatctggctttatatgttaatgttgtgtgaattttgtattctattctctaataccacttttgttttcatctaaatgatttttacagctaattaccccatatatagacaattacccaaatatatatatatcgtggatcatgaccaaaatttattatttttaataaaatggaatatagttgaaaatattagcataattacaagtggtaaaaataaaatttgcttcatataaattatttatatatctgcatacacatatgtatatgtgtagatgtataggtggcaatgtaaaatgcctttctcaacatggagaaatggtcctgatcacagacatcctgtactttgagacacctggctctatagtctttgaactctgtccttgcatcaaattagatcaccaaatagctacattccctgatgcattgtgttaacttactgcaaaaagtctttcacagataaatggcccctaatattttaaatcatgagagtttgataatataaatgatcagagggaaaaagttgtctctacagcctgtgtaaaagcactcttgagtatactgtctgttttgcaggtcaatgtcccttatctaatgatctgtccaataaattcatattagaaacaggtgctagggcaaaagtttgcttctgcttactcactggtgtattttatcttattagataagaagtacacacttcttacctaacttctcaagtttttacccatgcaatcagatggtgatggttccttccttaagttttctggtacatgtgtattcccacttcattataggactcttattcatttcttctttagtgtccttatcataagctgagtcttaactgtaagccatttcaaatatgtttttgaagatggaatatgtgaataaacatattttttataccttctctccaccatcctctggtactccactcttgccaagaaccctctgcacctggcctgggttcgggtaatcagctgggccagcttgtcatctcgcatctcctctaggagccccagaagaccagctttgaaaaagacctgtgaatggaaagagttgcaaatcacaagctttaataaagttcaaagggacaggaatagcatcaggtaggatttacagaaaattaccttggtgtgcccaaatttatactgggtgtggtcaatgtcgatggatgcaaggagcttctcagaggccttcttgctatcaatgaattgcccttcagggattgcacttgcatttaataccttgtatctgttgaagtacatatagcttttaacaactagtttactgatgacacaaatgctagctaaacattaaatgattcattttttaaagcagagctttaaaaaaatattattctttgttcacaaggagaacattgtttatttgaatggtcaaccctttggcaaccaatttttattccatttgcctttccctcgcagttgcaactttcctttctgtctcatcagaccctgttcttagaaaagggttctgccttaagaaagggacacattatggtgtgcctaaccaataaaatgtaatctgttatctttactagatgcatttgctttttaaggccctgaatccaagaaagctacttttcattgaagaatttggtagacagtacactttaggtattcagaactatcctaatcacctaaaatcaaacttagacatgctttggatcttgagccctggaatcctctgtcagtgccacctgacccagacctgggagagatcagctcctagcagctgctacccagtccttccccacctctgccttttctttgattctcaagatgggcttatctagagaggagaaaagggacctgaggaacagtcattgtgacatgttccctctgcctccaggaaaccctgggagtctaatatgtgggagaaaaagacgaacatagatgataccaaaggaaatgacagaaaatgaatagctatgtttgtatggaagagtttctaactcaaccacttaataactgtgactttgggcaagtaccttaatttccctgagcctcagcttattcatctataaagtgaagtcttaatagtacctacttgcactgtgtttttgcgaggattaaacaagataatctgaacatattaagcactcaaaaaggtcgttcttaattattattggagttaacgtgtgcatctatgagctaagctaagtgcctgataaatccaatgaaaattccacaaggtgcttaaaattttgtatatttatattttaaaagtatttgaggctgggcatggtggctcatgcctgtaatcccaaaacttttggaggccaaggctggcggatgacctgaggtcaggagtttgagactagcctggccagcatggtgaaaccccatctgtactaaaaatgcaaaaattagctgggcgtggtggcatatgcctgtagtcccagctacttgggaggctgaggcaggagaatcgcttgaacccaggaggcagaggttgcagtgaactgagatcacgccattgcactccagcctgggtgacagagcaagactttgtctcaaaacaaaagtgttcgagacttgagacttgtaatttttttacttctttttgtgacaaaactaacaagtagaggcatatgtttcactaaattgttttgcttgcattaaacttgttcatattaaacttcagaatacaccataatcaggagaaactgacctctgtttgaagtctgcataaaggattctgcttggaaatcctttcctacagatgcggatgccttccagcacaccgttacacctcagctggtggaggacaagctcatgctccatggcacctaaaaatgcatatttatttcactgcagagctgttgaaaaggaggtgtggcagtcatcctttgcactttcattatggaatttcttaccaggagtttttgtctcattggggatgatacacctcacaaagtgaggatgggtactcctgaggttggtcatcagcttgttcaaattctcctgtaaaaccaggaaaaatcctgtcattttaggctctagacatggatatgagcagtcattggtgtctataaaatcaatatctatagctgagttgaatgaccagtatggactgcattcatataaggcaacactttgaatgcttcttctgagatgctttttcctcctcaatagatctttctgcacttgagtttccgagagttacacacagaacaaggaaagcatcctggcatgtgcttcttttcagtttatgccaacaccatcctttctaccctggtccctggccatacacatacatttacaaggccattgccttcccatgcgagatgatcgctctttcttctaccaaattccatagttctccaataaggaaatggaagcctgcaccacatttggacgttttccttataatacagctcctcttttccagctctatcaatttttaggggatagagattatctacaggggagcaatcctaccaattataattgaaaattgactcgattaagagcaaggataccatattagctgcactgcagatttgctgctagaattcatgagttcattagccatactgatgtcttttagtctctctgagttcatgtcattgctctttttcatggctcagctagattatgaatggcagagtattatggtctataagattttctataaaatatttctcattatttgacttagcatgaaaagtgaactaataatttctgagtaatttaaatcccttctttccaaagttagatcaacagagtcactagttactatcagtccttttctaaactactcatggaatgatcttgtacttttaaaagcaaattttatgcattgggtacagtgtacactgctctggtgatgggtgcaccaaaatctcagaaatcaccactaaagaacttatgcatgtaacccaacaccacctgttccccaaaacctattgaaataaaaaataaatttaaaaaaagaaaagacgaggggaattttgcccagcgagatgtcaaagcatattacaaagtaattttaataaatgtaatgtgatattagtatatgaatagataaatatatccttagaacaaaaatagaagttcagaaaaacagacccatgtaaaaaaaatcccaaagtaattggagaatgtcaaaaacaatttcttccttactctgaaaagggcagacactgtctggaaagaagagcccttcttcttaccacctttcttggcccctccaccagctccctctgaagaaaaaggaagaaaagaaatactgttttgaattggcagggctacttcttgcgtatttgctgatttctgtgttcatcgagtggagccttttttctacccagctggcctctctgattgagcctgaatgaatcttatttttcaactaagtttgcagccacttatctgtgattctttctccagtgggaaatgaggccagggatattcacctgaccgtatagagagggattccctaatattaggacatgtgaggagctaacttcaaaaatcatcaatagaagctagtactgagaggtggaagtttgtcactctgttgcctaagatttataccctcagatactctatatatcctgcagatgtggaggaagaagtaggagagaatcgtagaagctgaggcttttcattggttgagagcctgataatcctctctgactctgcaatagggctcctgtcagcagtggagtgagccacaaatgtataattacaaggctgcctatctattcaatacttggaggaaccaggggcttggtctgcaacccttctgccagacctaagagatcactagcttcaatttaacatcacattttgtaatacctagagagtattattaacatttgagcattacctccttcagcagtttgagccccagagaagagctgagctagagttttcattgcagacttctggtacagtccaaccacggtctcattcagggggtccttgttcttctccagccagccagtaatgttgtagtccacaacaccagcatagtgaatcagagcgaagtgggcctcggccttgcctttgaccaccttgggcttctggaagttggcagacttgcccaggtgctggtcatacagcttgttcttgaaggaggtgtctgttgccttagggaacatgcactcctcttccaggatggagaagatgcccataggctaaaaagcagaccacaacacaaaattgtacttctatttttttttctgtctatagaattaaaataaaaagcagcgaataatatagttgccgcaaaatatggtttcagaaatgcaaaaccaaccttctcgatgagctcgatgcaggcagccaggtccatcccgaagtcgatgaacgtccactcgatgccttccttcttgtactcctcctgctccagcacgaacatgtggtggttgaaaaactgttgcagtttctcattggtgaagttgatgcacagctgctccaggctgttgaactaaataaatagatatgtttacttctctcttaagcaaattgagtattttttaaaatacagaacttttccattttaaaaatatgtgtccaagagcctttatattacagatattaaaatcactgggttaaagagactttgaaataaaaggtgaaaagtatggaaggtttgagggcatgtggaagctactatttttctgctgtcattttgtagaaaatcctaccattatgatattcttttcctgcatttgcttaagtttattcaggtattttcctgagtacctacttaatcatcctgtgtttattcccattatcttctacattttccagaaggtttacagttttctgttgactcatttaggagccaacttgcaacccatgagaagctggctgggaggagtctatcttgcttggcaatcacatggtcagcatggcaagtgaacaataatttgccacccctgttattctttaatgtgaaatgaaaaaaaaaaaagatcaagataccaagtattatataaagtatgacaatatacatttgtatttttaaaaattccccaaacagcactttgggaggctgaggtgggcggatcacgaggtcagaagatcgagaccattctggctaacatggtgaaacctcgtctctactaaaaaaaatacaaaaacattagccgggtgtggtggcaggtgcctgtagtcccagctattcgggaggctgaggcaggagaatggcgtgaacccaggaggcggagcttgcagtgagccgagatcacgccattgcactccagcctgggcaacagagtgagactccatctcaaaaaaaaaaaaaaaatcaccaaaatattaacattatatataaatagtagaattatgtggaatctttttccttgggaccttctatatcctctgcaatgccctaagttttgcttgtataattagaaaaaaaaattaaacttcttgaaaactataatcaagaaaaatatatttcgtaatcaaatatgaatttttatttcatgatatcacactaatgagtcttaaaagctaattgcatttgttactgctgactctaaattattaacgtttctcagctcttattgtctctaagtatttcttaaaatagaccttcaatcccactgtactaagctaattcagaactccctttgtatcaataacaagttggggagtccttattaagtgcattgttgttttttatagaagtggaattggtactacaataactgaccagttactctcttttaaggcttaaaataatttctacagtggtaagaaaaggtcatagtcttcactaattccttcatatagatatttccattgccttactgtaaaatcctctcaccaatcagctacaaactcacatcaaaaatctcaaaaccagcaatgtccaagaccccgatgaagtactgcctgggctgcttggtgtccagctgctggttgatgcgggcaaccatccacaggaacatcttctcgtagacggctttggccagagcacctactgcgttggacaccttaaaagacaaaattataactctcgaagttattaaaggcctatgaaaatgctttcatccctggcagttaatttgaattatgcacctacctgttctacagtctggcctttggtgacatactcattgccgaccttgaccctggggtagcagagagctttgagcagatctgcagagttcagactctggaggtaggccgccttgtcagcaactaaaaagaagaaagagtagaacaatgttattgtggcccaaagaaacccacttccttaaaaatattttttaaactacaagtattttgtgcagtgttttaaatatctctttctgagtatccttacccatttgttcattaagttcaagtttttgattatggggtagtttgccctaaagaacttcaataattataggaaacacctacctagtgcttatgtttcccattgcacattatttaggtatacagatactttaaaacttaattcttaaaagtgaatttaccttccctaggaaaattcctgggtaacaagttaagaatgtgattttcaaacaaatgcaaaatcatgggagtgacttagttgataccttctgtgccatctggctctgcttgctcctcacgctgcttttgcttaaattttaggttcccataatgcatcacagcccccgtgagcttgtaaatggagaccttttcttcattagtaaagcccaaaatatcaatagcactctgtcaatataaccaataggatagctgttaggttgtgatccacacgcttactgttaatactgcacattcccattgctggcctgaggaaactaccagtgctaatgggagacaaggaaccccttagattgggtatatagagagttggtcaaccaaaggccagcacagagcattagaattataggtgcataccctctgaagattcaaaacgggaacttagaacagagaacaaagatagtaaatctaaggaacttgttattttgagagatggtaggaatctaatgcaagtcaattgcaaaaaaaaaaaaatagtttagaaattttcagaaatgatagatctttagaacaatgtaaggggtaagcaaaatgttataggggcacatcatactcttttcatttgactccaaggggcatgtccatttgcatcctggaatcttcttttgccatttctactagacactgaatatttatctggatcaccattactctgacccaccataataattccaattttcttgtgttctacttacatctgtggccatcagttcttcctgatcatcgatgctggccacactgatctccccttgactgacaaatgggtaatcatatgggttcgtggtaatcagaagcatttctaagtacaggaaacagaacaaagataaacataattatcttcttcattaaaacaagagatttctagacaaattgtgaggcactatattgttgtgggaactcagggaccccaaatagagggaccggctgaagccatggtggaagaacataagttgtgaagatttcatggacatttattagttccccaaattaatacttttataatttcttacgcctgtctttactgcattctctgaacataaattgtgacgatttcatggacatttatcacttccccaatcaatactcttgtgatttcctatgcctgtctttactttaatctcttaatcctgtcatcttcataaactgaggatgaatgttgcctcaggaccctgtgatgactgcgttaactgcacaaattgttcgtaaagcatgtgtgtttaaacaatatgaaatctgggcaccttgaaaaaagaacaggataacagcggtgttcagggaacaagggagataaccattaggtctggctgcctgagagccgggtggaacacagccatatttctcttctttcaaaagcaaatagaagaaatatcgctgaattctttttctcagcaaggaacagccctgagaaagagtatgcgttcctagggggaggtctctaaaatggctgctctgggaatgttgtcttttacagttgtagataagggttgaaataagcctggtctcctttagcgctcccaggcctattaggacaaggaaatcccgcctagtaaattttaatcagaccggttgtctgctctcaaaccctgcctcctgataagatgttatcaatgacaatgggtgcccaaaactttattagcaattttaatttcaccccagtcctgtgatctcaccctgcctccatttgccttgtaatattttattaccttgtgaagcatgtgatctctgtgacccacaccctattcgtacactccctcccctttgaaaatcactaataaaaacttgctggttttgtggcttggggggcatcacagaatctgccgacatgtgatgtctcccccagatacccagctttaaaatttctctcttttgtactctttccctttatttctcagaccagccagcacttaggaaatagaaaagaacctatgtgaaataacattgaattattgggggtgggttcccccgatatcacatgatgctttgttgatgactgatgggcactggagaggcgtttaaaggatattaggcaccatcgcaaacaccttgaagttgatgtcatggtgctcttataaatccttattaaaaaataaaatggccgggcacagtgtctcatgcccataatcccatcactttgagaggccaaggtggccagatcacctgaggtcaggagttcgagaccagcctggacaacatggtgaaaccccatctctactaaaacacaaatattagccaggcatggtggcgcatgcctgtaatcccagctacttgggaggctggggcagggagaatcgcttgaacctgggaggtggaggtagctgtgagctgagatttcgccattgcactctggcctgggtgacaaagtgagactccatctcaacaaacaaacaaacaaacaaacaaaactattgtaatccaaagaggataatcacataatgggaaaagttgtatcactatagtgttgattatatacaatccagaattggaaataatctatctgtaaagagggtatggttaagtaatttgtgcttatttctagaatagaacactatgcaaccattggaaataatgatgtggagctatatttagtgacatggaaaaagctatgatacataattgctcagtaaaaaagtagattacaggagagcatgtaaccatgatttcagttatgaaaattgtatgtatgtatctatatgtagagatatgtatacagaaaatgactagagagatattcatccaagtgttcatggtggttatttcatagtagtaggaattagagatgttattttcagttttccttttgatttcctttgaatttttctaatgagcacatataaatttttaccaaactcacaaagctatttataaaataaaaaggcacataaacttgacaaaattcagtcatagaatactaggttggactgtgcattgataggtactgatgcagtaattctggaaaagaattatgacatttcttaccaataagttctggtttcttattcgatgtaatctggtaaaaaatatgataacttctctcagccttaagctggaaaacaactctagacttctctagcagatctggaaggaaacaaataacacataagaaaattgtaaaaattcatgtgacatgcgaatttgatttttggtcagttttttaggtcatatgaatcagaaatgattttaaagatatctgaacacttacatgtttcaatatcagcagatgccagttttccagtagtgccaaagtggattctgatgaatttacccttgaaataaaagctaatattactaccttttttttatataatattaaatctttgagaaattccaaacatttgatgctggtactttaatattaaatcaattcagagagtatttgcatcaggtagaaaaaggtgtatctcctattttataagtagaagagttttatctttgatttaaaaattgtaaatatttcttaagtatgtgaagtaatggatatgttaattagcatgttaatcattccataatatacacataacatatatcaaaacatcacattgtatttcgtaagtacaattattatttgtaaattaaaaataaaaattttaaaattgtgagtaagtgtagatcatgacagataagaaagaactcaggaaaaaggccatatatccttcaagatggggctttgatctatgttattacatgctcagaggaaaaggaaagaacaatgatgtaatagaatgggaatgaaaaagattcagagaatgtaattacaaacatctcataaattttgaccagtgaacagcatctattagcgtgtccaagagacttacaaagcgagaggagttgtcattcctcacggtcttggcgttgccaaaggcctccagtagggggttggcactgatgatttgatcttccagagtcccctgcaaaggcaagagcagtccttgcatctggggcttgggaatttcctacctgagagtcccgacagagtctggattctgactgtgacaatcagactcacctgtattttgccagaagtaatttcttccttcttcttctcaccagtaactgcaattgttgcaaagtactggatgacacgcttggtgttcacagtcttccctgcaccagattctccactgtcaaatcaaaactcaatcagatgtggtctcaaacctagcagctatcacagccatgtaaagaaagcataaaatctacttacgtgatcaggattgactgattctctcggtctacaaaagaaattatagacatttaatactgttttcttacatatttgtaaatgataagtaaagtaaaatggaatgaacttagtattattcagtctggactttgcaacctttagggcttggcaggctttagacctaccactttctccctccccaactttagcacacatccacccatttaaacagaacaccactacttttattggttttatattcaaatcttccaagaaatatttccttcgaggaaaaaaattctaagatgaaggaaaatgtttgaatgccactctataagtgatgaccacgtggctgtgtattcctgaagcaccagactttttctttttaatactctatcactaaataaacaccaaaagtagacttggctctttggttaggtttagttgatgatttaagttagggacatatatattgtgggtgcaaggcgtaatgaagaatgagcattagagatatttttaatgtgtgaaaaggagtaagtacagtaaaggtgatagttttagaaatacggctttggtcatatttttaggaaaaggtaaaattttgttttgatgttttactgtctctgaagaggaattctctaagccccttctcaaggtgccacaagtagtttagattggtctagccaagacaatattgtaggaagcagattcaacatctaactgttttaataccaaatacaccttaaatctggagcctgttcaggttggttctgggcaaagggcgatagcattgtgccgtccttcatatagagagactgtttaatctgtcacaatttaggatgctgaggctgaaactacagagacaagttttactcttccattttttggctcatagtaacggagacacagtttgtatgtgtgattgtgcgtgcatgagtgtgtgtgtgtgtgtgtatatatacatacacagaaatatttgtatttttgctcatatttatttgagtttctgagtcattcaaaagtatactaactaaccatggccagcctctgttgaacttttcaaaatttaagagatcattagcaattatgtaatattacgcattacaaatcagcctttctccccttcctggaccttctccttcataaatacaccagcctcaactaaaagggacgatctcaaggaatgtgttgagattgcctcgagtctctttctcctatggttctgctctaaaggtttacgcacttgcaaagcattcggctcactcaccagtcagcatgaactgataggcgttgtcagagatggagaagatgtggggcggggcctcctggcgctttttgcctcggtaggctgtcaccacctcgggcttatacacaggcagccacttgtaggggttgacagtgacacagaagagacctgaataggtctatgagaaggaaaaagaataagtacccaaagacctttcctgttatttgtgaaattaacttattaattgaatgtttttttgagacagggtcttgctctgtcacccaggctggagtgcagtggtgctacctcagctcactgcagccccaacctcccgggctcaagcaatcctcccacctcacccttccaagtagctggtactacaggcatgcatcaccatgcccagctaattttgtacgtgctttttgtagagctaaagtctcactttgttgcccaggctggtctggaaattaattgaattttaacaaaaaggagcactttaagtgagtactcttatttcttcaaggcatcagcttgaaaactagttggcaagttcaacaatgtgatagcagaatcctgagggaagtgactacaattcagctttcttattgctctcctcagggcttttcacagtgatttttacatagcagaagaagaagtacatgttattaaacacatgtgctatgaaacttttattgttttatggaaatggtttatattttctttgcagcattaagataattcaaatttatgagaacataaatttggacataagctaagtggccaacagtaagggaatggttaggtgaactatggtaaatcttctaagacaatttgatgcaggcatttaaaaaagtaaacatgaaagtatacagcaacactcaggaaatatttacaaaacgtttttaagttataaggaaacaggacacgaaatgatatatatatatatatatatatatatatatatacatcatgattacaatagggggatttaaaaaatctttgacaattggttcaagacaagcaccaactagttaaactggatgctgaccatcaactctaggtacacttgtataggtgttgcctagctaaataacagcactggctaaactatgcaaaaatatgaatatagtataataaatttgatttaaaaatatttactgcatgtttattatgtgcagacctttaccagacagtataaatgagaccagataaatgagatgatgtcccttgaggaatccccagtctatgtaggagacagtcatgtaaatgaatgatcaaggagaaacatggttagtgttaaggcagggacagaaaggaaaggacagaacatctcactgcttggggaagtgggagaggtttcatcgaggaggtgacattccagatagaagggaccagaacacacagatacaaattgctgttatttcaggggattgaaaatgagtgaaatttgtttttaaaaaaaaaaaaaatgtaggccaggcatgatggcttatgcctgtaatcccagcactttgggaggccaaggcaggcggatcatttgagcccaggagttcgagaccagtctgggcaacatagtgaaactctgtctctgctaaaaaaaatacgaaaaaaaaaaaaatagccgggcatggtggcacatgcctgtaatcccagctactctggaggctgaggcacaagaatcgcttgaacccacgaggcagaggttgcagtgagccgagatcgcaccactgcactccagcctgggacacagagcaagactctgtctcaaaaaaaaattaaaatagtttaaagtgttaaaacatgtttatcttttcactctggatgattctgcggctggagtggggaaaaggaatggggaaaattacctgtgattgaaatataagtagtaactgctcaaatgcctattgaagggtttctgggcaaacctagtcaacatggacagcggccttccccagctttggatgggaaaacaaggaagtgctggctgttgagctgtgctttacgatagcaatcatgaagccttttaactagttatgctgcaatgaaagtgaaatgggtcactacctgtgacctatttatgctcagtggaagaagcaggatggtagggtacatgaggatgattatacagagcactggcaggggacactcacgtagatcatccaggctgcataacgttctttgaggttgtacagcacagcaggctcatgcagatgagtcatcatggccatatcctcgatcttgtcatatttgggagggttcatggggaagacctgatcatccttcactgtcagagtctggtaaacaggaaagataaccgtttacattaattgagtgaccaaacaacaacaacaaaaatcaataaaatgtggcaagctcctgggattctactcaccgctcctccctcagtcttcaccgtcacttttcctccttctctgctctggatggtccctttgacaaaggattctttgggctccgccacaaagacagatgttttggcatcaaagggcctattctgggcctcaatgcgctccctttcagactttcggaggaaaggagcagcctccccaaaaacagccaattctgagtctgaactcatggctgctgaactcagaggtcctaaaggagataaaactttcacattagagagtctggattgccatgtataccaataaatcttaatatttattgtatttcataggcccagttggaaattccactagacaggtctactgttcaccatactatagttactgagacaaacataatcacaagaacgaaaatgcatcaggtggtctctgtgtacccaatgccgtatttagggctttgcatccactgtcttatttcatcctccaggactcacattctcattgggaactgaattacagtccagtgctgctgtcaagtagcttgtgaccttgggtatgtcacttgatgtttttgagcctaagtgactccatctttagaatagggattataaattctgcctttctaaattcacagcccatgatatatgtgaagatactttgaaaaagaggtttaaatgatgactgagaaagtaatttgaaattgttcaggccaccatttatatatgagatgtcatgaattatcatgtcacaaaattccatgtcttgaatgtaatgtagaagaactttatttcctcctttacctgttcagccagatttgttgaagttcagtggcttattggagattataattttgtttacctttttttcttttaggttaggtgcttagtatagtttctctgacataattttttgcatattaaatacagttcatcagtttaacccccttaaactaattagggataaaaacagtagccaacgttaacctcattcttctacatctaagggctccctttactattccaaattttcctttgaagcatgcaggccctgtttgctccgttctatgtgatctgtaggttgccagtggtatcagtagaatgaaaggtttggcaaataattctaccgcagtcattacatgatcaaattacttgaaactcatttgaatcgtctcttctagtctctccctttagaaatgcagtaagtagtgggagggcagattaatacctctattatatataagaaaaatgccacagcactcggcattgtgtaaggtgactttttacaagggctttaagaagtttaaagaaaggattgtcttacttccattttacattgttggacattatgtttactaaatgaattctaacagcaggatacatttttatcaaatttgagatttttagccagggaatctgagggtagactctttttttcctgcacagacaatatatttattcaaagcgattcccctgctcaaatgtcaccccaccaatgcttgagccgtaaatgaggatgtgtgcattgtcctgaaaggacagtcctccctttctcaccgctttcctgaagcacagttgttaaagggtatttactgagacaagcactttctgaaaggttgctaagtgacagaaatccatcccagagcctcttgcattctcctccaggaactggttagtccaaatcttaccttgttagcaagtgagaagatgtagcctgggagtgagacagttctataaaagaaaagggaaaagcacttgattagttgaccaaaaagagggggaaaaaatcccatttatggcatggcttgctattgtaaacagaagtaacaaaattcatagaggtaaaacgtgcagttccagaaggagcagtaccagaactagcagctgctgctgacactgggcggtgtgaccagtgtccctcttgaaaggcccgtcctgctcccacttaccttggagctttttaaagcaggacgagtcagcctcattccaagggctcttttatatggatagctatggaaacaatgcagctgcctcttctttcttaagtcaaaaggaattgtttggcaaaatacctcttggcaatctagcgtccccgcataattctcattcatattaagaatggttggatataattagaaatatttttcttattgagtatgtggataaatctcctatggataatttgagaagatgatctgaaagagtcaagctggtggataaaggcagtggctgggcagccaggatacctggcttccctcggaacttctttttggctttgctgggcacagcattcgggcttgcctcgcatcactttcgcatatttcacgtgttaagtcacataaataaaatacaaatatgtattttaattttgtgacagttaatttttacctgttggtcctttctttccagccctgcaaaattaagcgatgtgccttcaacaacttaaagagacagaaggtcctctctgttattccaatattcctgtagtttcaggaatttccttgctcgctcacctttttgcttttgccaaagttgttccctctacttagcacaccatttcctgtccccctacccatttgacttgcctgaaataaaaaaggttgaatattttctagtagcagaggtgtttttagagagtacttttcaacattttttcgtgtcatagcccgctgagaaaaaaatgacaatattagtgtagcatgctagagtaatgtggaagggatttgtctatatctgtaaagggcttggggagaatatttttaatttttttacattcctttatgtaatataaatataataactatgatacacatagcattaaggaaaatattaaatactgaatatgtcggaaacttacaaataatatcttcttgaaaatcctaaggaaaaatttgagctatatcctacaaataaaacttgtttgtttctgactttattcttgaaatatgacacaaatttccagatcaaattttcaaaaatgatacaaacagtatctgtgttcttgataattaccatagcggggatttttgtccaagaaggagggatgaaaatggaaaaccaagtaatttacaactgttggagtattttaaaaattcaccagttcttctttctccttcattgaaaaatataatgttgaatattctcgtacagtgaaaataagtttttaatccatttaaactctctctttcatatcaaatatttcaaaggataatgaagctctaatcttcaaaaacttcatgggttaaaggagtcatcagcattggtcaaagggcacaccagtcacaaatacacacaagtacctgatctattcaaagtctaaggtttggagctattactgtgggctacctcttccagtacaacctacttagccttctggcacctttactctggctggatgctctctgggctgcatgccttgtcccaggcatcctggaacaccaaccctcccagcaattccaggggtctcttgactgcagaagacagcattacattctcagctggctgctgaagtccttcttggttccatccagcacatggcaaataccaccattgtgcttgcctcctgtaggaatcataggttatgctgtcagactcgaatgcagcccagtcaacactctgaggaacccttagtcagccttctcccagctaggagccacctcccaaggtccccctccccatccagccattctgagactgaagagatcaacattttatggcacatcagttacctttttgatgccaagatacactggttgggaagctctgttttaaggtgagctgttgagctgtttttccaaactaaacagccatttttagtgcccacagcaatagtttaatattctcttgttccatctctgctgccaatgggcattttccttatgttttattaaatagttcttattttatgttatttacaaaatgatcttcacttttttttttttttttgagatggagtctcactctgtcacccaggctggaatgcagtggcatgatcccggctcactgcaacctccgcctcccgggttcaagcaattctcctgcctcagcctcccaagtaggtgggactacaggcacatgccaccacgcccagctaatttttttgtatttttagtagagatggggtttcaccatgttagccaggatggtctcaatctcctgaccttgtgatacacccgcctcggcctcccaaagttctgggattactggtgtgagctaccgcgcccagcctgatcttcaattttaagtcaatccatggttctatattctgtttcctcatttggtaaactccttcagtgaatactgtgttctataggtagccgctgtctaatacattgtttttgactataaagaagaaaatgcaaagccttgttcccagtaattaagagacacaccttaattgttcccgtgccacttggctcaggatctgtgactgttaaatgttctctgagaacaagagcttaaggaatatgtcattcgggatcatcttttccactatgtaaacaggtcaaagacatacattcactttgtgtccttttcttgatttcattgtatttttaccactgctgcaataagtcagaggctttctactttgcattgctcacacctgggactatctgtcacattttggtgtggtgacagcttgggaatgagctaatttaagagtgctgatactctctctgaatctccttgcattgtctatgccatgcaaggagattcagagagagtagcagccactgatctggtcttcaggaaggttacaatctgagaaatcgggagagcactaatagatggctcaagtcaccttcagaacaacgtgacggcggcctttaaaagttacagtgtgtaaatcctttgcagaaaaggatccatattttctgcatctacttgatcctcatcaacacttaggatagtgctgacatgtagaaagtgctctgaaattctagtttataaattctcagatgccctgggtttctttatcctaatcattcttgtccccaataactgaaattgggacctggatttaacttttggctgcataccagctggatatccttggaaatttactaaaccttctcaagactcagcttcctgctctataaaagggataagtgctacctcataggggtttgtgaggagtaaacaagacacgaaagtgcttagaagctgaaaacagtgcctggtacccatcactcattcaactgatattaacaattgtgattactattgccccccacagtttgttagttcttattctgaagtctctgcagaagtgaaactagttttctttctgatctctataacaagacatgctcccttgatcatttcagtcactcaataaacatttgcacagcatgactatacggcaggctctcgggtaaactccccactgccactatggaatgccctcctctctttcatattattgtttcattatatcaaaatccagctcagctcttattcagacattttctcaattattccatcagatagagaaaaggcagtttggcctgcgcagagagacaaactggcattagctgttacatgaagaaaggtgtggtgtaagaagaggctggtcgtggtggctcacacgtgtaatcccagcactttgggagattgagatgggtggatcacctgaggtcaggagtttgagaccagcctggccaacatggtgaaaccccgtatctactaaaaatacaaaaatgagccgggtgtgatccctggcgcctgtaatcccagctattcggaaggctgaggcaggagaatcactttttttttttaattttttaaaaattttattattattatactttaaattttagggtacatgtgcacaacatgcaggtttgttacatatgtatacatgtgccatgttggtgtgccgcacccattaactcgtcatttagcattaggtatatctcctaatgctatccctccccactcccccaccccacaacagtccctggagtgtgatgttccccttcctgtgtccatgtgttctcattgtccaattcccacctatgagtgagaacatgcggtgtttggttttttgtccttgcgatagtttgctgagaatgatggtttccagcttcatccatgtccctacaaaggacatgaactctacattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttctttgagaatcacttttgaacccagggggtggaggttgcagtgaaccaagatggcgccattgcactccagcctggtgacagagcgagatccgtctcaaaaaaaaaaaagaaagatatgaagaaatgagggcccaggctagggagttggtgatggaagtagataactgatcaagaaattggttaacaggtgatctttggagcggggaactgaatgttaggtaacttggtggaggggagactgacgtttcataccataccatttttgtattttcaaaattttatgctgggtgcatgtattattgctttaaaaattaaaagtgatgatttgccaaaacaggatctcccttaaacattggaagaaaagaacagatgggattaaaagaagaattaaagagatgccagattaagccctagaagagtcaggactcaagatgaaagtttcccagtgactgcttctgtgttttttccatggactaaactccaggcccatcaatccacattgttaatgagtgttgatattgttttctaggaatgcattggttttctgtttcaaacttggtacctttgcaccagtaacccacacgtataaagccccatcgatagagagctctacttccaaatgtctagtcatagaactttctgaaaatttgctttataaagaaaaaaattggctagtaagaggcctgtaggagagctcataatttgaagttattgagagacataattcagagccacttataatttgaataaaaatatatacatatattcaaatttatgtacttatttaaatgtatttatatataaattacaaatataatttttatcatatattacattactctttttagttccagatttagctttcaaagaatacattatttagtcctaatttgaaataagtggaaaaaggaaaatttgtatctgtttgcactcatgggtagaattgtacaggaagttgctggagggggtgctatatcaaaatccaagaatccaaagacttgctgtatgtaaagcattctattaagtgctcaggagagaggaagatgggcctagctctcagcagttccaccagcacaaaacacataatctgcatgtaaataagggagtttggtgatccttcgtggaaaaatttgggagaagcaaaactaactcccttaagactaaattaacgtttgtttgtttttctatccacaaaagtaaaattggtacatggatattctagaaatttggaaaaagcacaacaaaagaatgaaagttaagagaaatgatttcttactagtgagtgtagaaaaaaatgcattcatttctgcacatttcaacatttgcttaccatctttcattaggttaatttgattatgcaattaagaggcacaatcagtatgtatataaactctatagtcctcatgcctgtcaaatattaggcatcaatacgtgttggttggatgacaaaggaataagcgttattctgataatgccactacttacctggcattttatagcctgtaaagtgagcctctttcaacagctctgaagtacggatagcacagataaattctcttctcttctttgttttctaagaaaccatgatctaaagggttattatacggcttacctaatcagggtggagctcaaagatttcttgccccattctccattgattttaacgcctaatatatttaaccctgagtactgttcactccagaattgctctaacgcctttaggttgactattaggatgtgcattcataaactgctagccttactcaggcttcttacaatattgtgaggaagataaaatgataaatatgccaatagttattccaggatgtagaaaatgttaagtgtaaatccccaaaggagagggcattccccacaaaccctctgctatcctgtttgctcagtctcttcaaaattagcacactgactgtgagagtataggcagatttctttaacgaagaagtagcattttgttgaaggatcagggaaggccttgtagaagtgtcatctgagatggtccatgaaggaatgggtaggatttaacagatggagatccaggaagaaagaagttctaggtgcaagaacagaaactgaaagaactgaagtggaaggaaaaaaatttgaagtctgtttgaggaggagagagcagtcttgtctgactggagtctaacataagtgtaaggaagaagtctagggagacagttggaaccagatgcatcagaagctgttgtcaggcctcactcattaagaaggaatgttctggcccagaactccaaatgaggctgaccagagcagcttctttttatctttgttctcagaccacagaccccttatttccttatttttcactcggttctacactctcagattagttttccatcccccatatccacacgtccactttggcctcctcctttggcctccttttgctcatgatctcccacccttgaccatacttgatcctattagtcagggcacttaacccctctcctacttctgtgaccaacgtccttcctcctgctgatgcctgtagaagctggaaacagttatgggttgtttttcctgccctgccaagcccactcagcttgtgacaacaacgagccttgaatgcttggcaccagggtttgacttgaataaaatatttaaccctcttggcttgggcacggtgactgacatctgtaatcccagcactctggaagaccaaggtgggaggattgtttgagtccaggagttcaagaccagcctgggcaacataatgagaccccaatctctacaaaaattaaaattaaaagttaacccatgaatatggggctgttagccaaaacaacacttccatgaatttagaatgctgtatcattgaggaccaaaattatctcatgcttactttaaaataaaatctaccaatattttttgaggaattttaattttacttgactatggtgctttttaaagtcaatttttaggaatggaaaaagtattcaattaacccaattctgttttccttctctcagttgcaagaataaaaactggattaaaataattttcatcttgtcctgccaaaattatgcccccacaaacaaacaaacaaatgcaaacccaaatctcaaaagagaaaagaaaaatagaagtatgaattagggtgggaatggaattctcatggttgagggaggaaagatttttgctattctgtgagctggacattttaaagaaacccaaatgtggatcaacttcctcaaaactgctgctttttctttgtggttttggcttgtcccaggtcaagcaactggtccagtggacaggagttgattaaaacaaggctgtgttccaaggctgaagagtatttttagatcttgaggaagaattttttttttttgaaggaaaggatggtaatgtcatccaaagtactagtcctgtgcagaagctgctacttggcatgtctcaagaagcacttcaaaaggaatgcggccaaaggccaagcttcaggaagccaaatgctggagacccagttgttcttctggtctatttggaaaacatgatggcagacattttcatggattttctcatcgtttgccccttttataaaccttcatgaacacaggcatttgctttgttttgattgccctgtggaagactctagcttaatgttctaaattatttcttctttgagcaataagaacaaaaatgatcattggaaacccccaagatatatcatatccttgtaggaaaatattagctggccaatcttgaacagtcttcaaagtaaaaattatgggaagaatggatgaaacaaagatcagatgctggcgtgtgtacatgtgggtgcactgtgtgtttatgtgtgcccagcattcatgcatgtacttcatgtgggtgcactgtgtgtttatgtgtgcctagcattcatgcatgtacttaactaaaagtgccctttgcaattaggagaaaggcaggaacggtggagctacttactgttcttggatgattcagactcatcagggggtagctgggtgtttagatagataagtgctccctgctaagatcttaccaaagcaaacgattctaacttggcattcaggaaaatcaataagtggaataaagaaactgaatttctggaaattatcttcaattgaatcgcgtgatgttggctgagctactcaggtcccgcaagcaaaaacttaggaacagaaagtttttatcagctgactgaagtgccattgcttggtgcatgactgtattatagtttcaaagtgttgatgcctataaataatatttttaaatatctacaactactggctgggcacgcctgtaatcccagcactttgggaagccaaggtgggtggatcacttgaggtcaggagttgaagatcagcctggccaacatggtaaaatcctgtctttactagaaatacaaaaattagccgggcatggtggtgggcacctgtaatctcagctacttgggaggctgaggcaggagaatcgcttaaacccaggaggcacaggctgctgtgagctgagatcatgccactgtactccagcctaggcaacagagcaaggctctatcaaaaaaataaaataaaatatttacaactactgaaatatgatatgaatatctgtcttggtgactgtgatggttaatttaatgcgtcaaattgacggggccaaggagatatagatatagatacacacacacacacacacatatattcagttgtttctgtttctctggagaaccgtgactgataaagcgacaaagtcacaagcactactactagtacttgggtttgtttcccacatcatatttgaaggaaatgaactgcaggttaattgtttcttaataacttcatattttcccagtccaaaggctgctcacttttcaagaaccagcagatttctccacccattacaatccccactgagactccacatttctgaagcctttgtgtccatataataataacacccagcaagctgcttcgattgttcataacatttcaacgttgtgtttcatctctcctttatcggtgtaggtttcttggaagcagggactggacttctgcttcttttgaaattccctgcctcagctgcaaccagcatactgatgggaacctggtattccagtggttctcaaccctgaacacacatcagaataacctgcagatgcttgggttctatttcccaggccagtggttcattaagtgtgatccccagaccagcagcatcagtatcgcctgagaatttcttagaaatgcaacttatcaagccctacctacaaccaacacaatcagaaactctgggggtagggccccacagtctatgattttggaatgcactaaaatttcagaatcactgccctaaggactctgattctgaagaaatggagcggaattcagaaaacttcatggaaaaagtaccattacctggtaaattccatgaggtcaaaggtagggtccaattttgctcaccgttatacctcaagggcctgtcttagtgcctgacagatggtctggactagaaactatttgttgaataaaagaaagaaatgcaatttgtgaggcctacgtattgtgcaactatatttttcagtgtctgctgacttttatagaaattagatacaagtcctttgaaagataaatattccctttgaaggtgccatttattgcaagacatcaattatttaacaaatgatgcacttgttgttcatctagtagctccaactagtgttttggcttatgagagagttttgaaaaacaagcaaaaaggtcagcgtttagaaacctaaatgccttcaccaaattaaaggaaactttgcttttttttttctctttttgacagagtttcactcttgttggccaggctggaatgcagtggcacgatctcagctcattgcaacctccacctcctgggttcaagcaattctcttgcctcagcctcctgagtacctggaattacaggcgcccaccacctgtattatttgtattattactagagacagggtttcaccatgttggccagcctggtctcaaactcctgacctcagaggatccacccaccttggcctcccaaagtgctgggattacagacgtgagccaccccgcccggcctgcatttttttgttctatcaggagcacttgccgcgttgagctctttggggttttctgatcttcttgactacaggaaggacaatatgagctcttatactctacagaataaaggaagaaaattcttctgcgtttcaccttcaaaatataggtagaataaactaaagctacagcagactacgatttccaaaagaccattatgtatattcaaatagcaagttgtcagatagtgtactttgctctttaaatagcgtgtcattgatgcattgattctactacgtgcaaattgtggtgtaagacaaaacagagaatgctgaaaagtgttccttctctcaaagagctcacaacacagaagagaaatgagagcagggaatacaaataactacagtccctctttatcctctttagtactcgacagagccctttccaatgtttttctttatttatctgtttgcttatttgtgaatttgttgtcttccctcctcactagaacataagtcaaggaaatctcatttaccaccacatctgactggcactgagggtatttcctggtgctggtggacacaatcaatatttcttaaatggaatgctggggaaggaaacacaaagttaaacacatgaattactactttgaaaatattagatcccgccgggcgcggtggctcacgcctgtaatcccagcactttgggaggccaaggcaggcagatcatgaggtcaggagttcaagaccagcctgaccaatacggtgaaaccccgtctctactaaaaatacaaaaattagccggacctggtggcacgcgcctgtagtcccagctactccagaggctgaagcaggagaataacttgaatccaggaggcggagattgcagtcagccaagatcgtgccactgcattccagcctgggcgacagagcgacactccatctcaaaaaaaaaaaaaaaaaaaattagatcccactctgaggcatctattttcatgttctctgatgaggacctatgctctggattcacatggatctgcggggttcaagtcttggttctgaaactcgctgctgtgtgcttttaaccacattgcttaacttttgacagtttctgctgcccctccatcgtgatacttaactctgtattgcctcacctgaagtttaatttctctctaagtctgttatttaagataagccaaaaaatgtcccgtaatattgaaaaatatattttactaattccaaggactgctcgcttataaccttgaaattacaaatatttttatgagaaactatacatgttacattaaatttattttcttattgttatttttgtagaaagctgtgttagctccctcaaagtggtaaactaacttttcataagaggataattttacccaacaaccttgtgataattaactcaccatgacttccaaatatagctccaatttacccaagcattattaaaggacttttaaaattaggagcacagctaaaggaatttcctccttgggtttacaagtaaaattaaagtgactgagaataacttcaaaacacaaggcaagacttatttaccttacgagtattattggttagtcagttgaagtaattttaaattccattcttattattttaggcttcaataattctaacaaaaagtttttatgtgtatgtataaatatatatgttatatttatatagtcactaaataaatatttttagaaccatgtttttcaaactttttcttcccattgctgagatgagatggtcttttctatgagtttttctaaataagctgcaaggttctttctcatgtgttctgggagatgtatcttctggtggtgagatgcctagccacccacctgggacagccatgagacctggtgagagaattgctaaatcatgaaactctccaagcttccaatgccctatatgtaaggtcagaattgtaacacctgtcctgcttacagatcaaataaaaaattgtgtataagggtgctgtgatttgactgtgtcctccaaagttcatgtattggaaacttaattcccaatgcaacaggattgagaagtgggatatttaagaggtgattaggacacgagggcccttccttcatgaatggattcagctgttattgcaagagtgggttcctaataaaagaatgagataagttggacatcttcttcccttcttctctcctgatttcctccagttctgtcttccacaatggaatgacaagcaagaagattttcagtagatgctagtgctttgatattgaacttcacagcctctagaactgtgaaaaataaatttctcttattcataaattatccaatctgggatatactgttataacatgaaacagcgaaagacaaagggtttcataagtggaaaaactatatatacctatgcatgtgtgtatgtataacagcatatatatatatatatatatatatatatatagtagcactctatcagcataacactaaacactatatatgtataagtatatatatacatatacagacatgcatcacttaacaatggggatacattctgataaatatgtcattaggcaatttcttcactgtgcaaacatcatagagtgtacttacacaaacctagatggtatagcctactacatgcctaggctatatggtctagcctattgctcctaggctacaaacctgttacgtgcatgttacgatactgaatactggaggcaattgtaacacaatgggaaatattcatgtatgtaaacatctaaacgtagaaacagtacggtaaaaatatgatataaaagatttaaaaatgtcagaccaatataggatacttacatgaatggagcttgcaggaccggaagtcgccctgggtgagtcaatgagtgagtaggagtgaacgtgaaggcctaggacattacttactgtatactattgcagactttataaacactctacacttatgctacataaaatttataaaaacgtatttttctccagttataaattaaccttaactcaccataacatttttactttataattttttgactatttggtaatagcacagcttaaaacacaaaacacattgtatagctttgaaaaaaatattttctttaagcttttttctatttttaaaattaatttcttttgacttttaaaacttttttgttgaatactgagacataaacccacacattagcctaggcctacacaggatcattaatatcactgtctaccatctccacatcttgtcccactagaaggtctacaatgtcactaggcaatacaaatttatcagtgccattataatcttttttttttttttctgagatgcagtctggctctattgcccaggctggagtgcagtggtgcaatctcagctcactgcaacctctgcctcccgggttcaagtgattctccttcctcagcctcctgagtagctgggattacaggcatgcacaaccacgcctggctaattttttttttttttttttttttggtatttttagtagagacggggtttcactatgttggtcaggctggtcttaaactcctgactttgtgatccacctgcctcggtctcccaaggtgctgggattacaggcatgagccaccgtgcccggccagcgccgttataatcttatgggaccaccactgtatatgtggtccattgttgactgaaacgttatgtggtgcatgactgtatacatacctatattatataatatatacatatatgtaagttattgctgctgatattctttaatggcttgcttttataaatcccacaggaaatggttatcaaagcatttcagtggacctagtcattagttattcactctctaagcctctgctagtaagactgaatatgattggtcttcatatttgaaagcaaagatattcttttcacagtttaacactgtcttgctttttgcttttcttttttaatagaaagtattggaaaatacaaattggtaaacacttactgactctgaattttagctagaagaatcctcttattccttgacaactatttcttaactggggaactggagccttggatggcaaaaggacaggtctgagcaaaatgccctgctgtccaagagggatctggcagtgacctagcacaaatgtcccttctcttgtgacagcctctcacagactccactaagcctttctccagtcggacatggccctttattcagacctctttctggtgttgactatgtggtggggaagttacttagggttttttgcaataagtaataccttgctatatgcagtgataacattgtaaaaattaagtatataagcatatagagttaaaaagtgaatgtcctcctttccctctctccccttcgtgccactcttagcagtttggagcatggcctttcggatcaatttgtatgcagttttaatatgcacatacaaaaacatgtaataaagagatcattctgtacattttgttctacttctcaaaaatcttttcatgtccgaacatatattgatatatctattccgtaatataaatatgttatttaacttccgatgaacattcctttctttctcttcttctttttgctattacaaacaatgcaccaacaaacactctgttctatactcaaacacatacacataggcacatatgtatctggaggatacttttataatcttgttttatacaattggttgtttaatgcaggtaaaatttatttttatatgtaacgtgatgtaaaaatttaactttactttaaaaaacggatatctaggccaggcgaggtggcttacgcctgtaatctcagcactttgggaggccaaggtgggcggatcacctgaggtcaggagcttgagaccagcctggccaacatggtgaaactccgtctctaccaaaaatacaaaaattagccaggtgtggtggcaggcacctgtaatcccagctgcttgggaggctgaggcaggagaatcacttgaacccagaaggcggaggttgcagcgagccgagatcgtgctgggattacaggagtgagcaaccgcacctggccgagactgttctctcactcagcaaaatgccctgagattcgtccaagttcttgacagtatcagtagttcctatttttttttggtaagtagtattgcactgtatggaggtcccacagtttattcattctctcctgctgaaggacacttaggtttttgcagcgttggatcattatgaatagagctgtcttaaacattcatgtacaggtttttgtatgaatgcaagttcatttttcttgagtaaattccaaggagtggggttgctgggttaaatgataagcataggtataacttcataagaaactgcaaaacatttttagagtagctataccattttgcattcccccagaggtgtataagagtgccagctcctcgatatccctaacagcactcaatatggtcagtatatttttaatttaatcattctgagcagtgtatagtcgtgtctcacgttggttttaatatgcatttctctaatggctaataatgttaaacatgttttcatttggtaaagtgtctgttcaaatcctttgcgcattattaaaaggggctatttgtctttttacttttgaactttgagagtcctttatatattctggatacaaatcctttgtgagcagggacatcttcatgggagtgtgacctgtgcagctgcacagggttccacactcaaagggacccagagctttgttcaatgttctacagttgcagtcttgaaattcttaataatttttcaaaaaggaggtcccacattttcattttgtacttagccccataaattacatagctggtcctgtttgttggatatgcaatttgcaaatatacgttcacagtgctagcttgtctttccatacccttagtagtgtttttcccagaacaaagttttcaactttgataaggtccagtttatcaattttttctttgttggattgcacttttggtgtcatgtccaagaactctttgatcatgaagattttcactcctgttttcttgtaaaattgttattgctttgtttcacattaagatacatcatccatttggagttaatttttgtatcgtttatgagatttaggttttacattgaaactttgattggcaagagatttaagttatagattaatttaggaagaactgacatttttacaatgtagcatctttatgtctagaaacatgataatactttttttatatattcaagtctttgtgtcctataaagttttatggttttattcctatatttcttgcacttttttcctggtttattcctaggtattttgtacctttttttgctatttgaacgagatttgttttctattatatttactaattcattgtagtagatggattgaagttgaaaagaaataactgaagatgaattgaggttgaaaagaaaactgttgttttggggtgttgattttgtatagaactcgttactaaaggggcttacaaactgtttgcttttaggcaggttccggaagagaccgtgctttcctcctcacttcctgcctttcccttataaaaactaggggattggagtggagtggtggtcagttatgagagttctgctgaaatgacacctctggacagcccgagggtaggaaaagggtaccatttgctgttaggtacttggtgccattgttctcagctgtgggttttaagagctaattgcatcagaaaaaaaataagataaagataaacacattttatcagtagatactcattcagctgcaagtaacagactagtttagtgacatttgcttttaaaaatgtgttttatttttttcacataacaagaaatcttggggtagaccattgctgatgtcagctcagtggttcagtaatgccactaggaacccaagtttttcttttctttcagactttttttccaagcaaactttttgttttggaataactttagatccataggaaagttgcaaagacagtacaggcctctcacatacccttcacccagttttttgctcatgttaacatcttacataactttggtacatgtgtcaaaactggaaattaatattggtacattactattaactaaagtacagacttcattgggatttcatccgttgttcctctcttatccttgtcctgtttcagaatctaatccagggtatcattcgttctaatgtctccataggcatcccttggctgtgacagtttcttgatcttcacttgattttcatggtcttgacactttgaggactactgctcaggtattttgtagaatgtccctcagtttgagctcatctggtgatttctcataattagactggagttgtgggttggcagggaataccactggggtggagtgccctactcattgccaggtgtcctgatatcagaaggacttatcactagtgatgttaaccttgtgatagtcagctggtaatgttaaacttgatcactgatcttttagtctttttattatggagaatttgaaacatgcacaaaagtagagaaaacaatatagctaacccctatgtatctatatccagtttcaacaattattgattttatttcatctatacctccatctactttcccagtagcacccctgggctattttgaagcaagttgtaaacattacatttaatctataaatatttcagtatggatcacgaaaagataaagactcctagaaaagtaggcacaatatcattagcactcgtaaaatccctggctatattttcaaggctatttgtattttcccactctgcccttttcggcatgtggctctttatccttgctaacagttgtgagagagcttctctgtcttcagccgtcacatctaagtttaaggccaaacactgggaggcaggatagcaaaaagcaaaaggtttcccagatccttttgccccttacccttacaacccgacttccagctgtatctcactggtcagaattgtatcacgtggataccacaagtaccaagagaagttggaaaagctagcatttggctttccaacctccataattgaggatgacatgggatgatgaggttgggaatagatgcggagtgagccaacatagagtatcgttcacactaacttggggaaaagagaaacttcacttgacacatttctccattctgtgaaaccagtccttagggaagagagtgggactggtggaataactactgaatggccataccatagcagcacttgtgttctcctgcctctggcttggtgatgcctaaggctgggacctggctgggcctatgagtggaggctaaggctccagctgtaggggctggaacaatgtggggctgcagccagagagccgttttaatttgacttcaatgactcaaagatgtagttattaaagaatgcatttcaggccgggtatggtggctcactcctgtaatcccagcactttgagaggccaaggcaggtggatcacttgagatcaggagcctggccaccagccagcctggccgatatggtgaaaccctctctctactaaaaatgcaaaaattatctgggcgtggtggcacatgcctgtaatcccgctacttgggaggctgaggcagaagaatcacttgaaccggcgtggcggaggttgcagtgagccaagatcgtgccactgcactccagcctgggtgacagagtgagactccgagagagaatgcatttaacaggacataaattctaaaatcaggataatcctagactaccgagtagcttaagtataagtttagagcattaccaaagcaatgactctacaagaaacattgagttctggtgaatttaacaagaatttttcaaaataaaaaaatgtttagaaagaagctgccaatttttaatgaaaatcattttattttacattatttgacatacttttaaaaaagaaaaaatgtgccaattaaactctgaaatgccattgattctaaggcacatcctgactttagaaatgttaaaatgtggaaaaaattttgtcttgatattgatgaaatatggtattttaatttttaactatataatacaagtaaagtttggattctatgtcacaatcatttttaaaaattgttttattgagttataataaaatcagtgagtaataagatcaatgaaattccacttatgtatacacctatgtaatcatcatccagattaagatttaaaacattttgctatctcatagttttcttgtgccctgtcccacttaatctctattcacagaagtgaccactctctgaattttttcaccgcaaattagctttatttgttctgggatttatataaatggaatcattcactttcttctcttttgtgtctgactccctttttttttttcttatgtccaggatacattgttaagggagaaaaaagcaagttatcaaaacaattgaaagagtattatcatttttgtttaaaaaaccacaagtagtctgtatctataagtgtgttcctatgtatattacatgtaaggacagcgtactgaaatggggagctatgaacaggccaacctagacctccatatttgaaaattgtcacttgctccttcccctccatgttactcatctcgttcccctgttctgcattttcatttttcatagcacttaatgtctttttacattttatatatttacttatttattatgtttattatgtatcatatgtttctcctcctttccctagaatgtaagattgctcatggtaagaatctttatctagttagtatttggcacatagtaggtgctcagtaaatatgtagtgagtaaatgaatcaaatggtattggagtaaggtgaaggaaaaacactttttaattaatttatcatagttgtatgtattacaatgtataacgatcaaatagggtaattgggatggatatccatcacctcaaacattgatcatttctatatgttaggaacattacagttcttctctctagctactttgaaatatacaataaattgttaattataatttccctactgtattattgaatagtggaacttattccttttaactatatttttattctcttaaaccaacttctctttatccctacttcccttcccagcctctggtaattcagcataatgtttttgagacttatccatgtcgtggcatatatcagtactttgatcttcttaaaaatcatggagtagcattctattttaaaaatataacaagattgggccgggcacggtggcccacgcctgtaatcccagcactttgggaggccaaggcaggtggatcacctgaggtcaggcgttcaagaccagcctggccaacatggtgaaaccccgtctctactaaaaatacaaaaaattagccaggcacggtggcatgtacctgtcatcccagctactcgggaggctgaggcaggagaatggcttgaacccgggaggtggaggttgtggtgagctgagatcgcgccactgtgctccaccctgagtgacagagcgagactccttcccaaaaaaacaaaaaagaacacagtttgtttattcattctcctgttgacagacatttgggttgtttctaatttgttactattatagaaagagtctatgaacatatatgtaagagtctttgcatggacttatatttttatttcttttggataaatagagtggaattgctgggtcatagggtatgtatatatttacctttataataagttgtcaaacaccttttaaaactgattttatcattttatagttgcacctccaaggtgtgagaactccagtttctccacatcctcaccaacactaagaactgttagtcttactaatttcagctttagctttatctgctaggcttaaagaagtatctcattgtggttttaatgtgcatttccctgtagactcattatgttgaacatcttttaaggcactcttggccatttgtttatcttctattaggaagttctcttttaaaatctttgtctattttttaaaatggcatatatatgtatatgtgtatacatatatatatacacacacatatatatatatatatatatatatatatatatatatatatatatacacacactaagttctttgtcagatacatgttttgcaaggagcaatcacttaaatgaagaaaagccaataaggttgaagcaaactgtgagactcaagtcaaactgacatttactgaataactaccagatagcaggtccttcagacccaggctttcccctgattttcactctgccgggcatcattttcttgatttttttcactatgctactaaagcctagagaggttcaataacttgttcaatgctgcccagtttaaagaggcagagctaggattcaaaggggtctgtgtgaatccttccccttaaaagaagcacacttatattgggtgccctctgtttttccttttatttaaattatatagaagggacttctattttttttcaatgcttagcctctagaatcttaatctgtccttgaattagggctagctgcttagtcctgattaatttctaataaggaactaactagtcctttaatatgcccctgaattagattatagggaactctggtgtgggagattaaaatctgacaccccaaagtacgcttcttttggcatatttcaagatggctattcagaggggctgcagacacaggaatagctctgaaaagctatccttttgtgggggagatttgcatctgtagaggaaatctacattagtgaagtaaacagcggatgcagaggctttctctgagttctccttatccggatctaggagagattaactcagaggaaaaggagacgaactctgacattttaaaggtctgacagagaaacttgtacatagcctaccatctattctttctgaggactgtcagccgagtggcttcatttgcataagacaactacttttgtttacagtgtatttcctccctcaccatcccatgacctactgtcacctccttctgggagctccaagcccctgtccctttctgtacagtataaaacattcagtcggctgggcgcggtggctcacgcctgtaatcccagcactttgggaggccgaggcgggcggatcacgaggtcaggagattgagaccatcctggctaacacggtgaaaccccttttctactaaaaatacaaaaaaattagccggcgtggtggcggtgccagtagtcccagctactcgggaggctgaggcaggagaatggcgtgaaccggcgaggcggagcttgcagtgagccgagacagcgccactgcactccagcctgggcaacagagccagactccgtctcaaaaaaaaaaaaaaaacttcagtcatctgaccctcccttgagtctcatattttgagtggcttctatatacatgtgcttatagtaaatttgtatgccttttctcccgtttatctattataattttgttttgtaaatttaaattaccaaacctttaaggcggggggttcagagaaggaaaattcctttcacccctacagtgcattcataaaaatggcaataatccaggataaggagaaccaaaaaaatttttaaaaggtgggaagagggttccaaagcaagctgagaagagtttgtgtatagccaggacaaaaactggaagccagtgaatccccaaaagctgaaggtcaagacagagcagggctataaaatcaggaaagagaaacatacactcagaggtgaaaagaccatgaagttcttgagaagcccaccagagacagaaagcatttctattttttcctggtatagacctacaatagccatccccaaaggcaaccactcccagatctagaagcccaaggactctttcagttcaagaacttgctatgcctggcagcttccatcaacatcgatgagttttaaaatcttttctaaccctggcttcttaccctgcagttaggacatcttggttgtgatggaaattcaaatcaatgtaatgcaaacaaacaaaagtattctggcttcaatcttgggattaaaatgacacctccaggaattgctctttttctccatttcttgactgtgcttttctctgtattggcttcatacctgcaacaagctccctctctgtggtgggaaatccagttcgtggcagctctaggttttcactgtcctgatagtctaaggaaaagagaaagacttttcccaggagttccggtaccaattctggaagggctctgattggcctggttaatgtcacattttcatcactaaataggattcccagataaaatagagaactcccagttatatgtgaatttcagaaaaacaaattttttttactataagtatgtcttatgcaatatttgagacgtgcttatactaaaaaaattgtatttatctgaaattaaaatgtaactgaacatcctgtatttttatttgctgaacttggcaacctaattcctatgccaaccacctgtggccaaaaggatgacagactcctgaatcctggagattgagtcagtctcagattgatggggactgggaatgggggaagggtagttgcctaaagaaatcctgagcagattaaaagcttgtgcctactatacttgctgtttcttcctgtactcccaattttgtgtagacttttccagatcatctatctcatgttaaaaactgagataatcaccttcacttccaaatgtgtatttttttgacaaactgccaattattgacaacagattttttctccattcctctcacctctagttattgaatttacaagtttggtgttctttcatttcttgattttcctttggtccattaatccacaacttgaaaacccagacttgtgtctcaccaagtaaattcctacattccagaagctgcaaaatttgactcaatgacagtctagtgctagctcaaaggtgacttggggcagtatctgagcaagcaatatgaacctggaaattcagatgcagcagatttgctgatttgaagagatcattccagtttttataaaaatttcatatacttattattttatgaactaatgtactgtcatagtaacaaagtttggaccttcgctggaggagaaggggatgagttcaagaaattttcctatttgtaagcactactatttgtttgttctgtatcacattgccatgttctcacttgtatgcctcaactgtaaatatgcatatctgctttattagtcacgattctccaaggagtcaaacgcacgtgtgcacacacacacacagagggaaagcgagagatttatttgaaggaattggctcacactgttgtgaggctggcaatttgaaatcagcagagcagggttagcaggctgaagagccaggaaacagttgatgttgtagtcttaagtcctttggtgacttcagtcttttgagaccttcaactgattgaatgaggccctcccacataatagagagtaatctgctttacttgaagtctactgatttaaatattaatcgcatccttaaaaaatctctttggcccggcatgggggctgctgcctataattccagcgctttgggaggcaaaggtgggaggatagcttgagcctaggagttagagaccagcctgggcaacatagtgagaccccgtctttacaaaataaaaaattttagccccaggcatggtgcacatgcctgtggtcccagttacttgggaggctgaggcaggaggatcacttgagcctaagaagttgaggttgcagtgagctatgattgcaccagtgcactccagactgggtaacagagcaagaccctgtctcaaaaaataaaaataaaaatcccttcacaacaatgtctagactggtgcttgacccaaaactgggtactggggcctggccaagttgacccataaaattaaccatcccatctaagaagtcattactttacgtctaattgtgtcaatgtatatcattgtcagatcttccttcaatattgtcaaaattcttaatacattggttttatttgcttggaaaagtttcggtgataattgctgaaggaccaggctattttatagaaaagttctttttctcttgaggctattggatgtgaataatcctgaagtcttcttctgtagcaagtcattcaagaaatggattgacctttaaaagaaatttcacagtaattttcctctggcttatttttggcaatcaaaataaatagaatcacagactggggactgggcatggtggctaacacctgtaatcctagcgctttggcaagccagggcaggaggatcactggaggccaagaatttgagaccaacctgggcaacaaagcaagaccctatttctacaaaaaaaaaaaaaaaaaaaaaagagtcagacatgatggctcatgtctgaagtcctagctactcgggaggctgaggcaggagtactgcttgagcctagcagttcaaggctgcattgagccatgattacaccactgcactccagactggttgatagagcaagaccttgtctcaagcaaacaaacaaacaaaaaaaacaaaaacaaacaaaaaaaactaaagactagagggatgttgattcctctttgaaatcttaggtttatgcttagatgagacactgcagtagcctgaagcttcatattagtctattggcatgtgctttgacaaaaagcaaacaaaacatgtaggtaacaaagatgaaagataaaatagaccaacatcaagaaaaatggcattctgagttttgatctcagagaactagtcccctctctatgttccaggaatgacagaaaatgacatatttcaaatacaagttaattcttttcttttagctaaattgttcacgattgaatggtgcttttatacgtcaagaaaatgatcccttctcttcctgatcttctattaaaaacaatgagacaattaatttttcctactgatgaatctgataatatgcactgttaaatgtgtggaacgcaaatttagagtttcttatacagatcagatactcagagggagtataattcaccaaggattcccctttggaaaatgatgtttaaaagctcagagagcactaattagattaagtacgatgatcatgagagaaatgttagattagaaccaaaaagtttttgaaagggtagagcaattcggaggagctaagagaagattaatgcataagaattgagtgactgtgctaatgacaaaaagaacctaaagggacacatttcaaatcagtcaatggtaaatggtggagaggtgtgagaggaaaaggggtcagggcccctttgacaaatattctcttaggtattttctcttaatagagggtccttgtggaggaagagtgatctaaaagtttgcatgggtaaaggaatacctgttgaattcagtaagaccttaaatgcccaggggaactctctggccttggcttagtaagcaatagaagtcactgaaggtcttgaggaaaaaggagggagaagaacgccgtaggttagagaagcaaatctggaagtatagtgtagactgtgggagaagagttcacgctggcgattagaggcatgtgtgagtttcgattgaatgtgtgggcagggcttacagatatgagatgactctgagatattctttttttttcttttttttttttgagacggagtctcactgtgtcgtccaggctggaatgtagtggcgtgatcttggctcactgcaagctctgcctcccaggttcacgccattctcctgcctcagcctcctgagtagctgggactacaggcgcctgccaccacgcccagctaattttttgtatttttagtagagacggggtttcactgtgtttgccaggatggtctcgatctcctgaccttgtgatccatccacctaggcctcccaaagtgctgggattacaggcttgagccaccgtgcctagccaactctgagatattctaaaggagtggggggcttacagagaggaatcatggacaggctagatggtatctttgaagttatctgatccaatatactacccaatacgatatgtctacatttaacagtccatagcttacattagagttcactctgtgttggtcattctatggattttgactaatgtcatacatccaccattacagtatcacatagatatcaatttctttttcagagacagtgtagactaatgctgtatcaatgaaggaattttctttgactaccagatatctgtttctgtaatgttatcagtggattcccactgttctgccagaagttttgaatgttcttcctgctttgcaggcagtttctccctaaagaactactgaatattatgtcatactcccaacagggtaatatatgtgatgtgcactgtaaaactttccaaaagttattaaaatactgagttccaaatgcacctggccccaaaggttgtggatttggagttgtggatctatactccctagtatccccagcaggatctgggagaggacctcagaatcaaacaacttcatatttctgcagtgaaagaatctctgcacataaatactcacactaagtgggataaagagagataaatatctctacaccactttcagtcaagttttgttgtgaaagggaaaacttattttcttaaaaaaaaaagattttgtcttttcaaagcattttggatttcagaattgtagataagggatggtggacctagacaacacatgacaaagtgatataaatgccactgtaaaaaagactatggcactccagcctgggcaacagagtgggaccctgtctcaaaaaaaaaacaaaaaaaaaaacaaaaacggccgggctcagtggctcacgccagtaatcccaacactttgggaggccaaggcaggcggatcacatgaggtcaggagaccagcctgaccaacatgatggaaccccatctctactaaaaatacaaaaatcagcttggtgtggtggtgtgcgcctgtaatcccagctactcaggaggctgaggcaggagaatcacttgaacctgggaggcggaggttgcagtgagctgaaattgcaccactacactccagcctgggtgacagagtgaaactccatctcagaaaaaaaaaaaaaagaaaagaaaaaaaataaaaggctatgggcccatagagaggcaattggttcgtatctttaccccttagctaagctgattttagataggtcaagaggaagtgataagggaatggagccagtggcatggactatttgtatgagaaatttatggtggggcgcggtggctcactcctgtaatcccaggactttgggaggccgaggtgggcggatcacctgaggtcaggagttcaagaccagcctgaccaacatggagaaaccccgtctctactaaaaatacaaaattagctgggtgtggtggcacatgcctgtaatcccagctactcgggaggctgaggcaggagaatcgcttgaacccaggaggcagagatttcagtgagcagagatcgtaccattgcactccagcctgggcaacaagagtgaaactcagtctaaaaaaataaaagaaaataaacgtattaaaatgtttcaattgctatgtttttgttaaaagcaccaggaattccaactcaaagaagctaaaacattaaatgtgtcagctaatgtatctggaaggatcagagagaagactagcataaggcaaggcttgatctggaagctcagtgatactatcaagagctcagatccttttggcctctcagctctgccctgtaacttatacttttaggtgtacatgagcagggaaaacaaaactgaagaccgtagcttaggccatatgccccatccatccctggaggtaacaagaggaaagtcaccttccttgggactgtatagatgcccaaacagaaatctgagggtattgagaagggggaagagggattggctggtgcagagggaagcatttgacaaagacaaggggagaagccattgaaaggaggtaagcttttaatgtttgttttagatagagagtatatgtgtgtgtttgagggcagaaaagtggggatggggtgagttgaagtctagaactcattagagacgtcctggaggaggaggggaagagaaaggatttagacagagagagacagtgggtgtgtggcttggtaactagattgtggcaactggctctggtatcctgaacttgaactgcctgatagatgaacgggcacacctggttactcaaggcagtgtctcttggggattgctgtggttacagagcagttttttctgtgaggtcaagccacagctatagcctcaagctacttgagagctaaacctatctgtttaattattgctaaaaggattttattgttcactatgcacaggcatataaaaatgcactttgaggttataagattgggtccctgaactgacccttttttggtttcaagcagcaaccattacagaattttaaccagataaactgttagtaaaacatatccacagtgattgccacttctctgctatctttatatgaagatagcattttttagaagaaaaactctttattgagtatgatataaaatgcaaacaactaaacatcataagatgacaatttgatgaattttcaccaactgaaaacaacgagctaattagcatccacgttgaaaaccagcacatcgctgccactccagtagctttcttctacatgttattctgaccatgtttatgcttaatccagtttagggataaggctaccaaaagcatgtagtctgcctttgaaataatatcatggcaattttagagtcaactgttaacttggttatgtcagtatttcactgctggaagactgatttcagaaatactttgctcccaaaaaacacatctttaagcaaaaatctgaattgcccataacaataattttctccttttggtacatcagcagaatctgtcaaatggaagggtgaattgatgagatgtagaggatatggatctttattaagcagcaatgagtgagcaaagaagcaaaatattaaatagcaaaaaacaacaaacaaacaaaacaaaaaaagaagtggagactgtaccttactatttaattcaggatactaaatacatactttgcaagtgatggttatttgctaatagctttttaaggtgttttactttgtaaagattattatagaagaaactgttcttcttacttcattttatacaaataataatgtcagtagtatttagtcagtggcccctattttttttttttttttttttttgagacagagtcttgctctgtcagccaggctggagtgcagtggtgcaatctcggctcactgcaacctctgcctcctgggctcaagcaattcccctgcctcagcctcccgagtagctgggactacaggcatgtgccaccatgcccggctaatttattgtatttttagtagagacggggtctcaccgtgttggccaggctggtctcaaactcctgacctcaggtaatccacccacctcggcctcccaaagtgctgggattacaggcgtgagccaccgcacccgaccaactggccctatatttttatagaacatttatatatttgtttttgttattctaacttgtttctgttttattagaatatcagtgcagatctgacatctatcaatctacataaatatatatatataattcaatccaataaacatatgtatatttatgtaaatggatcttgagatgggagtagggcatgtgaatttggaaatagtgttttaaaacatcagtgggtagctattttatagttacttgttttatagtttttatagttacttgtttttctgaggtaggatagaagaagcagttgaggactggaataggaaggaaaaggctggggagggaaagttgtagaaaaaagataggaagctgagaggtcatgggagctgcttttgctgaagttgttcatcaaaccaggggccagatggccaggctgaggtggaggggaccctcctccaatatccctgactcccttgcctgtgcttggcctctgctgggactgagaactgggagagtggctgccattggcttgcctgctcccaggcgattcaacactttcctgttccctttcctccaaccatacattggctcccgggaccaggccgtgtgtttatgtgtgtgttcattcagtcataactgcacaccatcgattcagatcacacatatttatcagaagtgtagccaactttgacgtttgtttggttgaatatcaccagtagccaaaaaagtctggtgaatgtcaactttaaaaaaaattgtggtaagagcatttaacatgaaatctgccctcttaaattattttttctttatttttgagacagagtctcactctgtaacccaggctggagtgcagtggcacaatctcagctcactgcaatctctgcctcccaggttcaagcgattctcatgtctcagcctcccgagtagctgggattacaggtgtgcgccaccatgcccagctaattttttttaattttgtttttatttttagtagagacagagtttcaccatgttggtcaggctggtctggaactcctgacctcaaatgatctgcccaccttggcctcccaaagtgctaggattacagatgtgagccaccacgctcaacctgccctcttaaatttttaagcataaaatacagtattgttaaccttaggcatggtgttgtgtagcagatctctagaacttactcattttgtgtaactaaatctttatatccattgaacagcaactccccattgccccttccctttagcccttggcagccactgttctactctctgcttctatgtgtttgactaatttgattctacgtagaagtgagatcatgtagtatttgtccttctgagactggcttctttcgcttaggataatgtcctccaggtttatccatgttgttacctatgactggattttcttctttaaggctgaataatattccattttatgtagttaccacatttttctttgtccattcattcaccaatggacatttaggttgtttccactttcttgttattatcagtaatgctgtggtgagcactggagtacaattatctctttgagatcttgatttcagttcttttgggtaaatacccagaactgggattgctagatcatgtaatagttctctttttaattttttgagaaagcttcatattgttttccatagtggctacccatttgtgaatgtcaacttttaagtaactctctgattgtgatttgattgttgtgggtacaatttatacttcccaagaaacacctatgccagcagaaatacctgtgccatcctaagcttttaacttttgataagaaacgattgaatcgtatataacagagaaacttgaatattgagacgatcttgctctttggttttcaaaaaattgtgtttttctatcaaagatggtttaaatatagcattttccccttccaaatgtggtttattctcaacactttagatttattactttttgccttcatttaaatttccattcgggttaattgaaatgtaacagatggtccttgacactttgacactctctgtcaaaacgcattagtggaaatgcagcatttcaaggggaagtttgtacccacaggaaaggtgggattatacctacagtctatgaaatagaaagacagtcatttgaaagttcagaatggtaagttatctgccatgcccaggtcaagagaagttacaaatgtgcttctgttagtggaaaactatgagagtgaatggtgattggaggccaagtaaattatagagggaggagttaaggctgcaggctggagaagctagaggagaccagtggcaagagaggaccagggcagattttagatgtgaggacactggtggtgggcctggaaggcttggagagtgaaaagtgaaggaagaggaggcaggcaggaggaaattcaagtgaaataagatgagaagtggctcttgcaatatgagagaggatctaatgatactgttgtatgcagggatggaaggaaagtgaggccaagggcagcagggtcaatagaaaagggagaaaaaaaaacagtgaaattagtttcctgtaaccccaccagtgtcctacctgtctgtagagtactggccatcaaatagctcccatggaaagctagcatgtctcgaaaggtaattggatacagagcatcatctgtcagtgtactgaccctcgggaaaagcaagagcttggtttcctgacttgtgaataaacatttactctcctaagaaaaattaaggaattctgtctcatccacttaagtctaagtcaaagaaccgaagggatgaccctgcatcaaaccaaagtgagtccacttgtttgatcagcttaaagggatattttcatttgtcaagtgttccagaaatagtacataagatattgatattgtgtatttttgctatcaactggtaataattataaacatgccttgtgcagatttcttcttcatcaatttatccaaatataagggtcttggccaaagatttaaaatatcccaggtgtaacatccctaatgttatcttcctgaaagaatgaagtaggttcggatggagaagaaatacctcagtttaagaaatgaaaagcatctgctaataatgaaagaaaattgtacttattcttctgggacttcacaatgttccttctcctacccaggcacgtcctgagcacagagtgctaagtagagtattgccctcgggaggttcacaatcagcctggtgaaagatggcttgtgttgacagacaagccaccttcatctggaacttgtaaatttgagctggggacacatttgtcacatagcaaccttgaagtaaacagggtgattcctcccccagaaataggattttcgtttgctgagggggttggattagattatcttcctgccctggtacagctctagtcctctgtggcccattcgtctaccttttaaaaatgcctgtggcaagggattctcaaatcattttggtggaggtatagactgaggcaacatcattaagagggcaacttgggaatatctatcaacactcaaaatgcacaaatcatttgggcaagagttctacttgtagaaatttagcttgtacacttagttgcataggtgtaccaatatataaacacaagatttattgtagcaatggttgcaataagagaaaaaaaagtgaaaaaatcctgtatactcatcaatgggagacggatttaaaacattatgtatacccatgcaatgagctaataatcaatatttaaaagtttgagatagagctatatatgttcatccatatgtgttcttatccccatgagggcctatattttttatcttttattcccctctgcatttaaaacagtatctagcacatgtaggtgaagtacctagcacatttaagtgaagaaaggaataatgaattagttttaaaaatgagtttaaagatgtctactataaatgcccaaaaggtactgtgtatttcctaaggcatttcgtaagtggatcttggtctttcccagttgtgatagcagggggtatgagtattttacacagctctgccttgggagagtagatgattttggttagtagtgagaaggcttaatccaaaatcttgataacattctctagggctgtacaggtggagatggggaaagagacactaaatagccatctgcaaataccagtcactgttcagagcatttcacgaatgatgctcatggttgcaggacgctttgactgtgcttgaaaagggaatatgagacaaattgccagctatcccatttgaaaacattttggttgatttcttgttagttttaacacaaactctttagctcagcaaagttcactccttaaatgagatgaaatgtttccaaagcatatatttgcaatgaacatgatggatttacacttcttcatgtcagggagtgaaaagatataaacttagtgaaaagagggtaatgcttaaaatgtccttttccttaataaataatgtaagagatttaaaattcctaaaattaccctaattgttatctgtgtgtccattaattggaaaccccaatttcattcccctttgctgttttatttctttgccctcatggttatttttattttttattctgtacatttaaataaagcaccggcggggggatatactcttacaggattttgaaattttatagcctcacacttccaagttctttatagaagaaattataaagcctaataaatataactacacctgtcggttaaagatacacattacggaaaataaaaccgctgctcattttcctgtgcatgtttgtgagagcatttaaggatttgtttgaaaagaactgctgaaaatatggaaacttgacatcgtcacgaaacttgctgagacgctgggtgctgatttacaagaacacgccctcagcaccctcgttgcggtagataagccaactcttggcagactgttgtagccacagaaactcatctgactctgctacagtctgacgtagaaacttagaagagtatgtagctgctgattgacagctataggtctgtagggaccgtagtcttggtactctccagccttcttatttggggggaacagcactggaggagattagccacattagctagaacctgcttccatctttatgccctcataatagactaaaggaagaatatgaagaaatgtattggaaatttggactttctcatataaatggagccaaagccttatttgtcaattattctatggaaacaattgtttttttctacccctcaacacctccacccctactttttaagactttttttttttttttgagacagagtcgctctgttgcccaggctggagggcaatggcacaacctcggctcactgcaacctccgcctcccggtttaagcatttctcttgcctcagcctcccacgtagctgggattacaggcatctgccaccatgcctgactaatttttgtatttttcagtagagaaggtgtttcaccatgttggccaggctggtctcaaactcctgacctcaagtgatccacccgcctcagcctcccaaagtgctggaattataggcatgagcgcctggctcaagactttcaaatctaacacattttattttttaatagaatgtattctttaaaagttttagattgtaagaaaaacagaagatagtacagagaattcccatataccctgcatctagtttatctctatcacccaggctggagttgagtggcacggtcacagctcactacagcctcaactcctgggctcaagcaatcctcccgcctcaggctgctgaggaccacaggtgcacaccaccatgccttgtattgtttgtagaaacggggttttgccatgttgtacaggctggtctcgacctcctgagctcaagggatctgcctgtctcagcctcccaaactgctgagattacaggtgtgagccaccacaccaaagagctgggattacaggcgtgagccactgtgcctggctagtttcccttattgttaacatcttatatgagaatcattcatttgttgcaatgcctaaaccaatattgatacattattattaactgaagttcctagtttattcttatttccttcgtttttacctgatactcattttctcttctaggatctcatgagaaggccacattagacttagttgtcatctttccttaggcatctcctggccttggcagtttcttagactttccttgcttttgacaaccttgacagttttgaggagtactgcgatggtatttgacaggatgcttctctattctctgatgtttttctcaggtcccatgttttggggcttggggacaaagatcacagaggtaaagtgccattttcatccacatgatttgtgactgttaatgttacctttgatcacctggctgaggtaggtgccaagttttccactctaaagttgcttcttttccaccttttccatactgtactcttcagaaggaagtcactatgggcagcccacactctttgtcaggagttatgctccccctccttgagggcagaatacctacataaattctttgcaattctcctgcatagggaattgcctcttctccgccatttattaatttattcagtcatgtatttatatcagtatagattcatgagtatttattttatacttttggttataatccaatgcttttttttttttttttttgctcatattgttgcatatttagccactggaggctcttttttttcttattttttttgagatggaatctggctctgtcgcccaggctggagtgcagtggtgcaatctcagttcactacaaactctgcctcctgggttcaagccattccccagccttgcctcccgagtagctgggattacaggtgcccgccaccatacccagctaatttttgtatttttagtagacatgggcttcaccatgttggccaggctggtcttgaacgcctgacctcaggtgatccacctgccttggactcccagagtgctgggattacaggcatgagccaccgtgcccagcctagaggctctttcatttagctcctgtgctcctttgacatatccccattattgtgtgtgtaggttctttgtttattcatttgtttgagtactttcttactttctggcactacgagatgctccaagctcatcttgtatatttcccttcccagtcattaattcagctgtttctccaaggaaacattatccctttattggataatggctttagaaggcaatacctgggctctacgcatgctcattgctactggagtatcatttcttttaggccttttcagctgacagagcaaagaaataaaagtgtgcatacaaacctatgtgtatacacatgtctgtacataacaatctctatattaagctcaacatgagttcatagtgatgaactttataatccattaccacatggaccattctagcctcctcccctcgcttatctgtaaacttccacttcaagggtgagaaacctggctccatagttggccttccacttacttagttgttcaaatcccaatatacatgcatagcagtatcagaattattaccctggacctccctgggaaacaatcgagtagagtacagtgctcatatgcagttcctttttcttttaggtttacagatgccatttatgtccagagctactgaggtcagcaccttttctccccatctccttcagtaagattgtttcataaatttgtcatatagttacattctcttatcatagtctgcattccttactgggatcccttgacctcctaaatcattcttaaagtctgcatatattaaggttcattctttgtgctataagttctgtgggttgtgacaaatacataatttcatttatttaccattacagtatcagacaaacagtttcactggtctgaaaatcccctcattcacctatacattctactccttcttcctgagcctctggcagccactgatttttttaatctttctatacttttggctcttatagaatgtcatataattcaaattatatggtatgtatcctttttagactggtttctttcgcttgcaatatgcatttaatgttcctccatgctttttccatgacacaatagctcatttatttttatcactcaataatgctccattgtatgcatgtaccacactttgtttatccatttaattactaagggatatcttgaccgctttcagtttttagtgatttcctaaagctgttatcaacattcacgtgcaggtttttgtgtggacataagttttcaaatcgattggattggtcaattcttttatgacgtgaaactcaaagggaaaagtggatctttttcatctaaacctggtaggagaggataaatcactttccagtggtttgtgattcctttataattatataaaactaattcttttcatttctatccaacttatttatttatttatttatttattttgagatggaatcttgcgctgtcgccaggctggagtgcagtggtgcgatctcggctcactgcaacctccacctcccgggttcaagccattctcctgcctcagcctcccgagtagctgggactacaggcgccaccaccatgcccggctaattttgtgtatctttagtagagacggggtttcactgtgttagccaggatggccaccatctcctgaccttgtgatccacccgcctcagcctcccaaagtgctgggatcacagacatgagccacggtgcccggcctctattcagcttcttaaaattatcatgttatcaacatttatcctcttcttctgccactaccacccttagttttaactataagcagctgtactaagacattcagcacctgtttaggaactaagaagttttccgtaatatctatttgagcatgagtaccctgagcatgattgacataatgatgtacaaagtgggccttttctagctactcactgagcaaaacctgctgtcgcaagaagcatcaatggggaattctccagcggaattgcaatgaactattctggattcccagtttaagggacggaggtcggagttctgctaacattccaagctcgactttgtcagtgttctctctagttctcttcttgctagtcccttagatagtgctttcatcatgccgacactcagggctctctctgatagtaggctcccattgtcactggggagcgagagttgaaattcttcacattagttgaattatgctatttgctgaatgctgtgtactggagaagggagatctagggccatcaggttcatctagagaatttttctttgcccaaaggcaggagccaaatgtaacaagatgctaagaattcaagaagaagaatcatcatataagatgaggggctgggtgcagtgactcacccctgtaattgcagcactctgagaggccgaggcaggagaattgcttgaacccagaagtttgggttcaagcttgagcaacgtggtgaaactctgtctctatgaaaaatacaaaaaaattagccaggtgtggtggcacgcacctgtgatcccagctacttgggaggctgaggcgagaggatcgcttgagcccaggaggttgaggctgcagtgagctgtggttgcaccactgcactccagcctgggtgacagagtgagaccctgtctcaaacaaaaacaacaaaagaatccaaaaccaggcacttccaaaccagggagcataggttgttttacaaactcactgcccttttcttttccaatatccctactatttgttttgctggtggttatggtgatgggaaaggatgtaattgagaatggaacatgaaataagaacttggtcataacctgtataaaactgtgtcaaagtttactccttaaatgtgtacttgaaacacccatttcttgtttccagggtgccaacagatgtcgttttgtaagaaaagctccccaaaattctgtgcatcggactcatttatgcaatctctgcctacattgggaccccactgaagccacgacccctaaggcagggctggactgccttgcaggtctatgaagttctccattccaaatctctctcaattgtgatttgcattctacatttataggcagataattagctacattgcaatgtctaatatctttcatatatatatatatttttgtttttttgttttttttgaaatggagtctcactctattttccaggctggagtgcagtggcaggatctaggctcactgcaagctccgcctcccgggttcacaccattctcctgcctcagcctcccgagtagctgggactgcaggtgcccgccaccacgctcggctaatttttgtatttttagtagaggcggggtttcaccgtgttagccaggatggtctcagcctcctgacctcgtgatctgcctgcctcggcctcccaaagtgctgggattacaggcatgagccactgcacctggcctcacatatatatttatacagatatttcagtgccccttcggaggcttatgtcctgaggtacatgtttggcaaatatcaacattctataggaaatttcaactggacctatttacagattaaataagacattaacctaaaaacagaatcaccaattgacatttatttatttatttatttattgagatggagtttcgctcttgctgccccaggctggagtgcagtggcacaatctcagctcactgcaacgtccacctcccaagttcaagcgattctcctgcctcagcctcccaagtagctgggattacaggtgcctgccaccacgcccggctaatttttgtattttcagtagagatggggttttgccatgttggccaggctggcctcgaatgcctgacctcaggtgatccacctgccttggcctcccaaagtgctgagattacaggcgtgagccaccgtgcccagcccaccaattgacttttgaaataagtgttggtattatgaactattcatacatgccaaagaacatatatagaatatatgtgttgtttaaatcataataacataaacacgtggtatcctccagctagtttaagaaacacccagcaaaggtatttgccctcaaagagtcctgtgtgccccttcctgctatcctttccaagtttttctccccttacagctgaggtctttcagaatgtagaaggacctcatacgcttcacactgggacctacagaggctacccaactctccaaggtgacccagagacatagaatggtacctgtttctactaattcctgctccagtgagtttttcactacatcaaatttttgacatttattttgaacaaggaatatttttcaagtcaaaataggtacctaatgggctgggtgcagtggctcacgcctgtaatcccgcactttgggaggctgaggtgagcagctcacctgaggtcaggggtttgagaccagcctggccaacatggtaaaaccttgtctctagttaaaaatacaaaaattggccgggagtggtggtgggcacctgtaatcccagctacccaggagggtgaggcaggagaattgcttgaacctgggagatggaggttacagtgagctgagatcgtaacactgcactccagcctgggtgacagagtgagactctgtctcaaaacaaataaaaataaaaagtagctaatgattattatctataaacatcctctattcgttttcagctcatataaatgtttcttttttctagatcctcaaaggagcaaaggctcaagatttctatctcatcacataaagaaaaaaatgagggaatggaagggatttataaataccagagactataactctgtgactataaaacagtgacaaattctgacaaagtgctacttagaatcctctacgatcgggtggtactcagaggtccatgggccagcagcatcagcaccagctgggagtttattagaaatgcagaattttgggccatgccacaggctactaaatcaaaatctgcatttaacaagatccccaggtgattcatatcacaatatagcatgcttcctagtccgatgtccaagattcatagttaaattttcacttaattcacatttaaggcagagaaaattatttttaaaactctgggaatttctcataagaaaataagaatagtgttttctagaatggttttatctcctaacatattgtttcttatgtacgcactattaatgcatccttttaagtgagtaatcagttgtggtatctttatcacttagacatttgatgctgtcctaaggtaaataccagtgtgggaaaaaaaaaccacagtcttatctcttacttctgctggtctagaggtgggatcagtagcatgcatgtgaagtttcagattgcgctaaatgaactcatgtcaacttctttcagcatcattgttagtgacagttttgaggacatggtgataaaataaggaaatctattgagtcagcagtgcaaagtgaaatgcagaaagtgcaacagaaagtgtgaatccggaaagttaattcctgtgtacgtgtgttttgattgccattcatatgtcaaaccctgaactataagtcctgagttacatgaataataacctctcagcaaattgactagaagtaacaattgaaatatatttcaatatattttaaacgcatgttgaacaagaagccctggaagaggaagatcaaaactactttgtttactctgcctcttccagggcttctcaactttgatactattgacaagttgtaggaggtggacctgtgcgttgtaggatgttagtagcatccctggcctttcctctcagtggcacccccttcccctgagatgtgacaatcaaacatatctacagacattgcagaatgtcccctggaggggcaggggggtggaattgcccccaagttgagaatttctgccctaggcagtgcctatcatggcccctgcctcccatcctggcaatacagtcactcttcctggtgacccaacagcagaaccaatgtcattgtcctcctttccagagctctgtgctccaaaggtggggtgtgctcctacccatgtcacttcaccctcatcatgcttatcatccacctttcttaatcataaccttcatcattatgtgaaactggggacaaatgatctctttcaaatgactggcatatagagttgatcctcatcctttgaggatttcatatttgtgaattcatctagttgccagaatttattcataacctccaaatcaatacttgcacacttctgtgatcatctgaggacatgtgcaagatggagaagaatttgagtgaacaaacctgcatgttctcagcttaggtcaaacaaggtggcatttggccttcttgttttggctctcatggtataaacacgtgtcctttttgtggtctatttagtactactttttttttttttttttgcatttttgtgcattttgttggtgacttacaaatggctcccaagtgtagtgctgaagctctgcccagtgtccctaagtgcaagaaggctgtgatgtgtcttgtggaggaaatacatatgttagacaagctacattcaggcatgggttacagtgctattggccacgagttcaatgttaataaataaacaatatataactgtctttaaataatcaggtgtctttaaatagaaacacacatgaaacaaagttatgtattggtcaggtgatgaaaatgtgaccagaggctcacaggaaccgaaccctgtatttcccctaggagcaatggctctgtattcactaattcagcatccacagtaattttatagaactactgcaaataatgataattgactgtattcatgtgggaaagcccacttgaaggatatataaaaagctggtaacaccagtgactccaaaaaacagaattaggtggctgagggacggggtgggaggggactctttactataattccttttttgttttgggctacacaagtgtagccatcaaaaaattaaacttaaaaaacaaatgcaaataataaaatgaaaaaaaaacaatttaatcatgtttgtctttaatctcaggaaaacaaagtaacgcctatcaaaaatccaatgtatcaaatgacacccaaatgccctccctggtcttctagaccttccacaagctgttctcatgctctgtctgctcagctctgcttctcaccacccgcttcatgagtgtatctggttatccctctggattaccccttgccctgcaaagtactcagtaactcagttactttggtgttgattacttcacatgtctcaacagaaacacctttcttctctctacctagcaacattctgctttttcttcaaaatctttaaatattttcctgaccatcccactctaagggacctttctcttcggcttgctggaactcattagagtttgttataacttaccattgtagccaactgactttgttggttgtgtttaagttttgagtctccctaaattcattacaagttattgaggatgggattggtgtccttcttggaactccttcagagccttgcatgtaatagaaactcaataatgttgattaattatcctttatcattccataccacagtttttttttggagatggagtctcactctgttgcccaggctggagtgcagtggcacaatctcagctcactgcaatctccgcctcctgggttcaagcgattctcctgcctcagcctcctgagtagctgggactaccggtgcccaccaccacacctggctaatttttgtatttttagtagagacagggtttccccatattggccaggctggtctcgaactcctgaccttgtgatctgcccgctttggcctcccaaagtgctgggattacatgtatgagcccatcatgcccagcctgcagcctgtctttctaagtgtattcctgtccagttaggtaaaagtgaagctgcctaggtaattaagttttaagagtagtatgaagatgttggttggagacctgaaaaagacatgcaattgctcttcaaaatgagcgaaagtagaattgtgccatttgtgaggaggcgatccagaaaccagatttttatctcaaacgagtcacaaaatgggaagggatccaagtgtcgatttgttgaattcctgctgggctacacactgtctgtagcacctagtatacctcattttatttacatgagcctatcaggtagctttaatgaattccattttataggtgaacaaatggaagtttagtcactagcatatgtgttatgcagctggtaattgcagaatcgggataagaggccaggtctaaaggcctatcatgttgggttgtccccaaacagaacacataataaacattttgaacaaatataagttatttgctgtaaattcacaggattacacctctgggtaaaatacagggcaagaatgttttgagatggccccagccaagcattgtacatctatgatatgctgcaagggaggaggaaacagaacgaagaactttgccctccttcaaggcaactagtatcagctagtgatagttctcagtcctagctgaacattggttccacctggggagcttaaaaaactatggaaggctttggaaggctgaggcagggggattaccggaggtcaggagttcgagaccagcctggccacatggtgaaatcctgtctctactaaaaatacaaaattagccgggcatggtggtggatgcctataatcctagctacttgggaggctgaggcaggagaatcacttggatccgggaggcagaggttgcagtgagccgagattgtgctattgcactccagcctgggtgacagagtgagactccatctcaaaaacaaacaaacaaacaaacaaactatggacgggaagggcattggacataattagttttgggtgggactcaggtaccagtaccattataaagctttccaggtgattctaatgtgcaaccagggttgagaaccactgagctaaaaccacagagaggtacacggatcaagtggtttctttagttcagtggtttttaagtctggttcttggaccaccagcattagtatcacttgggaacataatagaaatgaaaactcatgcacttcacccaagactcactgaatcagaaaccctgaaggtggggcccagaaactctatcttaaactctctggatgattttgttgtacagtaaggtttgagaaccactgctctcagaacaggcaattcattgaaaaggaaaaacaaatagccaataaacatatgcaaagatgttcaaccacttttagggaaatacaatggaaagtaacaatgagggccagtgcggtggctcatgcctgtaatcccagcactttgggaggccgaggcatgtggatcacctgaggtcgggagttcgagaccagcctgaccaacatggtgaaaccccatctctactaaaaatacaaaaaattagccaggcatggtggcgggctcctgtagtctcagctacttgggaggctgaggcaggagaatggtttgaacctgggaggcagagcttgcagtgagctgagatagcaccactgcactccagcctgggcaacagagggagactccatctcaaaaaaaaaaaaaaaaaaaaaattagccaggcatggtggtgcatgcctgtaatcccagctactcaggaggctgaggcaggagaatcgcttgaacctgggaggtggaggttgcagtgagctgaggtcttgccactgtactccatcttaggcgacagagtgagactctgtctcaaaaaaaaaaaaaagtaacaatgagatacactttttaatctttcagactggcaaaacttgaaatgatcgataatatccagtgtgacagtaggagacaggaaaacattttatatacgactagtggaggggtaaaccaccaccactataacaaccttagagagaatttgtcagttgaattacagattacacatatgtatatcccaggaccaggcaattccctccttggcctccctgctaaagaaacacttataccacccataatcccaagactttgggagattgaggcgggcagatcacttgaggtcaggagttccagatcagcctggccaacatggtgaaaccctgtctctaccaaaaaatacagaaattagccaagtgtggtggcacgcacctatagtcccagctacttgggatgctgaagtgggagaattgcttgaactcggcaggcagtggttgcagtgagccgagattgtgccattgcactccaacctagaccacagagtaagatgctatctcaaaaacaacagcaaaacaaacaaaaaccacatgcacgcacacacttgtactagtgcataaaatgatgaataaaagatattcatatgcatcatgctgtttttgcagtgggaaacagcccaagtgtccatcactagaggaatgcctgagtatactgaggccagccttactatagagtccaagcagcaagtgacaaggatgaggtggctctacatgtgcacgtgtagaactgcccccaagaccttgtgaaatgcaaaggcaagttgcacacacatggatcaaatacaatttatggtctacgtgaaatgtggtgggggaaacatccggaatggaggtgtggacaaagagacttcagccttatctataattttaaaatttctgctaagattattatccaagaattttttgagcaataaaaaataattttggggtgtgaaaaaaatttctgtggaaataatatactagattgatgatatattatggtatacttaataatttttggtcatgaagctctgagaatctgacaaaagtttcccctcccccacaaaggcacaatatgtttgttcaatttgaaggaatttctagataacctgaagcccattcatagaccccttagggcttcctgaccccaggttgagagcttctgggctgctcagccttcaagggttctaagtggttttactcttctgtcctgggctccatgaccccttctttgtcgtatgtgtctcagaggagtcataacatctgacagctatttttatgagcatcagcagctcttctcctgcagattaaatttcaccagaaggtagattttcgctgacatcttaatacttggaaaggagcagatgatccttgaggagtgagtgaatatagcatatggtttgctgagctgcaaacagaagctgatctatgtcaaggaagcttcaagtgttacacatgtgctcttaggcatcatcaggttctgtttttaagttctgcagtgtcattctccccatgcacacagacccttttcagtgttttccacttggcttatatattaaaagaagaagaaaatagcaagaaaagattatctttccactgttagatttttaatcgatattctgttattccaaaatggtggcagaacaaaggtttttatttgccttattttcgtctactttaaactgtcttaaatggcaaagccagttctcataaaagtgaaactccttggtaatctactttttattaagtcccagagctgccaatagatttatggttcttaggtagtaagtctgattaaatgtgatgtgcctgccatttccatggatgccttgcacacactgtcgacctcatctctctgtgcccacccaggacctcattgctgctcaccctgtagcaggtttgagagagctctggacaagttgactacaggtggatttatttctcctttctctagcctcccatggatgcacttacattctaagtaggaaaagacaggtctaaatattatatgttatctgagaaatttggatggtcattcctttaaaaaaaaacaccatggattttattcagtagggatgcaactggatattcttgagtcttttcccatctggaataataatttctgcagctggcattgaagcctgccccttcatgagctggtccaacctctctttacaggttcatctctcattgctttctcccataaactattgctcccagccacactggcatcctttcccttatgaaaatccctttcttcttctgagtctttactcatgctctgctaacttgccctcatatggcccctaccagttcatttattttattcgctatcatccagatccaaatctagatttttcagaaatttctgacatttctgaaaaatctagattttcattcgcaagtcaaccccatcaacagtgctgagtctcctttgcatgtttgcaaaaccttgtctgttgtgctcataaggtacttctctatgaaaggtggtattgtacctgccctcagtatatgtatgttgagcacttactatattccaggcattcttctggttccggtgatatgaacaagttttgttctcatggagcttgtcttcaaatatgtgaggcaggtcaaataagtactgtacacaaattcaatgattccaaagagtgaagaaaatgaagcaagatgatgtgataaagcgactaaggaggagagaggctgctcagtgaagatctcttgagaagaacacatttgacttgaaatgtgtatgatagaaggtgtcagtcatgcaaaaatgaggggaaagagccttccaggtagaaggaacagcaagtgcagaggccctggggtaggaaggagcttggcatgtgggtgatcataggtttcctagatggcaaaggatttttttaaaagatgtctgtatttctcttacatcatctagcacataataaagcaatcagctgcaagactcttagctccataaggatagctttcatgcctgtcttccttccatgacccagcccagtaatagcacttataggcactcaaattgatgaatgtgtggatggattttcactgagtaactgaatgccttatctctgatccgacagcagttttgcagcagaaccagaatggacaaaataactccatcatctcctacatgctagtctgtgctgagccagcttctctcaaatatctgtctccaaggtttggtgtcaccattcattgaatgaagtaagaacagggcacttcccttccggaggaacgttgtacagttaagtgcaatcgcatataggaaatggttggaacttttggaagcagctcagtaatttcagacaattcctacagcatggctcagcaggcaggaagccagaagtcattgtatattaaactttacccatgcaacagtgggaatgcagtgtgaccagtccctgtcctcgccactgtgggatttccaaggctggcacctcttttaagcttttggaatgtagataaagcattccatcatgttagcgggccctcttttacctctcctgctgccgagtttattgttgtactaattccagggctcccatctggctcttctcttgcattctcccatggagaagcctgtgttaaactcattcaaagtaatccctactggcatggtgtttttagcgtatggaagagactgtccattcatagaagcaataatgtggtaagatcacttttcaagagtatcagttttaataaagaatagaatcaaaaggtttcttaaagtcatgaacctccacaaaacatccccacctcctcaaaacaaaaaagagagttgaaacttcatgcctactttggttttcagtggcaacgaaagaagcttaaaactactgtaggccgagcatggtggctcacgcctgcaatcccagtactttggaaggccaaggcaggttgatcacctgaggtcaggagtttgaggccagcttggccaacatggcaaaatcccatctctactaaaaattcaaaaattagctgggcgtagtgacaggtgcctgtaatcccagctgctcaggaggatgaggcaggagaatcgcttgaactcaagaggcggaggttgcagtgagccaagatcctgccattgcactccagcctgggcaacaagagcaaaactccatctcaaaacaaaaaacaaaaaaaactacttttttttttgaaatgtttacatttttgaaatgtttaatttcttctttcagtgttatggcagtggattagaatatggaattattaaagagtaaagattgggaccgccgtgttcaaatagagaaactgaggccaatatggaaaaagcactgcgatgctctccttccaatgaaaccaagacaaaccagttcaccctacgaagaggccaaatttttcctaaacagcaaaaagtagatgctttgcaagtgatagttcctaaaaaggatcctcattctcagcactctgctgctgttagcactgctgatggcagtccagagctgaatacatgtgcagagaacttccatttgttaacaaccagtcagggaacttcagagctaagttttatttttgcccaacagcatttattaacacaaccctgttgtttttaccagttgaatttaagtgtcaggtccatccatgacctggtggtggccagagtttcatattgtgtgtacaataatatgtagctgatgaaggtgggaagaagagttgggatgaaatggtagggtccacaccttctggcttatcccgttaccacctcacaattactatctgagtgggcaatgcttcagatagagtttgagcttagacagacatgttagtgatggacctaatcatttgacacacctgtttgccaattgaattggagtccagtttgggggctaaattccccaaatatttcctgcttcacaagtcacacccccaaagcactggccagtcggtaacatcagagggtctcctacatcccaggacccacggtccagatggcttctacgccaggcaaccaacggaccgttgtgcaaacacagtctgtggtttctctggctggtgtagaacccagtctggaatgaactgggaagtctctcatagctacatgggggcacattaggaaggagtattatttgccaagcagttaaaatagaactcattgctatttggtttctactaatttccagaataagtgatatcctgtctttttcacgtggtcccaaaaagaaatatttgactattggaagtcaatagacggggaaagtctccttaaatccttctgaataaaaatcttcctattaaatcctacgtgtcaccatagccagttttcatgacaaaccttccatcttggaccacataaaaattcagttaggaggttccaatctaatgctaaatgtttgctcaatgcacttacactggttttaatttagctttccccgtttattatttcatgctttgggtagtgtgactctgagccaattgctgtgagccatagactctgcaaatgcaaactaaatcctatgctaccattcatctcgaaagtcctcattatacttcctaattaaagctcattttacacattcactcatacaatagataggacaatagatattttgagcctccaagatgcatttagtatgataggactggtacttaatcactatgaaagtgagtaagataaggtagacaactgttgcccccacagagtctagtgggaaggactcatgaataaaaaaggtagcaaacagcaatatgttaggagctagatttgagagtgtctcacagtgtggcaggaacacagtggggacacgaaaagtaattcttgcaagggtaggaaaggtttccctgaagaggagacaacattgcaatttattcttgaaagacggatttgtggacagggaatggagaaagagcattcccagaaggtagaaccacatgagcaccagataccacatggagtggtaggaaagctcgataagtctggagaagagtcagtggtccagggtggctgctgtatagggtatggcagggagagtgaacccagaagaatctggagagatacgtagaggtgggagtcaagggtcttcagctaatccagttgtggacactatgaaacagacgcaactgaccagtaaaacctaaagggctctccctcccactcattgttacagctataacaacattgaaaccccaagagagggatgtaggaaggaagagtgtggaccttggtgcatggaagacttgagtgactttctgagctccaaaccttaatatttgtggttttagcaaattatttactctctccaaacctcagtcctcactcaggctcattatctgttaaatagggataagtatggcacctatgtcttaagtaggagcaaaaggagcaagtaaaagaatgtatgtgaaggactcagtattgtgactggcccacggtaagtaatcaacagatgctgagtttgtaataatacatgattgataatatctgatgaataacgtatgattgataataacattaccttggtcagggtcagtagagaaacccagcatatcaggtagatcagctgaggtcaggtttccccatcacttggtttctgagaatagccccggagggatttgcaagttcagccccatcccttggccagatttgcaatgtcaggaggacatggctggcaggctcattctgtcctcagatttcttaccccatggggatcaaggagggagagcccaagccttggattataaagacattcttgcatctccctgtgtaaaatgataatgccaaaggatcctggcaccaggcaagggcacgtggcccccagccaaggctccttgtccccacatcgattactaggtgcctactgatattagaccctggggactgtcttgaaagtccttgtttctttccccttaatgtctttgtttatttaatagctgcattgtacaagtgggaatggtgtgtatttctgtctcctggcagtggtggttgactttaaaaaaaatgttttaatcccagcactctgggaggccaaggtgggaggatcgcttgaggccaggagtccaagagcaacctaggcaacatggcgagatcctatctctacaaaaaaatttttttgaaatttaaaaatattttaatgcactttattttttagagcaactttaggtttatagcaaaacttagtggaaagtacagagatttcccatatactccctgccttcatacacagcatagcctccccgactatcaacatcccacaccacgtggtacatttgttatagtccattgacacatcattatcgcccttcgtccgcagtgtacactagggttcactcttggtgttgcactttctatgggagttgttgacgttttacaccagtagttgtcctgcggaagcctatccaaatagctcggggcaaggctggtgatgctaatttatttccaaataacctgttttggagaaggggtttaagattgagcagaagtgcaaaagaaagaaataaaggcatggaggaaagaaaagagagaaaagagaaaagaccattcactcacccaggccagtcccacccccagtctctgaagctcttggcaggtgaaggctaacgcagttcttgcctaagatgttcacactcttctcctgttccctaaatctgccttaccaccctctttctggagtaatagtgctgccttttcatcttttccttgcagctttctccctgctcaccctccaggtctgcatggtgagtgcccacccccacccccaaactggtatagggcgaagttttattttgagatggaagtctcaggaagggactgaggctcctctggagatatttttttttcatcacctaagataacttattttaattgctcttgcagtgttcttgtaaggaattctaagtaagctcctgctctgacagatgaagccttctgggaggttggctgtcccgggagccctgggtgatgctgagatgtcctttcaaacaggcacccaaacagctgaagggctccagttaccctagaggggagtgacatggacacttcctttgccagttggagaaagagaaggaggagggggagggaggtggtgaagagaagaacaggaggacagtgacaggagggtggggaggagtaaggaaaaccaaagggggacatgaagagccacggcagtcctgcaggctggcggaagggagtggaacatcctttctcggcctgcaccctctgctgtactctaggggaccaggatggcacccttctttaaacctcagggtatgagtagtgatttagcaacacaaattacacccctcctaaagtggcgccattctgcctgactcccctgggggatcattaagcaactgctgtaaatgaagctagccacctgtgtgctagcaagtggcatttgtcctaaatctttgattcaggatttaaatatgtattttaccgaagccatgaattaaaaggcatgcccatttacatatttttattttaccttggttttactcacttggattttctatatatttctatgacaactatggattgctttggtcatgaaaaaaataatgatttttaattataaaaattgaattggccaggtgcagtggctcacgcctgtaatctcagcactttgggaggccaagatgagaagatcgcttgaggccaggagttggaggccagcctgggcaacatagcaagactctatctctataaaaagcagaaaaaaaattagtcaggcgtggtaccttgtgcctttaatcccaactactcaggaggccgaggcaggaggatcacttgatcccaggaagttgagactgcagtgaaccccaaatgcaccattgcactccagcctggatgagagagtgagactctgtctaaaaaatataattaattattaataattaattattattaattaataattattaataattaaatatttaacatccaacaaaaaattgaattggtttgaaaaattttgcaaaactattttagacattttttaaagaaagggaccaaaagatacatgtccaattgttgatctaggttaacttgggggttggggttggaattgaaatgagagatgcgatatagtcttctttaactgtctctgtattgcctgacttgttaaatgaatacctattacttttttaactttttaagcaaattcaagaaagaaagaaagttaaaagaattattttgcgatgtgtttttaaaaagcaaggctgtttcatgaagtggaatacttttatctcactattttttaaattatataaaatttttagttgaacttaaaaaaaaaaagaaaaaaaaaaagacaaggtctcattctgtcacccaggctggagtgcaatggtgcgatcatagctcactgcagcctcgaactcctgggctcaagcgatcctcccagcttggcatcccaaagtgctgggattacaggcatgagccatcgtgtttggcccttgggctttattttattaacaacttagcaaattccttctgccaattttctttgtgtctgcatccctaagaaacattgagttttgcatttgtctctcaataggagaaggcaggcttttctgtcataatcagatatttctacccaaggaattcatgtatatatttttgactcagtggcttcaatggcttaaataactttatttttcaactatgaagtttcaaactgacagaaaagtttgaaaacataatttaataagtctccatgacccaccatctagatttaacaaatgtcatttttcatatttgcttcagatctttaaaataattgcaataataaaatactgtacttatctcctgccttcatccaggagcaactgtctccctaaagttggtgtgtatcttcctgcccagtgctttacacttttattatatgtgtttatgtccataagcactaggcactattgttttatattttaaaactatacctaaatagtatggcactatacatatatacatatatatatttttatatatattaaaaatatatataaatatatatttatttttttatatttttatatatatttttatatttttaaatatatttttatatataaaaatatattttatatatttatatataaacatttatatttatatataatatatatatttatatataaaaaatttatatttatatatataatatatatatttatatatatattttttgctgcttttcatcaatttttgagacatatataactcttattcattcattttcatggctgtatggcatttcatatatgactctaccacaatttatctatcctgtttatccagttgatggacattcaacgtacttctaatttttctctattataaaaaattaagcattgaacatccttctttatgtcttcttgtgcactggaatcagaatccatccaagggactttcctaggaatggaattgctaggaaattagttggttgaacagtctttttaaatataaaagtgagagagaaaaagagaattgaacaaggtcttaggttttctttagatttgttggtttagataaggattccaggtcatctcattttaccagagtacaaattctccaattcctttcatcgcttttctcccaaatttaaaaactgggaaacctcttaattaaagccctgattatggagaatttgttcaaactcaaagaactaacttatcttgaagctcaactgagacaggtgaatacgttgtttttttctctcctttctctcagaatattgagtatcactttagaatatattaaacaacctatcaagattaatgagcttattcagaaaagaaaataagtcctggtaagtagaataataaatttaaaattctgaatctttaaacccaggctgaaagatggcctctagtgtaagctgcattactgtgctgtgactttatgagccttctgtaatggtatttttcccctcctgctagatcaatttcagcgtgtttggaccagcagattccaggtgatggataggcagcttcattttaatagtctgttggtacagggtgacctgtagcctttccagaagaggtaaaatgaatcctccggttgtcaccccctccttcctcgctccaattccatcattaatccccgtttgaggatttgagtgctgccgaggactgacagactccatgaggttcagctgctgcctggtacatgtggtcacctgcagcttcttcagccctacatgtgagtaactcaggacaaaggtctacaacacctgccctaaatttccccaagtcttcccagcactcccagtacctcagtcttctgtgttttaaagtgtgatacatgcacaaggcgtgatgtacagcaggagctaaggtggtcgactgcgaagtccatcgcatcttaattgttcttaattttaaggtgtattttacagattttattgctgaagacaaggctaaacagcattacattttaaaaatcattttttaaaaaaagtacatagaagccgggtgtggtggctcacacttgtaatcccagcactttgggaggccaaggtgggtagatcacttgaggtcaggaattcaagaacagcctggccaacatggtgaaaccccatcttcactaaaaatacaaaaattagctgggcgtggtggcgcacgcctgtaataccagctactcaggaggctgaggcaggagaatcacttgaaccccagaggcggaggttgcagtgagccgagatcacgccactgtactctagcctaggtgacagagtgagactctgtctcaaaacaagtaaataaataaataagttaaaaagtacatagagatgcatgtggctgtgacagtattgggaagactgtattcaaatgactagatctgggagacactgattgaagcaaagcacactctgacttagggtcctagataagtccctgaatttatgtgagtgaatgttttctgggcacattctttcagttccttgggtctcagtttagcccctggaaaatgcaggcattggactagatcagggattctcagccctgccttcacctttgaatcacccggacaaataatgaaaaatgctggcatctgggggccctcttcaaatcaatttcatcaacaacttagggtagggacagggttaggccaggcatcagtatttttttttttttttttgagacagagttttgctcttgttgcccaggctgaagtgcaatggtatggtcttggctcaccgcaacctccacctcccgggttcaagcgattctcctgtctcagcctctcgagtagctgggattacaagcttgcgccactatgcccagctaattttgtatttttagcagagacggggtttctccatgttcgtcaggctggtcttgaactcccgacctcaggtgatccaccctcctcagcctcccaaagcgctgggattacaggcgtgagccaccgcgcccggccagcatcagtattttttaaaagctctcccagtgattgtcatgtgtaggtagcattgagagtcactaagtaaggtgatgtctgaggttcctttcaaatctaaggttgactgattttctgatcccatggatagactgtaaatgcaaagtaagttctgattcagtagcagtggaggaggctcattgtccctttcaggctcagccataacaagcgtgatgtttctcacactccaggattgggtcaacactggtctgaaagctccctgagggcagaggctgtgtcctttatctggctttcaccagttcctaccatagtgcttggtagacagtaggtgctcaataaatgttagatgaaagaatgataggttggagctcaggaatgtgatttactagggcatctggaattaatcaagtggtcagaaattggtccatactaaccaaactcgcaaggcactgaattttctaccagaattccagttgattattagtttattaagggaactcttctgggtccaggaagtgaaaccaaactctgttccagaacattctctttgtggtaaacaatatcagaaggtcgcttggtgagcacagaacaaaagttggatttttttttttttttgagacggagtcttgctctgtcacccaggctggagtgcagtggctcggctcacagcaacctccgcctcctgggttcgtgcaattcttctgcctcagcctccccagtagctgggattacaggcacccgccatcatgcccagctaatttttgtatttttgtagagatggggtttcaccatgttggctaggctggtctcaaactcctgacctcagatgatcctcccgcctcggcctcccaaagtgctgggattacaggcatgagccaccgcgcccagccaaaagttggagctccttatgtgcaatttccatcaagctctgaaggtctgatggctggacctccttctctgtaagcctgtttttatgtaaagtgtcaggatcagtcatccagaatcgtagtgggtgttggacctcctggtgacacgctgatagattttcattttccaccttcccctttgcaaatactcatacgaccactaccttgccgtttgcactcttgttaccataacacacagtttcctaagtgttggattgttttgccgcttgctaatgacatactcaagagaaacacttcaatctcctctgcaaggtcactccaaatcactcaagcaagacgggttacttctggaaagctgccctgtagacagctaatcccatccttcttgcaggcttgacttacggagatggcatttgctgaccttacgtttttaagagccatcttattttgagggctctagcactttgcccaccatctacaattaccatgactaaaaatacctcggagggtgaagaatcttcaaggggactttgcaagttggagaccgtattccttctatttcagtaccatatttcaaggcaatagccttgttcttgcattgagctacacattacctgccagacgaatatttcactttacagttgattggaagccaatcttgaagcggaaccttgtgattatgtcaccattgcccccttgaatgtacccaacagtgattttcttgacagcacctttactgcttagccactgtacgcagatttggccaccttccctgtgcaccttgccagggctgcattttcccccatgaaaatggaagcttccatcggtgcgtgtcggccgcaatcctccaagtaccatctctgtcttccaccgcccgcatagtataacttgagggcttccacataaacctaggataggagaaacagagatgtattttgttacctaggagctggtatttgtctggaggaaagtgtggaaggtgccgctgcaggttcaaacggagctgtgtgcatggcacatctttttaggccattgactggagcagtggtgtgtcactcagagtcactcatgtgcaaataggttgccaacctctgattgcaggcttaaacatgtgaggctccaccactccctgcccatttctgagtgtgtttaaataaaaggaagtgcttccaccatgtaaaaatgttggagtattgggaggccgaggcaggcggatcatgaggtcaggagatcgagaccatcctggctaacacggtgaaaccccgtctctactaaaaattaaaaaattagctgggcgtggtggcgggcgcctgtaatcccagctacccgggaggctgaggcaggagaatggcgtgaacctggggggcggagcttgcagtgagccgagatcgtgccactgcactctagtctgggcgacagagcgagactctgtctcaaaaaaaaaaaaaaaaaaaaaacaaagttagagtaactctgaggacttgctcatatattcaggaagctcttctttgaaattaatttatatatttcttctcctataccttcagtctgactggactgtaggggaagtgtgtgtgtgtgtgtgtgtgtgtgtgtgtgtgtgtgtgtgtgtgtgtaggtacctgtatgtgaatagaacattcatggaagggcacacaagaaactgtaaacagtgcttactttagggaggggcatggatgaactgggataccaaagagactatttttattttcagatattttgtgctgttttagactgctctttcttccattaaatgagagattagatctgaatggccacgtgatcttctgagtcccatctgtaagaatctgcatttccacggaattgggggtatgttttatattttctttctgtaatctttttactttactgaattcaactctgacgattatatagaaacacctcatttttctagcattacctgagaatgaaatttcccacactgggaattctccaggtaaatgaatctaatccctttatgttgttgaggtttgaagtaatttctaatgggatatttagaagctgcattacatacccccccccccctctttattttacagcttgaggagacatgtttcacatgccattaacactcacctattaaaagttcagtggttttacgacagtatattcactgagatgtgcaatcatcaccacaagctaattttagggcatttcaacacccccaaaagaaactccatactcattaagcactcactccccattctccccttctctcaccttctggaaaccactcatctatttctttctctgtggatttgcctattctgagcatttcacatggactcatacaatgcggggtcttttgtgtttcctatcctcttaaacagagtgcagttagtagcatgttactttttctttacgatttaggattattatgattggcattgtgccaagcccatggcaaccttgagaaatatttagatagggcccctgtttgcctcttatagattccatggcccattaatgtgcctgtggctccctttgggctctgtggctgggccaccaggtgactgctgaacactttgtcttctgatcctgaactctcatgttaaccattatttcctttccagtccccccatgtctgcaaagttggtcataggtacataaatgagatcaggtctcagccctcacgccttcgcttgacccagcctcataaggtcactccactgcgagcctctctggtgtgtttctgcctttctcctggagtgatgaaacaggctgaaatcttttcttcttgcattgctatcttcagcatcttatatcattcagtcagctaaattccatctttgtgataaatcccccacaaatattttgtgatctctctgatctaagcagtgttaaaccttttgattccttgtatccttcctctcccctttcttaaaatagtctgtagcgctcatgtcaaggacctgctcagcttccctttctctaaaattgcataatcctacaagaatattttcccttcttttccttcaggagcaaacgttctcaaaacattcttaaatgcaaacccgcaggcacagcatgtgtctgtcaactccaagagcatttggatgttcgaagggagaggatgtttgacatctaacccgtcgtggaaagaggagcctctgtgagtatttctttacttcttggtaggaatagggtgaaggaagaagagtctgatttagggtattgtcacagctctgggtcagactcttatgagggttatttgaggttagatgagtcaacttggcagggagggagtggttactgttctgaatttggctaagggagcatggcagggtccaactacagtatagtatgggaatttcaggttggggggcttctcatcttatgcctgttgtcagggtaagcccgtaagtgtgggggcacccttgcagagagtagcccaggttcattctgaatttggagagaccaagaaatttcagtccgtgtcagagaaactgatccttggttgggcctgacttgggctggggaagggatggcaagtagaacagtgcttggcacatagaggtaccagaaatatctgctgaatgacggtgccgctgatgtcactgagcggtcggtagccacggtccgtcatgagaggctgagagagattctcaggccaggcttggcgggaaatgctgtaatttacgattgctctgccacaggtgcaggtgagtgagtggaaggggcacgatgcaggtgcaggacctgtggtgggacgtcagaactggagtctgaatatgttgcagtgaccctcagttgcagacgggaatcagagaagagtctgggcacatccacttttggataacctgacactaagggattctgctgagctcagacctgggcagattagcagacaggacacccccaggctcagcccaaggtggttagaattgaggcagcctccaccgcagctaccctggtgggcctgcatttgacagaccataaagtgattcccctcataagtgacccaaccctgccttctggtggtcatttccatcaactgcacctgggtttaaaaggactggtgtgggagctccttttcctcaccactctcctcagctctcctcagcactggggctttaggactaattttactaactcacatgaacccagttctgctgtgatgtgagtgtaataagcaggaaaagtcaatgtacttcaagactccatctggttccacccattgtctgagacaattcagttatagttataacatgtgacaggcatcatgcagggccttgaatttgcttcgtagcagaaatcttttaaggcaggtactataattattcacgttaccgaggaggaaactgaggctcagagaggcgctgttattcttgctgcaagactatgacattcagctgggtgcgatggctcacacctgtaattccagcactttgggaaggtgacggggcaggatttctggagcccaggagtttgagaccagcctgggcaacatagtgataccctgtctatacaaaaatttttttttaattatccagacgtggtggcgagtgcctgtggtcccagctactggggaggctgaagcaggaggaacacttgagccagggaggtctaggctgcagtgagctgagatggcgccactgcaccactgcactccagcctgggtgagagtgagaccctgtctcagatagatggataggtaggcagatagatagatgatagatagatagatagatagatagatagatagataggtatgacattcagttttgggtgccaccaacctgttaacaatggcacctcctcaccttaccccagtccatccttcagacagtggaattgaggagaatggacagggaggggcactttctattttatgttttacaaatgtatttttataatgagcatatattatctctataattcttttttaaattgtagactaaattctgggtgtcatccctgatgaagggatcttgccagcctaggaaggaggaggcaggatacaggaactggagctccttcaccttgagagaacaggggttcataggagtatggtggctgtctaatgaccctggaagatccaagagagcagatttattccgtgtgtgtctccagcgcccagacccagggtcaggaggtggagttctcaaaacgggagttcagctgtgtgacaaagcatcttgctagccaggaggggctgccttctgctggaaaaagtgggataactttgaaagaacttaagctggaagttactgggatgtttatacaggagagtcagtggtggggagaagattggggtttaaaatattaaagctatggcagggtgctgtggctcacgcctgtaatcccagcactttgggaggcttgaggctggaggaacgtttgggcccaggagttcaagaccagcctgggcaacgtagtgagactctgtctccacaaaaaaattttaaaaagcatggtggtgtgcggccgagcgcggtggctcacgcctgtaatcccagcactttgggaggccaaggcgggcggatcacgaggtcaggagatcgagaccatcctggctaacacagtgaaaccccatctctactaaaaataataataaaaaaaattagccgggcatggtggcgggcgcctgtagtcccagctacttgggaggctgaggcagaagaatggcgtgaacccgggaggcggagcttgcagtgagccaagatggcaccactgcactccagcctgggcgacagagactccgtctcaaaaaaaaaacaacaaagcagaacaaacaaacaaacaaacatacaaacaaaaacatggtggcgtgcgcctgtagtcccagaggctgaggcaggaggatcgcttgagcctgggaggttgaggctgctgcgggtcatgattgcgccctacactccagcaaagcctttgatattccggtctcccagtctgtgatcctaccagtgggctgcagtacccactcctgcctctaggtggcagccttggctctgtaaaacccaggtctgtttttggtgccctggttcccacccttggctgggtattgttttcatctggagatttagggtattgcaatctactgatgcctggggctgcacctccggatattctgatttaattggtctcgggtgggacctgggaattgggaattttgaaagctcctcaggtggctctaagccaaggtttggagtgactgagtgcttagaccctgccatttctgtgggttcggtgagcagattgtttcattttattttctttcactgtactctgcagggggagactggacccatggagagaaagtaggagcattaaaagagatgtcaccagaagctacaaaacataccagctcattaagatagagacaacaaaataggtccctctaaaaataggagagagagaagaaacaggagcttaaacagtgcccatgaaggagttacaggcctttaactcccccaggaagtgaatttactccagccatgtagagggcaggggaatgttccagaaggcagggtgacacgctggccgggggccagagacctctctctttctggtagctttagcatgcggccaggcagtggcagttccggaattcaggactctctggggacctgcgggtatgggctggcagaaggggcttcacagggagaataaggggcttgcggggagttggttccagccagtgacagtgaactgacccagcccaacacctctgtccctaggcatggtggctgccctcatatctgccccagcccagcactgggatctcacagagaaaaagggccttccgtaaaggcagaaaatagctattgccataactcttcaagatgctgggccacaaaccacattgctgcggcccaagcccggactagagggaggcaagtgaggcaccctctttggcacaaaatctaaggggactgcaaaaaaccctcattaatcaaggccaggtgcggtggcccatgcctgtaatcccagcactttgtgaggccgaggcgggtggatcagctgaggtcaggagttcaagaccagcctggccaacatggtgaaacccagtctctagtaaaaatacaaaaattagctgggcatggtgccgcgcacctgtaatcccagctactagggaggctgaggcaggaaaattgcttgaacccaggaggcggagcttgcagtgagccgagatcgtgccactgcactccagcctgggcgacaaagtgagactccaactcaaaaaaaaaaaaaaaaaaaaccaaaaaaaaaaaaaccagaaaaagctcaataatcaaaattaatcatattgtattgcaatactttttaaaatcaaggttagtgcaaaaaacacccatgattaacaaaattttaaatgaagatgggatgggtgttcctgcctttatgagcctaaatggcttctcttgcctttactcctctgtggcacagcacggctctggacttctgtaagggagtcttctatttttcacccacaccttgcaggagccaccagtcagctttggcacctcaagaactttagcactcagggtgaggccaggctagagaccctgatgcctggcagagcagcagtgccacctagtggctcacgcctataatcccagcactttgggaggctctagtgccaaggcatgaagggtgatgccagacagagcaacagagagggccagaagctgtccggaagagagggttttccagagcacaggagcacgggagcctctgcatgggcagctgcacgggcggagctgaggtggggcagcagggaggctgaatgaacagatgaggcaggagcagggaagagtcagtgttgctgagactgatttttcctgcaggcagaaaattcccatgcacagtcttagcaccgccacaggcagatggggtgacctggaagcagtcgcccctccttgtcctcatctatgaaacaggagggtcagcacagaccgtctgtctctgtggcttgcatattcttcagaacttgtgcccaagtttccatttccagggacgggtgtgagaaatcagcttccgagcgacaaaacagtctcctgttggcagctccaggccgccccccccctttgtttttttttttttttttttgagacggagtctcgctctgtcgcccaggctggagtgcagtggcgtgatctcggctcactgcaagctccgcctccagggttcacgccattctcctgcctcagcctcccggtagctgggactacaggcacgcgccaccgcgcccagctttttgtatttttagtagagacggggtttcactgtgttagccaggatggtctcgatctcctgacctcgtgatctgccctcctcggcctcccaaagtgctgggattacaggcgtgagccaccgcgcccggcccaggtcactttttttttttttttttttttttttgaggcggagtctcgctctgtcgcccaggctggagtgcagtggcgcgatctcggctcactgcaagctccgccttccgggttcacatgattctcctgcctcagcctcccaagtagctgggactatgggcacccgccaccgtgcccggctaattttttgtatttttagtaaaggcggggtttcaccatgttagccaggatggtcttgatctcttgacctcgtgatctgcccgcctcggcctcccaaagtgctgggattacaggcgtgagctaccgcgcccggcccaggccactttttttgtttttgtttttgtttttgttttgttttgttttttggagatggaaagtggtggggagattgtttttgtttttgtttttgttttttttgttttttttgaggcggaatcttgctctgtcgccaggcaggagtgcagtggctcactgcaacctcggcctcctgggttcaagcgattctcttgcctccgcctcctgagtagctggaactacaggctcgtaccaccacacccagctaatttttgtatttttagtagagagggggtttcaccatgttggtcaagatggtctcgatgtcttgacttcctgatccgcccaccttggcctctcaaagtgctgggattacaggcatgagccaccgacccctgccaagattgggttttaaagtcttaaagctatggcagggtgctgtggctcaccttccttctttcattgtctctctctctccttacttccctccctccctcccttcttttctttcttctttctttcctttctcagacagagtcttactctgccacccaggctggagtgcaatggcatgatcttggctcattacaacttcctcctcccgggttcaagtgactctcccgcctcagcctcccaagtagctgggattacaggcgtccaccaccatgcccagctaattattgtatttttagtagagatggggtttcaccatgttggccaggctggtctcgagctcctgatctcaggtgagccacccacctcggcctcccaaagtgctgggattacaggcgtgagccgctgcgcctggcctccaggccacttttgacatgacagtcccaggagcagcatcaccgaccaccacatatccaatccgagggagaggaaggaggaaaggacttctccatggggatgtcctcacccagcctcgagattgtgactttctggaaactttagtaacaaatgctgcctgtgccaacagcttagcacttggttatactgttaattaattcccagaatcttagacactagggtggcaaataggattttatgagtgcctgagtgccagagaagattagcaagagaaaaaaaaaaaaacaaacaaaaaaaaaacagaatggagaggtttcactcttggacatggagttttgagaaatcctccagggcctggttctcagagggtggtccctggaccaccagcatcagtatcatcagggaacttgctagaaccgtaaaaccttgagccccattccagacctgagaatcagaacctggaaggtggggtctggtgaggtgggtttcagccaacaagccctgcagagcattccgaggcatgttcaagtttgagaatcactgatttagagccatgcttctcaaaccccgctgtgcctgccagtcacccagggatctcattagaaagcagattctgatccagtcgcctagggagggttctaagactttgcagttctgacaagctcccaggtgacacaatactgctggtctttggaaaactttgtgtagcagagatctaggcctgcatttcccagacaagctttatgatgaaagtcacctgggtgcttattaactatacaagttaccaggtctctcccctggaaattcccgttttgtggatctggctttgggcccaggaatccgctttttaaaacaactgctctaagagtttacctttaggcagatgattagaatcaccagggaacgtttcaatgcagattccccagctccaacccaacctactgactcagaatctctgacggtgcagccctaaattctgaatttttttttaaagaaagtaaaccaggcagccaggcatggtggctcacgtctataatcctagcactttgggaggcctaagcgagtggataacaaggtcaggagtttgagaccagtctggccaatatggtgaaaccctgtctctgctaaaaatacaaaacttagctgggtatggtggtgggtgcctgtagtcccagctacttaggaggctgaggcaggagaatcgcttgaatccgggaggcggaggttgcagtgagccaagattacgccactgcactccagcctgggtgacagggtgagactctatctcaaaaaaaaaaaaaaaaagtaaaccaggcaatgctgatgcccagctaggtttagaaacccttggaatagttcagacctctcgtttttcaagtaaggaaccggaaacctggagagtgagatgccaaagattatgaaagaaactggaaggaaagtgaagactggaacagagattttctcattcctgcttgagtgttcttccaatgactgtgtgtgtgtagctttgaaaatacaaagtattgggaataggaactgtgatacaaacaaaggtaagtaggacagtgtaagtcatgactgctactcagggagagtagagggagtatttaaaaatgcccctaaaaaggtgcacaaaggataggggcgtagccactggtgggtggggaggaccaagacagcctgaggtgtgttaagatttcaaggggagatggctgggcgggagtagtgaaggggagccacatctgcgggcacacgtggaaggacaggttgagtatccatctgaggcggcctggcgtggtggctcacacctgtaatcccagcactttgggaggctgaggcgggtggatcacaaggtcaggagttcgagaccagcctggccaatatggtgaaactccgtctctaccaaaattacaaaaattagctgggtgtggtggtgggcacctatagtcccggctactagggaggctgaggcaggagaattgcttgaacctgggaggtggaggttacactgagcggagatagcaccactgcactccagcctgggtgacaaagcaagactctatcacaaaaataataataataataataagtatccatctgaggcaagtgtactaaactgatgggccgggagggggcattcacagttgctgggcagagcagtgacaggtcagagttgtgtttcaaataggcctaagtaggactaagttgtattaactaacttgaatggactcagctgtaacattgtctgtcttgaacactacacactttggggccaaatggttggtgaaccatgtgtaccccagatcaccagctcttcatatcaccatgcaagccaaaaattcgtttcaattgagccatgacatgcaggaagagactgcccaaaattgcttcttcctttttctgtaacacttaatattcaaactgtctttttaactcagcaacacaggatgatttaaactatagacctagtattaatatttccttacagaggtggcaacagccaccaaaacaaacaaacaaaaaagctcatgttcatctccacccccatatttcagacagtgacatgaaggcaatggattctcagcattacaaggcaagacagaacttgaaggaagaaggctgggaggaaaccaatgttgaatgaacactgactctgtgctcagccctgagcaagcagtggaatgcccctgggctgtgagccacgaattcaaatcccagcttgtagagctgttctgggggttagaagtttggggtccctcgttgctgcactcgttccaggtttggggctggcgctgcccttctgacccctccctaaagtggacacaggagaaggagcggggagaagagacaggcggccaggagacaccctgttgagggctccctctgcttgcaacaggacctgctgaggttgcagctgaagtgctggtcttcccagagaaaacaacccctcattctcaaaggatgagagtgagccctgcggggctgcatgctcttggccatgggagatcaactgtggtcacatagagtgtaatcagtgtgtatttatggatcactcactacatgcaagaccgggacacagccgggatttactgtggggctgaaagcaagtcacttaaaaaggtaaaaattcatgtccttttaatctacttttcagcaaggaacatcacgtctgaatgctcgcggcctctgcctgccccgtgggatggtgctggaaattatactcatatttagatagcattctctgcaagtggctgctgttgtccttccatcgtcagcacaggcagatgctgggagtacccaccttggggtgaggtggcaagagagggccagcttgtatccgcctcgttgtcgtccttccttcctgacttgactctctcctctgtggccttctcaggagtgggatgtggttgtgaggagaatgtgcactttacccctcaccagtccagagaggggcacatagcccaaacctctccccttcccagaaacctgcaagtccccctgggtgcgcctgtgtgatgaggcaggctccgagagccacaggctggtgggccactaggaagcagtaaaggaagacattttatgattgtagctggagataatgaattgaaaagctggtctctgtttctggaaatgatgccaggaggccctcaaaataaacgcccacctgtccttcaggtctcaacacctgttgctcttgggacagagatcccaggcccaaaataggcacagctgctatggatgctcgtcttgccctcctggagctgagactgggccatgtttggaaatatgtctccctccatcccctcctcccatcctcatttggagccttagggctttaagacgtgagctctttcctcgctccctctccccagtctttcttgggtatctctgctcctcccatcacctgttcctgggcatggcataggcagttggtaaatgacagatgaatgaatacatgaacaaggaaacacagatctgaaatttctagcagcaaagtttggagcaggaagctctggctggccctgggctttttgctaagggtgttctggcttcgcgtggcagcacccctccccaccgggcctttgccaggacgctcgatcctctcttcgggcttctgagcagtgtgaattgcaaacagccatgcccactccccaggccaagaaaaccaagttcatggccaggattgctcac

SEQ ID NO: 410 - DNA, 6746 bp, Homo sapiens
gtggcgtgggggctgaggaggggctaaggcgggaggggcgcctcatcccttcaccctcccttttcgccatgtgggggccctgagcgccgccccagaagaggtcgagggaatgttgtgggctggggcacaccagcacggcagaaactggagaaagcgagagacgtcgccagggacccagggacctctccctccagttccccgggcccgcccggccctgatggccactcacgctatagcgcccactctgtcctgggccatcccgcgccagcagtgtagcccccagcccgggcgcctgaatgctctccctccggatcgctgctcgggtccccactttggcgaccgtgcccccgagtcctgcttccccggggcctgctctgtatcaggcgcctgcgccttcaagggtacccggcccgcctgccctccccaagagccgagtttgcgctcctcccggaatcgtttgagagaaggacaaacttttggcaggatggaaatctagatgagcctgtccggagcaggtaagctgggcccgggacgggtgcgattcagcccgagaacaatctgtctctccccgtcccggtctctccctccccttacccctgtttcccctgcaggctgacatattaatctgccttcccccgggagaaatttgggctggggttgggcttctgtcagatgcatggggtcagagcagctttcctccccgagtttagggactaaggtggtagctggcaggggagggggagggttgcttccgaaactgaggattgaggggagggttaggggccgagaaacccagagtctgagggagacgacttctttcctcaaacgcaacttgggggaacttcggaaaagttttttgaggggagatggagaagggagcggagttggggtttcgagggctaaagtgggagagagggtgctccgcttcccgtactgaaggaaggatgtgtgtgcttattccccagtcgggaccgattaccagcctagaaaaacccagccgcgtcccaaacccgctcaccccagcaggcccttagagacgcttggagatccccagacacgccccgcggaaagggaaggaaatgccagcccgagttgccgactctgccgggacggggcgggggatccgcccagagcggtcccctgctgtcctgggcccttacgttgattctaagttaggagtgatctgagagagggaataactcccaaaaatcttttttttttttttctgaatccaatttgagtcagagacccatttccttgagatggagccaagcgagtgccccctcccgcctccagcacaatctcccgctcttctccagttcccaaaggagggcaaggaaaaggcccctactctcctcccagggctgagatttcctcccccacccaagagatgccccaggaggaaggaatggagaggttcttcaaagggcagtcaagagcagagggtgggttcagaggtcacagctgaacttggggcccaggacaagggggaagggcgggcccaggccggtgtagaagctgcggggtggcctggggaagtggacaagggcagaggccgctgcaggtgttggggggtaccctggagcccggggtgttcctgggcggggaggtccagccaagcggcaagggtctgcgctgtgcctttagtttttaggttgggcccctcctggggagcacccagctggaggagccaggcaagtggcagaggacaccttccgactccttggaaagggccaggaagcgatctggatcctaggagagaaaattcctacgtggaacatgtggtgttctggcccttcctgggtagacacctgcagaggccacttggccctgccgggtcagaagccacaaatctgcccaggcctttgttttcactattcctgaagtttttctgctgtggcccagcacctgccctggcacctgctcggcatctgctcattggcaagccccggacggagttggactggcctagctgagaggtttaggagggcttccgctggcactgccaacagggagtttggcttggtctcccaaaaaaagggcctttgagaaggacatgtccaggggcagacacgaaatccactgatacgcaaaacgaatgtaaacccttttctttcctcacatcttgtggcccttcacacctctgcagttcagaggatttggaatggaaggcctcatccatccccagtcccaaagcaaacgtgggagccagcttgggcgtcttcttgcaggctgctggggctttgtgtgctctgagagaagatgtctggtcctctgcctaccccactccccctttgatgaatgtggtcctttttgctcctgcctctccaatactacccctcgccccacccccccacccccaacccagtcccacagatctatgggactatctctctttttctctttccttgctcctcttcccctttcttcttaggattgatggactgacagcagtttggcaaggcttccctaagcctgtaatagggagctgtggacccagccctgacttctcaagtagggggaaacagctctattcccgggcccttgagattgagtctcaagttgacaggagttgagaaagaaatgcatgaaggatggctgggcttacgcaggacaaaaacctctactggggaggggccagttttgtgccttgtgcctactgctgagagggaatttagaaacaaaggaagataagaagaaggcctagggaaacagcataaaggactggaaaaattcagaacagcaaagagaaaaaactgggagagaggaaaagatgtgaaaaggccctaatgctggagacagaaaggtattctggaagggtggctgggatagagataacatgaaaggaatattgataaagagcagaaggaagaagcaggactaggtttgtttgggtttttaagattagagatagtctggggcctgttaaaatagaaaatagaagaaaaaagattagagataaagacagaaaggaaaagaaaagaaaaatagggagagaaacagaaagcaaatgaaaggagagagctagagagtaaaagaaaaaggaagggaaagaaagggaggtaaaagtgagaaaaaataaatggaagggagacagaaagataggtagaaaaggaggaaagacagggacaagggaaagaagcaaggacaggggaaggaatggaagaaaaagagaaagtgaaggtagggcagaaatgaagcaaaagaaggaaggaaaaatgagaaatgaagatacagtgagataaagaaggaataaggggagtgaggggaaggcgggtagagagagagagaaagagaaacacgaactcaactaaggttaacggttaacagaaaggggatcccggttcctgaggagcacagggaggaaagaggagatggagggtgagcagaaaggccagttggggcccctccccgcctcaccttgggctgcggaggccctgaccgccaccactccgccgtctctagggcccagacctgggtgatggctgcctgtgaaccgtgggaggtagaggcaggggctggctgcctgcatacgggcttctcttctcgaagcagctgagcgagctggagttcttcctgcagccctacctgcccccgacacagcacgccaagctggacacatggcgttgaggctgtatgacatgcaggtccagatctggttccaaaaggcgtgcatgaagtacaagaggccagtgaggcaggaattgtttgtggattcccaccctggcggcccctctcccgggctcaatcctctcacccgcagccccaagtgcctccattcccaccctactggcagaggctgtctgaagaccgggcagctttgttccgggctcgggggtgctctggttctgtgagcttgggcctgtttgatcatttgttgttgttgttgttgttgtttgttgtttgttggtttttttggtttgtttgtttgttcgtttttagatggagtctcaccctgtcgcccaggctggaatgcagtggcacgatctcagctcactgcagcctttacatcgccggttcaagccattctcatgcctcagcctcctgagtagctgggattacaggcatgtgccaccacggccagctaatttttgtattttaagtggagacggggtttcgccatattggccaggctggtctcgaactcctgacctcaagtgatccgcccacctcagcctcccaaagtgctgggattacaggcataagccactgtgcccggtgatcatttgttaaatgagccctttgcactggagggtttttctgtagttttggttagcctgcctgagtatgtgcaaatgagacagggatgaagataagacctagtccactttgcaagggtgggaggggagtgtgagggtgtaggggttgggaggatgggaggctgggagtgagatcttcattttcttccattggtgagaagaaaaatcttcctcctttgctatccttatctccaaccctgccccagaaaaccacctttcaggtcaaggagtttctccatgccaggaggggttggattcatctgcaaagagcttgggaggaggtttgcaaatcctggaaaagccagagaaaggatctcatacatgaaagggaaggaagacattccctacccgggcaagtggaccttaggtctgcagtagagttcactgaattcacacacacaaagagattaattggtaaggtgactttagatttagctatagagaggatcaacttgaggttgctaggtatctttagcctgttgggcctgcactccccatgccctgctcatgtgctctggttgattcacaaggtttcttagagccaattcctttgtctcccaaaagtgggatggggcaggtcactgaggtcagccagttcctccaagggcagtgtatgccttgaggatgggctggggcacccccaaaccactggctagaaaggcatgttcacagtaaaccttgcagtgctgtctcagggaggcctctgaccagcactgcctagcattgctctttaagcttttcctcccctcttttctctagcttctcccttcctttatttctctttctctctctcttccttccaacctttctgatttctctgtctcccttttcatccagtccaagttggggatcttgtactatctttgtactccagatggctctgctctgagccctttaggctggttaacatgtaccctgccctcaagagttcactatttggatgcaaatagcaggattagaagatggggagggagcagctgggcgcggtggctcacacctgtaatcccatcactttgggaggccagggcggaagcaatgcttgagcccaggagttcaagaccagcctgggaaacatggcaaaaccatctctacaaaaaatacaaaaattacccaggcatggtggtgtgcacctgtagtcccagctacttgggaggctgaggtgggaggatggcttgagcccaggagacgtaggttgtagtaagctgagatcgtgccactgcactccagcctgggtgacagagcaacaccctgtctcaaaaaagaaaaaaaaagatgaggggggaaatggggagtaagctttgctaaccagatgtgggatgaatcaattagttttatgtattaatcatgattatgaccttcacatccccttggctcacccctagacaattcttccccactcccagccatctgcaaaccacagtcagcctgtccctgctcccaaaaatggaattgctgatgccctcaaggctgttactctcccagggtgagtgagagtgaggtcaatggcgccaggtcggagcctcaaactcttaaataaacaaagcatatttccctattcctgatgcagttgggggtcatctatcccttggaatggagaggctggcaattctggctcttggctatctttccacagaacacccctgattagccaggcccaccgccatccacatctgctcggcaaagaaggaaggcagcttgttccagaccttggtgagcagctgcagactgcctgcctagaacagcctccttactccagcctggcagggaaggaaggaacctgacttgcttcgcaggatctggaagctcagccggcagagctgagagccgcagttgcatcctggagcctgatgctagaagcagcttccgtctttgggttcttgctgcctcggcctctgctctgttcagtttgctgttgtgtttttctcccccatgttggggtggtggggtacagggaaataaaatgctttctcccaggcccctaatccttccccatgcctccatcagcctcaaagctgctgacagtcatgaactgcaccttccagccctgcccataagctactcaaagcaaattcaaattctcttctggccaggaggaagggcagatgctccctccttcctcaagcctccctggctcattgatccattttgagggcatttgggggtcaaagttgagaccagattgcttcagtttgtataaaattagcatttcttatcacaccaaggccacacctgttctctggcctcacaaaccagtgaggatgtaaaggtttgttgaggtggaggaacagaagtgaaatgagcaatctgctccatttagaagtcagtcgcttcggctgttcattccactaatatttatctagtacctattctgtgccaagcattgtctctacctcagtttgccacaaatatgaaaaaaaaaaaattcttggaactgtgaggcttcaatgtgttgtggaccaatatacaaataaaccaatggaaaagaaa

SEQ ID NO: 411 - DNA, 36797 bp, Homo sapiens
ctggatggagcaacaagagtctgggctattaacacaggtttgagtcaggctgaccggagctgtaaagcccttctcgttctcactgtgtgttcttttcagttctgtcttcctgaggctgctgtttctgggcatggccaggggatcttcagactttacaaaccagttgtgcagagccaggcatttcaataaggaacaaaatgctgagtaacaacatgaagtcagagtgttgcttgccaagagctgggaggcctgggtggtttcccaatcttaaagaagcagaaggatattaaagtgagcctcccaaaggaaaacgtggatctacttaccaacgcagaaaatgatacacacggattcgatttaggtaagtgcaccccctgtgatgactattggtcacttccagatcacatggactaactgtaggtctcaactattttgactttttttttccagaacagactaatacataactaacggcttacctttgtgaaaaatattttatgcactgtagaacagataattttcagtcctgggccaaagggggaaactttggagagaattaaacaggaaatgactctgctacaaagaattcaggagcatgagtgaagtgaataaacaatccaggcacgattgatgaattctagatgtcctgggaataacagggcttgttgccagctcagatgggtgaaatcctactctgatgaaaggctccagggctgcaaggagaccactcctacatccatcacatcagtgtcacaggtttaccacctgctcagcgattattcaacatcctaaggccttttgccccattacacacgtttgaccacttagtccaggaatgaggtaccaaatactagggagatctcataaagcctgcagctaaaataagcagaggaatcagaagctggacagagtgacccaaggaggactggggataactcaggagttccttttttttttctttttgagatggagtctcgctctgtcgcccaggctggagtgcagtggcgcgatctcggctcactgcagcctccgcctattgggttcaagcagttctcccgcctcagcctctcaagtagctgggactacaggcacccaccactacgcctggctaatttttgtatttttagtagagacggggtttcaccatattggccaggctggtctcaaactcctgacctcatgatccgcccgcctcggcctcccaaggagttccttattttaatatttgctgaaaattctccaccataatttaaacatgtaatgataagaaaaatatctgcttctgactgaatatttagaaaacacagagctatataacatagaaaaaaacccaagtcgaccactgacaaataattattaggactatttcttttcattctgtgttctctgcacatatgaaagtaaaaaattggaatcatattgtatatacagttttatattaatttttttacatagtcactttaataacaatacatatgctatgttatcactatagaatgtaaattcaggttagacaagaaaatttcacaagtgtaataaagcattctaattagctgggcgtggtggtgtgcacctgtagtcccagctactctggaggctgatgtggtaagattgcttgagtctgggaagttaaggcttcagcgagctgtgatcatgccactgcactctagagcctgggtgacagagcaagaccccatctaaaaatatatatatataaattaagcattttgccttttatcaaagtttgtgtatagtatctggccaaacccgcttgctcattagtcactttcattataggtaatttgtttagtttcttgtttatgattcttctggagaaaatttgaaaagtgttcttcacttaccttagcatgagtgcttaaaataggatgacatttaaaaattattctaatataacagcagctaaaatataattctgcacttataaaagagctaaactggagttcataattaagttattctcatgtttacaattatgattctgaaataaatactgttactatgaagctctattgtaagctttcttgattcggtttagacacacatacatacacttaagagttgtgagaggcgttacaagttgttaatgtattccatgcacgtttcagaaaagttctaatagagacagccagttcacaagacaggaagaagaaaagttagattaaccagggcagataagactcctatataacatacaaagcatgtgaaattcttcagcaaactgggaatacttcagggatcgccagctatcttctttagaactaatttcttctttcttttcttttcttttcttttcctttcttttcttttctgtttcttttcttttttcttctttctttctcccttccttccttccttccttccttccttccttccttcctccctccctccctccctctctctctctctttctttctttctttctttcttcccttctttcatctttcttttctgtctccctctatcacccaggctggagtacagtaactgcaacctccgcctcccaggttccggtgattctcatggctcagtctcccaaggagctgggattacaggcatgtgtcaccaccctcagctaattgtgtgtgtgtgtgtgtgtgtgtgtgtgtgtgtgtgtgtgtgtgtgtatgtatttttggtagagacagggttttgctatgttggccaggctggtctcaaactcctggcctctagtgatccacccgccttggcctctcaaagtgctgggattacaggaatgagccaccacacccggtcctaatttaatctttacagtctaagaaggtggttttaaagttttaacatcatcaagtggaattaggtgacatgtttcctttgtgttaacttgacttccctgaatgacctagttagtgaactagtcactagtaatttggtcaccaggcaaatcaagcatgcaagaaaggaagccagtattcaaaataccgtgttatcgtctgaacccactcaaataatttatttccaacataaacatgtaacctcaataatgagatgtctaactaaagtaaggtcctcttacaagatcaagacagcatcctccttccaaggcttaggctttgcccagaattcctaatacacagaacagcccataccaacagtcattgcttctacaacacatgtggatcaggagaagggaccttttagcatttcctctgctcttccatttgtataatccttatggaacaattgctggaaagcctgccattccagtgagaacaaatggtggctcttcaacttttcgaacaagtttggatccttgatctttatcataggaagaaagggaaacatctgtgtctgttgacatagtgattgaagaatcttcctagagtgagaaaatctctcacaatccaactgacctctatattaattttttatctaacatattatagtcatttgccatgttattaagcattgttgtaaacattgcttttaatgcttatataatattttatcttacaggtgtatgacaatttatttaaaagttccccttcttgggatgcttagagtgtttccacatttttaaattataaataacacttatggacatctgtacatataaatcttttaccacaaataaaattgtttccctaggattcacgtaaaaaaacatggagcaaggtttgaagctgttgaactctatggttccttcttcttctttccaggcacgctacattcaaatgacttggaagagcaggttctctgagccaggatactaaagtccctgtttaggaaagagccacgttgtatgtttaccctaccacaaagatacaggtgagaaaaactgaagcctgggatggtggaccaaagagagacactgacagaatgagccctagacttccagagtctgggaaacttaggccagataaagactagtagtctggcagttattactgggaatcactcttactctacagctaggcgtgtgccattcctcctgtcccttaactagaaactccctatggataacctggcttctcattccactgggaaaattgaagcatgcagtagagaccttccacaagctccctccaccacctcttacccacttgcctgtctctatgcacataaatatctgtcttcttttctttcaataccatgtataggttgacaacactcacattttcatatctccagcccagatttctcccgtgtgtcttgacttgatatctaatttcctacatgacatctctctttggatgactaataatcatctcaaatgtgtatgtccaataccagactgctgatctgcctccaaacctgtttttcctgtagtcttgtgcacataagttgaaggcaacgccatctttttactttctcatgccaaaaaacttggagtcctttttgatttatctctgtctctcacaccccacatcccatccatcagcaaatatttgcatcatgtctcactggatactgcaaccatctccttgctgatctcactgcttttcagcctatttcacaacccagcggttgaaatagttcttttaaaacataggtcagatcatgtcatttctcaaacctaccaaatacttccatttcactcagagtaaaatacaaagtccttataatggccatacacaatctgccccctccccatctccttacccatctcacttcatgtcctgctattttctcctttgtttgtctctgctgcagccacactggccttcttactgttctataaatatgccaggcactttcctgcctcagggtctatgtacttcccatgctttctgctcttccagatttctgcagagctcatttcctacctcctttatgtctttacttgttcatcttctcatgcgactttcctaccatgtttaattgcaaactcctgcccccaacactccatgtctctctttctaccttatttttctccatcatgcttatcactcaccaacagacctcacttatttggtttattgtctgtctgcccctactgacagacagttcttttatctattttgatcattgctgtatacttagcacctagatagtgcctggcacatacttggtgcttcaaatacacttgctgaataaagtatgggcatgctatgaaaaggcatagataggtaaggacttttgggtccagattgtgagaaagtcattggcaccaagatgttttcactcaattttctgagtcctattacagaatcctggccaaaagtataatacaccaaagaaccagaattatcacaggtgaagtaaaccaggccaattgttttctagatcctcttaggtatttttgtgaattatacatgttatgggaaattttaaacttgtctatactaaagcaaattagaatgctttgataaagcttattttggatttctcagtgcttctccttggtcacaaaatatggcaaggggttctagaaatagatttagtgggggaaggaaagaaactaacatggaatcgagtgacttctaaatttctaaaccccttacatctcatttaaacttttgacaacttttgagtcaagaaacattattccagctatgaatatatacaaattgaggttcgggcctggtgaaatgactcatgctggtaatctcagcactttgggaggccaaggcaagaggacggcttgagcccaggattttgagaccagcataggcaacacagcaagactctctctctacaaaaaattaaaaatttatctgggcatggtgacacacacctgtaatctcagctactcaagacgctgatctgggaggatcacttgagcctaagaaatcaaggctgcagtgagtcatgattgtgccacagcactccagcctgggtgacagagcaagaccttgtctcaaaaaacaaaaaaaaatcaaactgaggttcagagagaaatattaatttctccaattttgcacagccagcaaatggcaggcttagaattccatccactagctaactgagtagtataggacctagaccaagcttgtccaacccacggcccacagactgcatgtggtccaggacatctttgaatatggcctagaacaaatctgtaaactttcttaaacattatgagattgttttgcgattttttttaagctcatcagctatcattggtgttagtgtattttatgtgtggcccaagacaatttttcttccaatgtggcccagggaagccttgaacaccctgacttagactttatagctaatagcttgacaaattaggtgacttaggagaaatcatttaatatttgtctcagttgtctgccaaaaaaaaaaaaaaatgtaaattcacttcagacacacatcttagaataacccagggtgataatttcagatttttctggctcttgtttatttcttagctccttcagaagaaagaaaatgttctaaatgttaggatccactggggctgttatgtttcctagttcaaatctttaaactgttgttaaaccacaacaattaccacaagcacagagcctcctggaacattttcccaagtaaaacaaatactctagctgtgtgagggtatcaggcaaagctagaaatgggactccttgctggctatccatgtgaagggctttgtttaaggaaatgctatgttgccagcacagtcacttgtcaaagacaatagctgttggcaaagcattaatatgtgaggattgggagagctgccagtggaagcaaactgttttgtggtgtgtacaatgttgtgctgggacatcagctgaagttcaccattgatgaccatctgaaaactgccttccactcacagtacactcaaatggacaactcagcaaattgaagaatgaatttctagggagaggcaacacggtataattaatgaaaaaagaactagaatagaagtgaaaacccctcattttaattccaatgttgtgactctgatacctcctttaatttccctgcatcattttccttattcactcacttacccaggcactcaaccaggcatccagcaagtatgtattgaatgccagcttgtattcaaggcactgggtgaaatgatgtgatcatttcatgattctgctttatgtatgttagagataatagtcccatctgcctcaaattgatgtaatgaggatgaaaacccagtttccactttggtagaaatggaaatatgtttgtcttgcctacttcatggatctattatgagaatcataagagataattatgtgggtatacttaatgaacttaaagtgttagatagatatgcgaaaaataagtaaataaatactttgaccagaacaaaacttacatcattgctgaatattacttggggagagaggcagagagagagagaggcagagagagacagagagagagacagacagagacagagaaagaaaatgcaaatgagatccagtgccacttacctattcttttctttttttcagtgaaagcaagacttacaacgataaaaatagaagttagtttcaataattatttttataattttttcagtgaaaatccacagacaagaaccaaactcatggttctcaaattatactcttatactgattatcagtagttttaggtgtttgggttctgaaattcaatgctaggactgggagtagaggattttattgctaatatatcaggattaggttttgctgcacatttaaaaaaaaaaaaaaagcaaactaccaaagcctaaagcaagctggaatttgggggtttcttttctcagataaaaggagttggaagagaaactatctagctatggccactccataatatcatctgggacccccaggctcttttctctattatcttaacacatggcttttattattaaggtcatctctgggctgctgaagctccagttatcacacctgcattgcaagccaaaataagaaggagatgcagaaagtatcacccccagctgagtaaaattgtgttaagtagcccttctaaacgttttatctaggaattatgctttcatatctttgacagagattagtcacgtggccacagttagccacaggggtgactaggaaatgtagtttttgtcttgagagctattctgctgggataagaatcaaggttaggcaactagctatcttttccacacaaaatattacagaaaaaagatgttaatggatagaatgttctcaattacacatttttctccataccttttacatattcctttggttttaagaatattatcattctcctataatagtatacaatagtatatgattcaaaacaaaattataaactggatttttttaacaatctatttatatttcattttatcctacaaagagcaacatgattttcagttgttttatcacatgaatatattcaagccccattaatccaaatcaaataaaattatggaagtctagaaatccattctgtatggaagcaagctaacagcagcgttccatcttctaacagccttagcccaggagcatttaccagtaagcatattgatttgagcgtcagcataaaataaggcatccctgaatttttaccaacaaagaaaagtgtccttgcactgtggtcacagcatgtgtatctttctacatctgccctcaaattcccaacaacatgattgtgctctgagtggaagcctcttggtgttctgtgttgccttcatccatataagtatatgtaggtctttctgttcatttagagtttgccttttgtgtgtgtgacagggtcttactctgtcatctaggctagatagagtgcaccagtgtgattgtagctcactgcagacttgacttcgtgggctaaagagatcttcctgcctcagcctcagcccctgacccctgacccccaggaattactggtgcataccactatgcccagctaattttttattctttattttttagagatggggtctgattatgtttcccaggctggtctcaaactcctgggctcaagtgatccttccaccccactgtcccaagtgttagagcacatcatgggtgtcagctactgcacccagagagaatctgccttaagactttaaagaattctgagcaatagtgtctgaggggctcattccctaacctaacgaggattacaaaccagctgggttatgaaagagcagcagccatccaaaactgtcctgattggggaagtgaactctgcatgccacaaagcaggaatggcagccaaatgagaaacatatgctctggattctgatgcaaagtttttatttctttaaaaacaactgcattaaagtgacataaacttaaatttaatccaatttggaccttactggaaaacagtatgaattttgggtgaaatattttggagaaatttgaaatatctactatgttatgtgaccttagacaaagaacttaaccacaccaagttattgttattatatgaataataacagtaatgtcaaatagcaataataatgccaaaagaactgacagtctttttgaagattactgtgtcaagagtgtaagttacgttagaaagatacacatgctggccgagcgcggtggctcacgcctgttatctcggcactctggaaggctgaggtggatggatcacctggggccaggagttcaagaccagcctgggcaacatagtgaaaccctgtctctactaaaaatacaaaaattagctgggcatattggtgggcgcctgtaatcccagctacttgggaggctgagtcacgagaattgctggaacccaggaggcggaggttgcagtgagccaagatcatgccactgcactccagcctgggtgacagagaaagattccaaaaaaaaaaaaagaaagaaagaaaagaaaagaaagacgggaaggaaggaaggaacggagggagggagggagggagggaaagatacacgtcctgtggccacagtacaaggacatttttcttggttgggaaaaattcaggggtgccttattttatgctgatgttcaaatcaatattctaagttataataaggctgttacattagactcttaacacagtaatcttcaaaaagtaatgctatattattaaataagtgtacataaaataacttactggtcattctcttcttagtccaaggattttgtcactaacctgctaaaattcttttagcaagacttttaattagaggtcaaaaatttactcactctaatgagggacttgaattttacaatctgtaataactgacttgacgttgggccttattatctcggattctttcatcttccttgggttgttccttaattctgggcattttgctgcccattacctctctcttcaaaggttggcaaagggacatagcaacaattctggtaaacagagcaaatggaaatggaaatgagccagaggtgtgctcagtagaatgtcatgtcatgtattgatcaaatggcacagagaacccaggctctggagtcaagactgggaagctattgtcataaactattctacattggcccgtaacttgagccttaacaaatcatacaacctcagagacttcatctataaattgaaagtgttaatatcatataccttttaagattttttggccagatgcagtggttcatgcctgtaattccagcacttcgggaggatcacttgagctcaggagttagagaccagtctgggcaacatagtgggaccctgtttctactaaaaataaaaaaaaaaaactaggcaagtgtggtggggcatgcatgtagtccgagctactcaggaggctgaagcaggaggatctcttgagcctggaaaatcaaggctgcagtgagccatgatcaggttactgcactccagcctgggtgacaaagggagaccctgtctcaaaaaaacaagcaaaaaaatatttgtcaggattaaatgatgttacctataaagtattgtgggcattgtgttaattgttacctattactattaaccaacaccattatgagatatctctatatgttagcaacagaaataaatttatccatttatttcaaacagtatttgattcaatgcaattctagtacaatagaatactcctagaatgataataatatgactaagtttgtttttaggtcatttcaataagaaaatttagacttcgttatctatttgtcaatgcttatttaatccatagttcattctgagtccctcgccacttttacattgtccttttcgagtgtctttcacagccctgtggctttaatgcgttgctgtcttcccaattcacagttcagtttcatcagcactcctgtttcctgttttgtcactgtctaggctgcctgttttgcacctcgaactccttcctcttcctcttcaaaggatatcgtcaacatttccagtagggatgggcaatgaatgccacaaacgtttcttgctgcagctcttccttttctttctttttctttttttaacctcctttgaaccttcataagcttcctgtaatgactgtgtctctgtttcaactatttcagtatttctgtggcttttgattttgatctggattcacgtcttccagccaaaaccatctcaaacaagtagtttgaggtttttgctggaaggtaatttgaatttgtttacatggccaccaactcccaattttagatgtcctgagatttctggagtagaggattggccttaccagattacctttctcttattagcactattattagcaaagatgggctctttcgtttgtgagctaatcatacttcttataattctaaataactacttctaaatcaggagaattagaaaagtctttcatttcagcagggttgaaaaaaggttaattaaagtcatccacagacatagatatagcaacatgatttgatatacatacatcaataagaatagtcatgcacacacatacacagaaacacacaattattcctttacaatcttctggcatcttttctgcaaggaagccacaaacacaaactggatatgaacaaaataactcagcagatgaccaatgacctcttcctccttctcatcctcctccttctcctcctcctttttcttgttttgccatcattgtttaggtgaagcgcaaaacaagtcccaaatatttctgggctactctcaaattattgggctctgtggcgtgtgcatttgaatgttcattcaataaatattcactgagaacctactatgtcccaggtcctcacaatacagctgtgtacaaaacagaccagatccctgccatctggaacctcgtacttgggtgggtgatcagtttccagaatcagacagtctgctcatttgagaaaactcctgtgtggttcaagattccagaggagaacactgagacaggagcagactgggtttatcatatgccccatctcgtggtttcctaacaggccaaatgcaatacagagaggggtattgctcactcttccttcctgtttctgtcactcagacaggagctagatagttcctttcctaccaagctaagacttttgctctcatcaagtgagaaggtccctcttactttacaatatttctgacctgaaccctggcaaccataaatctacttttttttttttttttttttttgagatgaaatcttgctcttgtaccccaggctagagtgcaatggcaccatctcggctcactgcaacctccgcctcctgggttcaagtgattatcctgcctcagcctcccgagtagctgggattacaggtgcctgccaccatgcccagctaattcctgtatttttagtagagacgtggtttcaccatgttggccaggctggtctcgaactcctgacctcaggtgatctgcccgccttggcctcccagagtgctgggattacaggcgtgagccactgcacctggcccacaaatctacttctatctctcaccttgccttgactttcaccacaagacagaatagttccccttagagactttcatttgctctgtggtatcactctttagactgcctgagatacatactggaaaatgccacctcttaaaaggcaccactaagttcttaattgaatccacactttagtcttttatcctttcgatttctatggtaaagaacataggccctgtatttgctactcatatctcccattcatttgtgtgtgattatgtagcttttttagcttacacacagctataaagcattttccaagtcttttttatattatctagtttgcatgaaataaggatgtaggagtatgtttggcttttggctatagatagttggaagtatttctaaagatccactctcttctgagctctcttactgttcttgttttcaactaacagaaattggaaaataaagattgtgtgggtataaaatgaatgcttgcaatgtttgtcatttttggaactctatttctgtggctcttgactttttttaagatggcttcacctaaaagttgctaaggccaggccagagctcttcttataaacaaatgacaggggacatgatagcccataatgaattcaatctgggctatctgtggcgttgtgtgtggataaaaagtaaaagctaattttgagtacaaagaaaatgaataaagcctcttgccactaagatagttaagagaagactgtcagaaggcaacatcattctatgcagctggacctatgcccttccacagatgggaacaatgccatatggttagggagcttggctgttacccaagtggctcctattcagttctccatttgagcaagagttgagaggagatggagaatagtatttgggagacttcctgggttcaagtcctgcctctaccacttatttgctatgtgctttcttagtaacctgaagcaatgaataacagtattagcctcatagggttgttgtaaggtttaattgagatagtgcacattatgcatgctgcctacctggcacatagtaataggtgggaggtattattactgtgatgatgatgatgggtgtccagggggagaccagtctgaatgtacctggtagactcagtaggttactggaagtcaggagtcacaaatgtgaaccaggcagcaagctttagaaggtgattgacagggcaaattggcagggattgttaagaaagatacagagaatggtggtaaaaccaggaggaataagcatgcctttttctcttattggagcaaagaggacattacctggtctgtatccaactagacaagggcctgaaccttagagaagatgttgaaccccactagcattacttaaggtcaaacaaggcaaaagcgttttggttttctgtttatttgtctggtttgggatattcctgggaaggaatattatggattttgcacttctaatatctgacttctgtgtaatggaagaaaaaaatagcactccagtaagcctttataatgccatacacacataaagtgaaacaagaagaccctgtgaaggatgataggaatgacagatctcgtcctactaaaggaataaatttccttccaaacatattacagttgtataagctataaaatatattgctataaaatgactcacctatttgaaaatcctactgcatagagtttccacagttagaaaactggtatgcgaaaatgtgaaagttggtaagaatcaagaaatagttttttagtacctattgtgtgtaaggtattattacataatcacagaattatactattattttgctttttgcatagatttgcattacctagtcaatatttaactgatttatttaacctttgtaaaacaaattcagaatctcatactgagacttaggaagtatatacagtagttccccccttatccgtggttttgctttccataatttcagctacctgcagtcaaccacgatctgaagatgtttaagggaaaattttggaaattaacaactcataagttttaaattgtgcaccattctgagtagtgtgatgaaatctcacagcattccgctcagtcccttccaaaggtgaatcatcttttggtccagttatctgcactgtagatgcaaccatctagattatcagattgaaaaaacatagtatagacagtctagggttcagtactatgcacagtttcaggcatctactaagtcttggaacgtatccttcaaggataagggggaactattctattcataaattcatagaattttaaagctggaagaactccgaagggaatgaaaatcagtgtcctaggctttccttaaaatgctaggtaatgtcctaaggagcttttgaaattttaaattatttttaaaacactttataaaagaaattttttagtcaaatatatcagtgctcactaaatccccacctattataagaatttactcatcctagcaatgtcaactttaggaagcataagaatagaaactgagataatataaatgacttattcaaggggaatggcattaatcagtcaacaaagtgagataatcagtagagcatctgaaaaaataagacctctcatatgacctgtttgtttatttctgttcccagatgacaaatattttttgaattctgcccagctcctcttggggtagacaaatattaaaacagaaaaaagtggcaaggtgcttttgttcagtgtgggctcatggggaaaagtcctataatattttcagctggtcactatgaaggcagccagcagtgagctcagccgacattgttgtgggatggcactatgacatcgattaacggaaaactgaatgttgaaattatgcagcagaggaaaagaaaaggaggaggacaataacaaaattttccaaacagaaaatcacaaggtccacataggaaaagtatagttttcaaactccagaagatatttgcaaacaccagtgagcaagctatgaatcttgttttcccataggccctaccatcagtagagatcccaggtagagcaatttacctgcacattgttgccagggaacaagggaaggcgagtcaaactatttggggatttagctgagctttgaaataactgaaaagctatgcttcaatttttaagagttcatcaggtaggatttctaggattgtaaggtcctcactctagaacttctgaaaataatcagatgaatcggaattaaagaactaatggccttaattgtgtctaaataggaatgaagtaacaatgactgtcatcatgagctattctcttctatggctctggacggtctttttttttttttttttctgttcagagcttcctgcttggtgtttgcctaagtagggaggaaagccattgtttgaactttgcaacaacagattgcaagctaaggcttttctacactttgtttaattttcctgaaatgttcctttttacagaaaagatctgttgttgacctagcatgctttttgtcttactcaatactcccctggggatgtagttaaaacaacacttagctgtaattctcctgggtggagaagtgtttggtggtggcaatgaaactaaagcacagatttgagcaactgtgggctgttgactttatgctagcctttcataaagagaaacctcaaaacaccgtggccattcagcaaacagtgtgagtttcatctaagcctggctggctttgcccttgctatcttcgggctagaatgatcctaaccatcagtgtctttgtgtcatgatgcagaaagttggctaggacataggaggataatgctgaagtataacttctgagtgggggagggaatcaggcagagaagtaaagctctacacaatggctagtgcttctgtattatgatgtgtgttccaacggaggtcaatcattgtgcattgtctctagggagtgaatacagcatattattttggggtagaaattgagatttcttttggtggtaaaatatacagaaaatagaaactctctgtacttgatttctttaagtttatttaaataccttcaaaggtattcttctatgagaaggaacatgacataataggactctaaaaatgaaactgttttagtgatggaaattttccatatcaaatctactatagccactaggatatattaccaaagtttttaaaaattcttgtgtgcagtgaactttgttgattgcctactcagcaaaaaatcatctcctgtgttcctaatgaacctcaattttgctttcctctcttctagtcatgtgcctgggaaagattgatgccagctccagaaaggcatccgaatggtctaagtaatgccatccatctgtcagtaatagattcagaaatgggtatgtgattcaagtctggccaatgagatgtatgcagaagagtgctgggtattctggaaaattatcccttgtcattcagagatccacaggaatccagccttttgctccttgaatgggataaggaagcacataatcccagttgctcttccagtcatcccagacccacagccctgctttagccatcctatagccatcatatattcacaaggggagagcaactgaggacaacactgtggatccttgtgacataaccaagccagtgaaccaatcaatacatttatttattgtttgagccattgtagttgagcttacgttactggcagctgaaagctgaaagttattctatctgccaatcctcatcttgcacgtctcttagttttgctcttatctctccttttcctctttttcacacataaatcccaatctttgttccaactcacactgtcaacactctgacctttccctcttgctttcttttcctcttctctctgtccctctcccttttgcctttctttctgccagtgctacccacaggtatatcttaaatcttattagccatagccatgaccaaagactaggaccaccactaggtataactggattaggtggagttttgctcatttgccctcctttgtactttcgacatcaacatccctcacccctcagcaattctctccactgtgccccactccatataacaaaaagtcttgtgtgctctgaaacatccacccaaaaactatattttcactaaaattcctttggtgataatgccttaacatggtggtttccaaagctttttaaaaccataacccacattaagtatcctcactcagtatacacagaatatacacataggcacttgatatagtctggatatttgtccctgcccaactcttatgttgaattgtaatccccagtgctagaggtggggcttggtgggagggtgtttggatccctcatggcttggtgctgtcttcacaatagtgagttctctagacatctggtcatttgaaagtgtgtggcaccttccccctctccttgcttctgctctgactatgtgacatgcctgctttcctgctttccttttgccttctgccatgatcataagcttcctgaggacttcccagaagtcaagctgatgctagcatcattgcttcctgcaaagcctgcagagctgtgaacctcttttctttatgaattatccagtctcaggtatttctttataatgtgaaaggaaaataaaccttggggcccccaaatcactaagctaaatggaaaagtcaagctgggaactgcttagagcaaacctgcctcccattctattcaaagtcatccctctgctcactgagatagatgtatatctgattgcctcctttggaaaggctaatcagaaactcaaaagaatgaaaccattcatttgtctctcgcctatctgtgacctggaagccccctctctgcttcggcttcaaggcttcctgcctttgcttcaagttgtcgcgcctttccagacccaaccaatgtacttcttacatatactgattgatgcttcatgtctccctaaaatgtataaaactcagctgtgccccagccaccttggccacatgtcatcaggactccctgaggctgtgccgcaggctcatcttcaaccttggcaaaataaactttctaaattaactgagacctgtctcagattttcggggtttagagtagcaatgcaagaagggactaacacaacactgcaggaaaagttctatgaaacacacttacctttactaccagtgacacattctgatattacatattctgttctatttcatttttaaaaagtgtttgtctgtactcactaaattgatgtcatggatagttgttgtgaccaccaaaaacacttccttcacccacagcagaaattctggtggtcgtgtgataaacttgtcaaaaagtcctttgagggtaattagactcatacttaaacctgaataaaatgacagccaacaccaactaaaagaagttctgtctgtgtcaatttggatacattgtttcccctaaaaaaatgaagagtgagtgagaatatatgaatgctgacacctgatgtgttcctagtaatttcaggggatctttctgaaatggcaaaagtgtttaagaaacaccattataattatttctgaaagtaaagatgtttcctgcaaaagctatttgagtcccagagccaattcattaattggttttatgtttgactttttagagcccattaaatatatctatttggttattcatttggcagctatgctacttctttaagagctgggaatggcagattgtctataagaatcatttttataacatggattgtggtaaaaatgtgttagctttcttgttgataactacttgttatcagctagaaccacttttacagcctgtaccatgtgaaggcctcacatataaagtccatagcatgtttgaaagtcacatgatatctagaaaagccctgtataaactggaaagcattgtgtaaacacaaaatattattattatgcatttttttaaagtaagaaactcttgcctaagaagtcagtcatccccatggttagaacatgtctcccaaagttcatgtgttggaaacttaattgccattgtaacaatattaagaggtggggcctttaagaagtgattaggtcatgagggctttgtcctcatgaatggactaatgttgttatcatgggaatgggttaattgtggtgagcctggccccctttttctttctgcttcatctgcccctttctgccatccatccttttgccatggaatgactcctgccagatgccagtactatgctctcagccttcctggcgttcagaaccatgaacagaataaatttctttttttaataaattacccatctctggtattctgctataacagccaaaaattgactagggccttcatgaattttgaatgccaatgaattttaatgtttttgttaatggtactgagttctataaatgtttttccccaccctctaattgatacgcacacacatgcacacacacacacacacatgcatacatatgcacatacatattagacttttaagcctatattcaatacaatacaggctggttgctaatttacaaaccctattttctcttttataagatatattagaaggtaggttttcttctatatgtagttatagttgtggtgtgatatgcccagaattactgtgagatatgttaaatggtacagtatagctttagtagttaaggttttggagacagaaagactccaaatgcaatcttacatttaacaaggtctgtgaatttgggtgagttacttaaccttccaagctctgatgttcctcatctgtcagatgaggttaatataatgcacctcacaaagatgttatagaattgaatttatctctactcattaaattaatttcataatttactaatgggtcatgaccaccaaaaacacaggcttaacccacagaagaaattctgatattaagaatcatggagccaggtgcagtggtgcatgtctgtagtcccagatactcaggaggctaaggcaggaggattgcttgagcccaggaggtggaggctgcagtgatatgattgtgccactgtactccagcctgggcaacagagcgagaccttgtctctaaaaaaagaaaaagaaaaagaaacaaagctgatttaaaaaattgtgggcatattacaaacctgcaatgtatgtgtgtgtgtgtgtgtgtgtgtgtctgtgtgtgcatgtaaagtacttaggacttaggacagcacacttagtatttagcacataatacctagcaatagctcaatgaatggtagcttaacaacaataactaatgatattacgacatgtttatttcatcacaccttcaccatgaataaatgtagagatctaggacctagtacctcttgctttccctttggtgctgaagcttcactccactgcttcccaaatctatgtgtccacctagaaatgggtcatggttgctgaatcgtagaataataatactgcaaaattgctaaatctctgaggggcgtgtgtgtgtatgtatgtgagtgtctgagtgtgtgtgagagagagagagagggagagagggagggatatggggaagggaagcagtgcttgtctctttcttcttgctaaagacacttccttaaaaataaatacactggaaaataatgacaggaaactttacaaaattaaaagaggatgtcaggaagtacaggatgtgaggttgttttcatttctgtcagtattttcttattcatatatatttataactttaaaaagcagagaagttcactatttcttctacttaagatcaaatttatatataaaaaaaagacctgtgaccaaaaaaaaaagaacccacttaatactttctagctgcaattaagtatctgatctgactacattattgggcaactgaatagaatacttgtcacactcattctctatttctaaaaaatgatgcaggccaggcccaatgactcacacctgtaataccagcaatttgggaggccgaggtgggaagattgcttgaggccagaagttagagaccagcctggacaacagagtgagaccccatctctacaaaaatatttgtttaaaaattaacaataacaacaacaacagcagcaacaacaaaacggttgcattctcagacagttcacgccaatgtgggaaggatataaaagtaaagtaccctgaagcagcaatggataagaaaagcttggtctttttttaaaacaaaaattttttttattattacttctttcccagaagacaactttcaaacataggaacctaggcaaatcaacgaatgctcaaaactgaaaacccacttccccctctgagaatagagggtacagaaatatcagtactttcaatgctttagcagtcatgtgaatggtgagcattctatgtttttccatatgcacagcaaatgagcacgctgcttgcagctttttctccatgaaatggggatctgcatcccatagtagttactgagcagtacagttcctctccaacattgaaacagtttatctgcaaacaaatttctaaagttcctatgtggctggaagccaaaataaaacaactatgttttgctgtcctctgctttgctgaacagatagatgtaaaaggttgtaggtgggcttctctttattactgcacttgacttattaacaccttgagactcgaagaataaagtgtacttcatcttgtaaaagtttatgatctaagtcaaacaattcaaaaggtcataatttagctccatctaaggaactttaattcaaaaagacaggaagttgcttcatattaaaagtagcctcttctttacttcttaataaaattccctaagaaaatatttatggcagacatatgttattttcatcattccttccttggggaaaccactattccctgcttccacatggtttcagaggggctgcctatcactgtaccctaccccccttccagccacactgggagcataggacacaggcctggccaaccctaaaattatctgttcctgaaattaaaatagtgatgttgaaatagatatgtttctttcccctgggatgctaagctagggcaagagatcccagagcttccctgtgccatcttcaccaccctgcatggaggaggtggagcaggtccagccgcagaaggagaaaatggcagagacagaggagcaaaaggagaaggaggaggaagaggaaaagagggagaatggggaggaaagaaagaggaaaaagaaggggaagagtggaaggggtaagaagaagaaaagaagtgtagtctaacctccacagagctatgattgaagccaactgattcctgaacctcctagatacctgactcaaccaatttccttctccattcaaattagttttaataattctgcaacggaaacaggaggaactaacaaagtagctagtgtttgttcattcattcaacaaatatgccaggcactaaataggcatagagtcatgatgggcaacatatagtccttgccctcattgagcttatagcctggttagggaaaaaaatatcacacacacacacacacacacacacacacactctattggaatatatgtatatatattcaattttttatgttatcaggaaaacagtagagtgctgtgaaatagcattagaagagaattagggagctatgtttacagtatcactagaataatcacatttaaaaaaaaggaatgcgtgcatggtggtttgggagtccaggtctaacaatctaagagatgaggcagcatgggagaaacagagaaaatgtcctacctggttaggagaccaggatcctcatcctagctccatcaaaaactgcagaggttttcctcatcagcaaagaggtaataggtgtctttcattatttctccagggttataatgaaaatcaaatgatcacatacacctgattcacatttgaaaagaagagtacagtatatggtactgtggtaggataccagggtacatgtggtaggaagactaacaggagaacatggtctacccagttcagaaggctggacatgtcccacagtcaggtaggaattgaagaggaaggctgatggcccactaatggtggatgagagaattgctttgcatttacaaaggacatacgacatgctccttatttacttatttattttatcctttggcgtgttaatgagtacattttaaatgagacaacagctctcaatgatgtttaagacaataatttttaaaaactacttaaggtatttttacttattgtttcccatatggcttttgcgccttctttacaagacattttaggtcatttttaaaccaaaaaaaacaaagacggcacccccatttctctaacttttgaaaatccaattataaaaataatacactaatattgtgagatattcaaatagcataggaggttatacagtgaaaagtccctctcatgatcacccctacctactctcctttcccagagataactaatcttaacagttttctccattctttcacaactttatctgcatattggaactgagtcttgaaaactgagtagtagtagccatttggccactcacaaagttaagggtttattaaattatattagaaagtattaattggcctgccagtgaatgggcacagcaactgggtatttaatgggcagctccaaacggaaagccctggctgtgcagcacccatctatggctggtatggtttcaatctgtgtctttgctcaaatttcacgttgaactgtaattcccattgttgaagatggagcttggtaggaggtgattggatcatggggctggtttctcatggtttaacaccatccctcttggtgctgttgtggagatagtgagttctcatgagatgtggctgtttaaaagtgtgtagcacctcttccacttcctgctgctcctggccatgtgaagtgctggctcccccttcaccttccgccatgattgtagttttcctgaggcctccccagaagccgagcagataccgccatgcttcccatacagcctgtggaaccatggaccaattaaacctcttttctttataaattacccagtgtcaaaaaaaaaaatacgtcacccagtgtcaggtatttcttataacagtgcgaggacagacaaatacaatggccaagcttaccccgaggacagttaggatggtgttttttggtttgtgcctgggtccaaggtcaaatagctggtaccctttcaaaacccacaaatcatttacaatcttgtgtttgttctttgttccattggtagaatcattttgcttccatctctctaccacaactgggtattgaggatgtcatttggcaagtagaggccctaaccaaaaggtcctaaataatagctgcatgggtatcttgttattaaacaatgaagctgctccaatgagaaaggctgcattataaaaccatgtggctttagacacactcactgccgcccaagggggaacctatgctatcataaaaactgagtgtctatcatccagataacatcactaaattaatggttgatataaaaactcaactaatctttcagatccaacactctaaatgaccagctaagcagctggtttggatcatggggaatttggtggcagaagctgggacttattcttggaaacataatcatttgttcggttttttcctgtttttgtctttattgctgctgtggcatttgttcacaatgaagtcaatgcagagctgaaaaaaatgaaataatgattgttcacagaattgcattaactgcagccacgtagcctgactcaggtcacaaagtcacttccttcattttgcattaaatttggccaggctgggtgtggtggctcaagcccataatcccagcactttgggaggctgaggggggtggatcatgaagtcaggagttcgagaccagcctggccaacctggtgaaactccgtctctactaaaaatacaaaaaatagccaggcgtggtggtgcacacctgtagtcccagctacttgggaggctgaggcagaagaatcacttgaaccgaggaggcagaggttgcagtgagctgagatcgtgccactgtactccagcctgggtgacagagcaagactccatctcaaaaaaaaaaaaaaattggccaatatcccatcagccttatagcttgacttatttcccctgctgtgggactcgacactgtcggaatgagccttcctagtgacgcaggactaaactcctgaatataaaaggagcccagagctgttgagtacatctactatgctttactcgaaatatcttaatgaaaatggagaaatgtgaaattaaataattcaaacttaaagctgttagaattttaaagtattccagccttaagaggaatacggctatgtggcttgagtcacttgatgtacaactgcaacttctgcctttttttttttccctgtaaatcattaagaagaccaaatggcaccagagataagaaccccccacccccaccccccaagattactacctctcctcatagaatgaagcaaatgtagcattttgtaaccaatcaaatcactgtactgtatgcacttgtcttgtatggaaaatgttgtgattctgctaaaatttctgtctctgcttatataagcgaaacattaacttctcctctttgaaacactgaccccatttgtttggagtaagtgtttcctggtggcaagctttgtgcttgaataagctctatacttaatcatattttctgaatctcattacttaaagttgacaggttgtttctacaagtggaggaacaacatgagcatgcactgtcatgatgattgatttctagtccacaagtatacagtcttcaaattaagtataatttggcctgaaatcacattgtccattagtaaaatattccattgtattcatttgaggagctttctctcctccatgggtcaaaacaagcatcccaggattatgttcatccccaaaaataggatagaggtgtgagtttgcttaattggctacttgctgctccctgacacaggtccctgtcctcttccatgtggactatgtgccctgggtaggctcagcggtcctctctactgatcacaggctgactgtgcctccacctgcagcagcgtgccatagaattctcttccattggtctcgctttagccttaacttggaaagaacccttccttacttccctccctgcctggaagatcccacagtgctggccttttctgaaaaaagatgctcatctttgttttttaattgcttcatagttcacctttttataaaagggaaagcaaagaggcattaaacagcgtgactcactgggaaagctagtatttcagccagacagaagagttcattggaggatgggaagttcagaggaatatggctggggggatgaacacctgattagaagggtttgtagggtattagaataagtttgtatttatctaggcattgaggaaaccggggtcattcaaggctttacacagaacagtagcaaaattagattttcctttgaaaaggaaactctgatgctggtagggagagtggttgaaggggagcaaggctggaagcagtgataccagttaggagaccatggcagtagttcaagaaagagatgttgtgaacctagtgccttaatcctctgctgaatctgagagtctcctctccattggcctgtgactaggaccataggccaatctcctactataaaagataaaaaggctgatacaaacatttctaggcttgcttgcagcttgagttaagacttaataaggtgatattacaattcattctggcagtgctggcagaggaaacagcagcaatgatgctctgcgagcctgactcagggccagcagtgatggcagcccaaggtaagtatatccaggggctgctggtggcagcagcagtgtctttgatgcagtggttcaatatgttgtatttggctctggttctggttacctgaacttcctttgctcttgcccattttctgagcctgagtcttcaggtctctaatttattttcatcagatctttaaaataatcctctgaggaattaaggcaggtgttattattttcattaagatgagggaaatgaaactacaaggttaggttacttgcttaagagcaaaagctagtaagtggaacacccagggttggatccaaccaaatctttgtgatggtcgcagtactctttacactccccacttgcttaccaaacttggtactcctaatacctggcatatacaggaaaatgaaaggaagggctagaagctattgcttacacttggcacaggctctaaagttatgtagaagtcttattaaaattaagttatttaaagcaatatataatggagtaaaatacaagatctaggtataattagtaatttaaataaattttacctttgtaggaggtgagcatctagattccccaggaatacaaaatcattaatctttgtaatgtgtaccccggtaaaaatatatgagaagtcctgaaatgaaacattagccaatccttaggctagtgttccaattagctaaatatccccgtttaatttagtaaaaccagtatttaaccccacatatgtgatttatgagtttatatataatagccttatccatttatgttcttaaagcctggaagtccagaacatcttaacaattgtgcaacaaaatttgactaaagattggtagagctatggatgctaactaatgctgctacaaatatataaaatactctgttaaataccttattgaaaaagagattaaatgtaagatgtcttttccatactgcatgttatgttgaaatgactattttgtcatctggagagaattatatgcaatgatttcatagtgaggaaacaaactcatgattcaatgaaagggtaaggtagatgtgaatcataatcactttaaattatagttattaaaattctataaatttaaaacactttagttctataaagcttgggcaatgagtccattccaagcagcattgaccaatagtattattttcaggatgttttaagtataccaggttacatctgaccataaaatgtttctctattacatgtgcccatttatttgttctactattcattcaggaactatgctgagtctcaaggcaaagataaataccacaggctgggcatggtggctcacgcctgtaatcctagcactttgggaggctgaggtaggaggattgcttgaggccaggagtttgaggccagcctaaacaatatagtgagacccttgtcaatacaaaacattttaaaaaattaatcaggtatggtggtgtgtgcctgtagtcccagctactcaggagggatgctgaggagggaggatcccttgagcacaggaggtcgaggctgcagtgagccatgcactccagcctaggtgacagagactttgtgtctaaaaaagttaataataataataaataccacagtgatgtgtaaataaggaattatgtggtgatatataacaatagaagtatgtatgaggcaaaaggaagaatctgaaaataaacccggcctatagtcttcactgaggtgttgattctttcttaaactgcatcttgaaggatgaatatgaggataacagtggacatgtaggaagggtgagcagaggataatagtttagacagagggagctacacgtgtaaagacatggaggcatgaaatagcttaagttaaaagaattgcaagtgtttttgtgtttatagaagctaacgttgaaaagttatggtgggagatgaagctaggcaaagaggggacagatcatgaaggatcttcaataatcctgtaagtcccattactgggtatatacccaaaggaaaataaatcattgtactgaaaaagacacctgcacttgttatgttcattgtagtgctagtcacagtagcaaatacataaaatcaacccaggtgcccatgaacaatgaattggatacagaaaatgtggtatatctacaccatggagtattatacagccatagaaaagaatacagtcgtgttctttgcagcaacatggatgcaaaaattctaagcaaattaactcaggaacagaaaaccaaatactgtatatcctcacttacaaatgaaagctaaacattgggtacacaaggacacaaagaagggacaataaacactggggattccaaaagtggggaggtatggggagagacaagggttgaaaaactacttatccagtactacattcactacttgggcaataggatcattagaagcccaaacctcagcatcacgcaatatacccatctaacaaatctgcacatgtacccccaaatctaaaagaaaaaagaaaaaaaagaggccaggcgtggtggctcactcctataatcccagtactttgggaggctgaggcggacggatcacaaggtcaggagttcaagacaagcctggccaatatggtgaaaccccgtctctactaaaaatacaaaaattagccaggtgtgatggcaggtgcctgtagtcccagctactcaggaggctgaggtaggagaatcacttgaacccgggaggcagaggttgcagtgagctgagatcacaccactacactccaggctgggtgacagagcaagactccgtctcaaaaaaaaaaaaaaaaaaagaaaataatcatcatcatactatatgggcatgatttaatggacatgaaaacgatagcaaagagttttagactaaagcatagcaagagaatatttaccctttggaaaaatgactctgaaggtagtatggagaaaaattttgaagagaaaagatacagagtataggttagaattaacaaagacatgtaaatagaaatgaaaagatgagaaaatatgtgagaaatatctaggtaatagaaccacagaaattaaaaataaattggatgtgaagggtaacgtgaggacttagacaactgggtgatcatcaagccaaaaaccaaaataggaaatacagaaagaacacatttagtggaaattaaatataagctcagtttcaacaagatgtcatttgagttgtcagtgaattaggcgggtagtacaggcaatggtgtacatagaagaggccagggctggctatactaatttaagtcattgattacacagtggtaatgacaactatgagagtgaatgagattgcccaataggaaaaggaaatgctgaagaagtgttgcatgtatgtgtggagtttcattggtagctctcacatctttgtcaataataattattggcaagttttctcattcatgcctaggaaggtgcatcatgatgtggtagaaggaatgatggactggaaagcaggagacagcctgcaatcctggtctcttggaagtccttgcatgtcgttgggcaagtcatttaaccattctcttcctcggttactttacctgtgaaataagattggattagatgagttctaacactctgtgattcttcaaccaattctccaaatctcatgattttcatttctccctaatgggctctgatgaagctgccaatgaaacctgaaataactgggaaataggcattgagagagaaatatggcctaggaagagtcacacaccttataatttttccctaaataatggaaacctgactttgaaaataattttgctgtaatttaggagcagttattgtagactattatgaaaatgtagggctttttattgaaagggaatgatagttggtcacaaatatttgggtttggattgaatggccttttgcctccaaatttttggaaaataactaagattgacccatttaaaagccacccacttacagcttcagtgcagtagaaattatgtaatagatctgatcatatttgtcccttctggccaattatgacagcctacaagtaatgcaggaatggaaaacatttttggtaattatattgcattaaaattgtatgtcattatgagagtaggcagttaagataattgtgcaggaagatgttgcagatagatggcctcctaggtgctgagctggccccaaactaaatacgtgaaaatgttttccttcaggttcctgaaaatgtgaagtacattgggctgtgagcaccaaggaatcaaagactgtagtttcaactgacaaagcaaacatctgtgaaagatacacactagctgtgttgtagtaaatgaatggaacagtttttgtgaaattatgtcgtagttttgattgagctccagtctggcagtgcccttacacttagcctctctgacttagaattattctttgactgtcaggaagaatatctttattgtgagaagccctgagcacactgtggcttacagcaatcagggcaccaaaaacttcagaacatagaactttgcactgcaaagataaacctggaccaaaaggagtatgatttgttaaacctaatcagagtttgtggaaatatttaaaaatcaagagaaaaataaaaggacagacagttaataagcagatattaagacgtatgaaatgacaacaactaattaaaagatagaatcgaaagactacaaaagccataaaaacagtataacatctaggaataagcataacaagaaatgtacaagacctacaggaaaaaaactttaaaatgttactacaagatgtgaaagatgattttggacaaatgaaaggctctatcttggaaagagatccaatacattattaagcgaaataagcgacagaacagtatgtaaagcatcctacttttcatataaaaacgaggagaaagtaagaatctacatttgtatttactggtgtataaagaaaatctggaaaaatatataagaaattacctatgaggggtgtgggaaattagcagctaagagaccaaaatgggagattgaatttgcacactgattatccagagcacttccttgtttgattttacagctacagcaatccatgatatggttgtgttataatttgtttaattcagacttctgttgataatatttaggttgtttccagtcatttgctagtataatcaatcctgcagttaatcatataaatgttacctcttcagaaaattgattttaaacataagtaaaactttcaataacaacaacaacaaatccagagataaaaagcagatactttcaaatgaaagctctcactcaagtatagacagtaaaggtgaaaatatgaatgaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaagagaatggcgtgaacccgggaagcggagcttgcagtgagccgagattgcgccactgcagtccgcagtccggcctgggcgacagagcaagactccgtctcaaaaaaaaaaaaaaaaaaaaagaaagaaagaaaatatgaatgatattgccctggtgccgtggctcacacctgtaatccaaacactttgggaagccgagaacggaggatcacttgaacccaggagtttgaaaccagcctgggcaacatagtgagactccatctctgttaaaaaaaataataaaatataaattaattaattaattaaaatataaacaatataaacagtggaagtcttagacatggccaagtccaaggccaggcatggtggctcaaacctgtaatcccagcaatttgggaggctgaagtgggcggatcatttgaggtaaggagttcgagaccaccctggccaatatggcaaaacccaacctctactaaaaatacaaaaattagccaggtgtgttggctcacacctgtagtcccaggtacttgggaggctgaggcaggagaattgcttgaacctaggaggtggaggttgcagtgagctgagatcacaccattgcactccaacctaggagacagagtgagactgtatcaaaaattgaagaaaaaaaaaagaagtgcccaagtccaagatggttagacatccttactctccttcccatccccacatcacaatccgaatgcatgcttctggggctccagctgtcttgcttttgtatgaagaagcattcagaccagatgcagtagttcatgtctgtaatctcagcgctttcaggggccaagacgaaaggatctgaggtgggagagtcacttgaggccaggaattggagaccagcctgagcaacatagtaagactttgtctccaaaaaacacttttttttttttttttaaagctgggtgtggtagcatgtgcctatagtcttagctactcaggaacctaatgggagagaatcacttgagcccaggagtgtgaggctaccgtgagctatgattgtgccactgcactccagcctgggtgataaaacaagacccttttacttaagaaaaagaagcagcagcagcatctgtatatcacccatgctccatgcattggaaagccttctgtgtagatgtagaatcatgccaaatgattttatccatgcaaataggtacaggtatagggatcaaaagttgtcctagttaatcaattatcattagtcccacagtgttttctgtcacagatgttacttttctggagtggtaggtgtggcaaggtaattcattaaaatatgaatttgtgttggttctctctatagttttaacctcctcaattctggtgagataagtcagtttttgtctccttgtctcagaggtgatttgtaactgagcagaaagtaggagcttcctgaagaaaggcactccatttgatttgtaaaaacctcaactcatagaagagatggtaatacatgatctgaatgaaggagagtgcctttaaaagtggcaagatgggaaaagggttaacttctccagtctgggcagtctatagatttttggagaagcagggacccacttctggtccctaggcaaggtctctgagagaatcactgcatgacttttgagctccaagcaccaggatcccaaccctggtcactttccatttccaatgagaggcccaagatcaatttgttactggatttctaggaaccattcaacaataagtatatctgcaataacctccatggactggaggttagagttgtttactctttaaatcagttagaaatgtttttaactgcaaacaataaaaaaaattttaaaccaacatacggtggcttaaacaaacaggatgtttctttttctctcacaacagaattctggaggaaagtggctctgggaattgaacagtggctcagtgatgttggggccaccaagtctgcaattctccctacctgttcttcatggttgtaagatgactgctgcaattctcggcatcatgtgcatgttaatgtcaggaggaagaaaggaagagggagcactgggatgttacattcattttgtcaggaaaagcaaagcctttccagacagctccgaaacttgcttacctctcattggccagcaccatcacttgaccacttgtccactcctagctgcaaggaaagtggcaaagtagaaggtatttgagaatgtctgctgggttagccaaaacaatagtgacttctacacccaattttctgggcactgcagaagtatccttgagtcctatgtgatcagagggagagcaaacctcaataatgaaacagattcaatttccatcacccagtgagacaccatgggattagaataaatttttaaaaaaacaaattgaaaaaaatgcatttttaaaacaacaaaatcagaaaggatgaaaggtgatatttctagcatatcagtttgtggtggtaaattaattaccttatacaaaggcctcagtgactttcttctccttacctaacgaatcatctttaaaataagtaaaataaagaaacaagagcagcagcagatgcttcctaaaaagaagttaccaaatctgttcaccacaaacctgagaattcaactgtggacatttggacaccagcaatgaacatgaaactcagcttatgaggcatatttggctaaaggtcaaggtgacttaaagttcatcataggacatctacaatttgcaaagcaggtgactggatatggactccttccaagtctcatttaattggataatgcctacgttttaagtatcagaagtgagtctttctctattaaatgaagtcagttccactaaaacctaaatcttgtttggcaggcactccatgtttcttaatttttattccatgctgtatattcttttagacttgattttcacttttttttcttttttcctgtacatttatctttgctgtgaaacaaagtgccctgctttgaaggacaggtttgtgggctgctggtggtgagacaacagcagtccttccaagtcttcctcccatcactctgttagctctccctttgtttttaattagcattacaccagttaattctgttatctcttaaccctggttctgcatcctcttcttcttttctattccttactccgctcctgttttttcttgttctgcttttccaagaaatgtcttgtctcctcatcagttgactgtcttctctttccagagggaccataaaggtgccagcctaaggaacacgtaaaacgtgggaacagacaaacaagctgctgcctattacagagatagataattaactttggaccattacatgcaattcatcagcttatctttttcaaactttatataagaagtcatttcccaatggtaaccacttgccagctgcaactttgacgcatattatcaggataggtgagattgatgggggccctttgaactcttcccagggaattatctttataatgttacagttttctctatagcatggtcatattgttaacattggttataaggtcatatggttagtatggttagtattggtggctcacagctgtaataccagcactttgggaggccaaggtgggaggatcacttgagccctggtgttcaaaaccagctctggaaacatagcaagaccttgtctctacaaaaaaaaattaaataaattaaaagattagctgggcatggtggcacatgcctgtagtcctcactacttgggaaactaaggtgggaggatcctttgagcttgggaggttgaggctgcagtgagctgtggttgtgccatggcactccagcctgggtgacagagtgagagcctgtctc

SEQ ID NO: 412 - DNA, 100 bp, Homo sapiens
tcccatctggaccctgctgggcagggcttctgagctccttagcactagcaggaggggctccaggggccctccctccatggcagccaggacaggactctca

SEQ ID NO: 413 - DNA, 426228 bp, Homo sapiens
gctgctttcattttcccttggctgaggaaacgatggtttggttttgcaaaggaatgctggggacttctgccagcttgctaacggccttgccccattcagatgcatcgaactcacagaacatcgctccccagctgctggctcgcggttctgagagtgcctgaatagaaaaccactcatttcccttcgcaaaagaggcgcccaaagcagatatttcaatatattccaatttagccgagggaagccagaacatggatgttgttgccaaggaaaccacctccttcctcctgtgtgctgtgcatacgtgtatcacttcatctctctgctctccaaggtaatatcatagctccgtgcttggggaagggtttttaaaaaggcatataaaacctcttagcatcaagaagattcattaaatgatctcattccagagaagcttaaattattctttttagatccttttatgctgaggatggggaaatggctgagtcagtgctatctctcgcagcccagcttggtgtcttcgtggagacagtttttcagaaataaacaaatcagagttcgcaagcttagacagggcgagtgtgtgtgtaataagaacgaggccgtcatgtagctgtaatgtcacggtctaatccctcctagaggatctgccaagaccaccttgatctgagggcctcctgggtgtgaggccacattgcacagggcaggcttcaaagtggagacaagagagggtcggtgttgcaaggccacctgtcaaaagattccttgttcgggaactgcgtggggatttctgctgcccaatctgttctcagacccactcctgggctgtttttgtcctgccttggtgtctggtcttgggtccacctctctctcctggacgctgccatcacccccttcattcccacctaccctattctgtatgttaaagtcagcacaatcgccctcatgccttacaacccaagagacaaactggagggtgcacttggtagtcatctgagagctcagtgggtggccccgactttcacaccttcttcctctcagcccctcctggtttttagggctcagattcccccttgcccactgcatatgcagattaaatttggcttctctctttcaattagtggcactagccaagaatattggtttatattagtcattcccagctggggggcaattttgccccccaggggacatttttggttcttatttcgaggagggagtcctgctggcatctaacgtgcagaggccaaggactctgctgaaacaacttacagtgcacagtccaggcctctaaaaacagaattatccagccccaggtgccaatagtgctgtggttgagaaaccctggcttatacttattctctttgctcgttgatgtaataaatatttattgagtacctactatacaccaggctctaagccagcagctggggatgtgaactgaacaagacagacatagcttcactcactttctcacatagagccaattgggagacgttaaacaaataattacaatgatacaaataaattattattacagcttgaatctagatctgacgtggatatcctgccacagttccgaagtctacctagtgccccagccgaacctgccctggctcctaggtggggtatggacatctgtgacatccctccccaacaccccaccaagctgggctgcaagacgggttatggtggccccatgacttccttccttggtaagccacaggacttccttgttaactgctttgctgttggtcattgcagagaaatagggaacaataaaaacaacctgaggtgtggcaaaggctctaggactgcatcatctgctgaagctccagtccctgcgctgcatctcctgagtggcatctgtgatggcaaacaaaggctccttgggcttcacgctctgctttctttctaagtggtacttaccacccgctgcatcccagccttcttctgaccagcttcctcttctgataggcttatttccatgaagtttttcagagttagaagcatgaactttagaaccagatgatcccggttggaatccatctctggcacttgctatatgaccttggataagttacttaacctttctgtgtctcagtttctttttctataaaatgggcataataaaatctatctagcatagttattgtaaggattaagtaagttattatatgcagagctcttggttcacagttagtgccatttaagcctttctgtcattcttactgttaccattttcctggcatgtcagtctgatgatgcagacgaggcaggaactttcgtctctgcctctcgtggactgcccaatcagctccacggaactcagccatgcctgcagtgctgcaggcctcgctttggactgctggaggctgagaagtcaatggatgttgcttgggcattttggggggtttccttatgcaggaggaagatgacaatcattgtggaagcagaaggttgtcatggaaatgcacctgttccaagtcattgcaccctgggctctgggctggctctgcacgggcctgccatgcactgacttcagcttcatctgagtcagtggaaggctggacaaaggtagacatctttcctcactgccagcctgccattgcggctttctgtctctggtgtgaacaggcaatcgagctttcctggtctcctgagctactgtgaacgtggcagaagatagtggactctgaataacattggaaacaactacttcctggacggccactgtgtgcatggcctgcgggagggtgagggcaagaggactgatggttactgggaatcttcttcatggccaggcttctgtgtgtcctctcacttaatcctccaacagcactgtgaggaaaatacagcatcccacctcacaggcgaggaagcttaagttgaaggaatgttaaattgcctgctctgagcctcacagccgggaggtgacagccccaggattggcggccagggtttgtctgcctttaaaacttatgtcatgtccttctgtgttatctcggtctgtacaggctgctacagcaaaataccatagcctgggtagtttatgaacaacagaaatttatttctcatagttctggagcctggaagtccaagatcaaggctctcgcaggttcagtgttcggtgaggacccacttccttattcatagacgtccccttctcactgtggcctcacagcaaggggtcagggttctctctggggcctctttaaatagggtcaccaatcccattcatgagggctgtacccccatgacctaatcccctcccaaaggccccacttccccataccatcaccttgggggttaggattctaacatgaattttggggggacacaggcattctgatcatagcatatgtgtagttgctcctggcccgctggggaaatcaccgtctccaagcatggctcccatctggttaccctgggtggccaaggtcagcagaggtgctttgccaactgattggcacccacactacttctgtccaggtgggctggggcgagggttgggtcacagtgggactctgtggggctccggggactgtcagctgccccggggctggaggtcctgctgctctgtgcccataggcacctcctgggaatctggcgacttgcatcagggcccggaactcaccctgacagttctttcagctcttgtcttttcctcccctacctacctgctcatctcgctttcacacacaaagcctcccctgcactccccgctcccctcctcaatccctttcccggcttttgtactttatgatgccgtgacttgggtgaggaaactcattaaagtcattattccgtgcacagaaatgtgtctttcatcccattcatatttaatgttcctcccacttgatcttttgatgctttttaattcttgatattacatgacatacacacacagctctcgttgggaatcgttctttctatagagttgtcatgactgctctctgtgtgaggagggctcctccttacgtatttattaatttctaaaatgatgcctgtattttgggattgatgctgtctgatgctattgactttgaatgatcaagggtgacattgggataagaggaattgtgggaacaggacagaggtctggattcttctcatgactgttgcttttcctgcctggaggccaggtgtccatctgtgaaatgggcagatgcatgcctcatggcctaatccaatccctgcatttggcatccgttgggattttctggggtgtaaacacctggtttaaattctgtctaatttgctataaaaaggaatattttaggaggagatggggctacccatagaatcacagaaaaggctgagaaattggctgtctgagggacagataaccagggcagctgcagggacctgggagcgggctcccttccggctccgtggtgaaaggaaggagacctaatggctgtcaatggctcttttctcagctcaagatttaaattccagtaagtgaacatagaattggctcagcttgggtcccatgcccaaggagagggcggggtgttttgattgacagttatattgagatcttatccaatgagggccaggagttcccccaaggttaagaggctgttttcagaagaacgatggattctgagtagaagaaacaacaaatgccctgaacacatcccaaaccatggggaggcagtgagaccatggacaaaaagaggaaaaagcaggttcttcgggttccaaatctctgacagagagagatacatttctgggcctcagagattaccttctaattcaggaggaggcaaactttctctggaaagtgtcagagagtaaatatttttgtctttctggcccacatgacttctgccatgataccgtggaagtagtggtagaagacatgtaaatgaatgggtgtggctgtgttccaataaagctttattgataaaaaacaagtagcagggtgggttgggcctgcaggacacagtgtgctggcccaggttctagttgacagctttcacttcttagagaagttcctttccagctttagcaatccgggtaagacagtggttctccgatgtggctctacttcagcagaccccaaggagcctgttgagaatacagatgcctggggcccaccccagccttgtcaaattggaatttccaaggatgggcccaaggatctgtatttttaacagttactcctagttagttctgaactacacagtgttgtgaactggtcttctaagacccagtggagcaggtaagaccatcttccgtgaaatgtggatgtagtagagaaactggggagggcttaggaactgagaggagaggaaggctctccagggttggggaacagtgtgtgtgtagggcaggcttcctggaggggcccatgctggccctagatgggaaatggagctgtcccagcactaacctagattttcctagctctcatctcattctctatcctgtggtatgctattcacaagccagaggggaattgatggaaagtccgggtatgaaatctgagccatgcagttccctgctgtgaggcagtaaggtctcagaaagttttctgttttcattatttcgaaaaggctgcacccataacccagccctatttcatggctttcctccatggcacccctttccccttgtcatcgttcttcttcctcccctacagacctgctttatcagaaacttcctttctcctttgccctgaatgacccccacctgtgcctctttctgatactgaccttattctggcaaacccagctccttcttgctgtaatttttaatgggaataagactgctgggagaagccctctcccatctctttcagttttccatgttttcttccttaacaaacaccccactcataaaacctttggggtcttttctactgagggttgaagcctgtagatgctagcagagcagctgcactgtaaagagggaggtgggttcctagggggtggtcctgggcccagaaggtttctgaccatcatcgctctccccttggacctaaacagggctctttgcttgttacaatagtaggcatccattgcctgcccaacattcacctcccttttctggcagcagaacaccttttttctcaggaatttactccatccccactttgagtccaggtggattgggtggattaactccaggatggacatggacccaggcctggcaaatcagtgcatcggattccccttggccacagtaattggttcagggttgggtctatgggcaaagtccatgctgggtcttatatggggttgtacagaggaaagaactctctttctggacttgctgtcaaactggagtttttggagtccaagtggggagagtgtgctgagagtgagtgtagtacaggggaaaaacaaagccaagatgtgcaccagagagaggatcaaagagtgagagagagaaaacaggtccagaggatggggtttgagcctctggatccagccggacctgaagccagaagacctacatgcagacttgtctactatatgaaatcttacattctctttctggattaagccagcttaagctgcaactcagagtcttgactgatagttgacttggtgctgggaagatgagtctctccacagggatgcctgagccacagggagactgccgtagtcagctgtgagctctttcttgtcctatcagcacagcccagatgagttctcaccaggaacaggtacacaacagtcataaactgacagggttagtcataggcccgttgtgctctgaaagctttgtcagaacagacacacatcatttgtccccttccacaccccgctagcagctctcagcatggtcctcagtgaatgtgctgtttgtccagctgattgaggggcagcacagccttcctcaccactcaacaactgcctgcacactctcctgccatcctggtcttgtcagtatcaccccaccgacccagtttccaagttagaagccgtcgtcctctgcctctttgatgtaatccagcctcttactgcttttccatctccaccaccacctgcttagctcagacctcagcctttcttaggaggaagccatttggctctggaactgacacctacccaggttggcctctgttccttacctgtgaaacggggatggagcactacacttgaaatgtgaaatgtctccaaggatttggatgtcaggggaatgtaatggccctttgagccattatattcaaaaggagcagaagaaagacacaaagtcacctgcaagaggcagtggcccagaaagcttagacatcacctcctgaatgtacatgaaggccatgtccatcagaagggagccttggcagccaataggagcacagaaaatgaggcagcccagaggcacgctttcctgtggaatatctggactgcattatgggcttctgtcagttgtgaacaagaacacactagagcctgatgccactggctcctccagcaatgtccgaaagcgttgacttcctgtgtttgctagccaacagggaaagaatgtgctggtcaggcagtgcaaccgtttgcaatgagtaagctggcatttgggctttgttcatcgtccttgtgagctatgagtcagcatcttggagactgtgaagtctggccatcaatgacactgcatttctggtttgcagggcttggtcaggccctgaccccaggttctcaaggtcaggagtgtatcagtgtgatctaagggctctacgccctgagattctgattgatgaggtcaagtgggaccaggcccttctactgaacagctcctcaaggaggcctggtgcacagccagactgagactcagggcctgtgcatggttaccgcacctcccctggctgcctgtggacccccttttctgcctcctttgagccttttcgcttggtgttgctgattgactttcatgttcacttgagtaatttacatggagcctgctttaattctcctgagaccccctgtaggctttcatgaaattaaaccctcaacaacgacattagagaaggaaaaagggcctctttatttggaagttgtgaacaaaaagagaacagaactgctggcagttgttcttcatctgaatcttctgcttctggctctgtagttggatcttgtaccaccggggctttgcttccaggatggggtgacttagggtggatgtaattgtcatgaccttctgggggccaggatttggccggaatgaccaccattccaattacttggctttttgctactggaaaggctgtgagttggctctctaaggatttctaaatgactaaggctgagcacagaagcagcaccccaaaatcctgtgcaccaaggttggggatgaatcctcctctgatccttctcccaagacttctggatcaagagtgggtttcattcatttggcccctctgaggagacaagtggagaaaggaagttctatttactacagggtctgtgactttatgcgacttagaagggtacaagtatgataattgtagaaagcagaacatcactctggctaggctctgttgacttggacaaaatcatctctaatctatgatacatcctgagccaaactatactcactgttggaattggggacatcattcgcatggcctcacttctgttgcttgttttgccctctaaatctctgctatcaccttcacctcgttgactttgcagttaacttctcttgctgctttgcagagaaaatagaagatgttagatggggacaccaaccttttgctacaaaagtctgaatgtaaaaacattgtctgcctccttgtcctggtttcactggcttctgactgaccaaggctaatggaatcacatgctccttaagggtctaaagggtcccactcattgctctatcttcaaagccattcccatcaggatttaggtatgtctgcatcttgtccacatttacaatggagttctttcttcccttccctttgcagcttacccactagcttctgccttatcactgtcttcccaactcacagtcaaacttattgagagaatgagctatactcctcccacacagtcctgcatctatttcaacagggtttctgcctatactcctcccaaatggatctgaccatgttaccattgccctccacgttcccacacccagggatacttcagtccttactttacttaaacctgcagaaacgtttgacaccctcaacagttccttcctgcaaacatctttccttggttttcatgacactgaattattctgattttattatccctcctcttccctttcagtcagggaatattctccctctgcctgttccttacctcagtgatttctgaggtgtctaaaaatcatccagggtggttgctagaatgcaggtcagatctcagccccaacacctcatacaggtgcatcatgacttctcttgactgcttagagtaaaatgtgggaagagagaagcaaattaaatatagaatttatactcaaaagggaagcagaactcaaagagttggagaattctcagcctgtaacacctgaaaaaatgtgttcaggagacagcatctacaatgtggctaagcgactgtttgatcagattagtagggacagaaagaagccagatgctttccatcaggacactggaagaacggccctaaaggtattttggagatcttcagggctgccacatccatcacaggcccagagtgccagggccttgagggtggtagaactgtttcaagggaggggctcagtgtgcctgtgggaccttgggcttgctgcccagagccacctccaatttttgcttcatacttctggtgcagtgctctttagccaccccagctgaggctcaagtgtggctcaagagggccctggtacagcttgggctgccacttcagagggcacaggctgtcaaccttggtagcgaacctcagaggcccaacccctgactcgttgtgtccagaaggcaggacatggagtcaaaaaatattcttctcaagcttcaagatgtaacactgtttgccttgctgggttttggacttacttgggatctgttactcctttcttttttccagttgctcccttttggaatgggaacatctatcctatgcctgtcccaccattgtattttggaagcacgtaacttgttcagtttcacaggctcacaggtagagggcagtttgcctcaggatgaatcacacctttgagtctcacccatatctgatttagatgatatttagatgagacttaggactttagacttttgagttgatgctggaacgagttaagaattttggggctattgggatggaatggatgtattttgcatgtgagaagaacatgaattttgaggggtcaggggtagaatgttaaggtttgaatgtctgtgttcccctaaaatttgtgtgttgaaacttaagacccaatgtgatagggttaagaggtggggcctttagaaggtggtaagtcatgagagctccaccctcatgaatgggattagtgtccttttaaaaggacttgagggaagcatctgggccccttttgccttttgtccttctgctatgtgaggatgaagcagcaagccaccctcttgcaagcagagttgatcagctcttaccagacaccagatctgacgctatgatattggacttcccagcctccagagatgtgaggaatacatctctgtccttataaattacccagtcccaagtactttattgttgcagcatgaatgaaccaagacaagtccactttctatctccagcccagtcattgctcctgagcttcagaaccacatatccaactacctacaagataccttcttgaggatgtgccagacagtggaaacattcaaagcagaacttctcatcatctccatgcttgctgtcccatgttcctcttccctgtgactggcaccattgcccaaccagttatgcaagggagaaacgtcgactcctccttttccactgcccccgccaaagacccaaccaatcttcaagtcctgtacattctaacccctatgtaggtcttaagttcccagttgcttttcacttccactgttcctgccctgtccagggccccccagattttctactggatgggcctctccctgggttatctgcctctaagtgtgccttctcccactatttttcacatggtgacttaggaacagtttcagtctgaccttgtcactcttctccattcaggccttgagtggtgtcctattgcttctgtttggacaaaatccacatcttagcctggctcctcttctgtctctaggtatttatcctccaggataatcaaatagctactccactagcctggctcagcaccagagctaggcagaaaattcaaatgattgtagcacagtttaccaagtttctgttattgagctaaaataaaaagggtcagcttgtccagttggattcataagaatcagagatctcaaccagtactaagccttactaataactgcaaggatacaaataattgtgaggcccgggtaaagtgtgaagtctgaaccacaatacagctcccaggacttttttgccacattaggctgtgccctggcccagacttatcactaggggtctctacgtgctacacgcgagccatccttcttgaaagcgtagctatttgggtcctgaaacatcttcacttttttctctgctagtttcatagcttgcacaacattttccagggagccatctgacataaatccataggttccaggtttgtttaccgcgagcggttttaggcagatagggcacgtctcgctaaaagcattccatagataagagagcttctgctggccaacatcattagagtgtttgccagaggctctgtccctggaaggattatgaggggatttgatggggtcatctttctgtcttgcctggggtgtctctcctacaggtagagaatgaactgcaggcatacagctgaccctctctttccccgtcctgctctgcccacctccaacatgctggtgcttcccagagctctgaccttggtctcttctcttcttactctacatgtgtaatatggagcacctcctcctcctcctcagcagcttcctttctctagacacagagtctcccaaagctacctcttttacctttcagcttcagactcacatattcccctgttcattgctgccttaatgtcctccagtcctcagacaagcccattgggtcctttcttcctttcagggcaatgacatgcacgcccacctggttctcatgaaaccttgaatcatcttggtcctgccagttgctagctctttgtcctaaagtaagtcagagaggaaaacctctatgaacctaagtttccacatatgtaaggtgggcataatagccatatctgcttcacaaagctgttgtaggattaaacgagatgatgccactaagagcttatggcagtggctggcacaccgtaagtgctcaatagttactggaagtatctttggttccactcccattcctgtggctactcattactgcatgttacaagttctagcttcttcttaaggccgcctttccattttcaccgccctctcctcacctctgccttcacccgtgacaacagttttggaactggcctcctctatgcagctctctctgatctcccctattctctgtagccagaaaaatcctcctccattatgcacctgattatgttagtgcctttgaagactgtgttgctcttgggagaattccaaactccttaaagtggtttaggaggctggctatgatctgaccgctacctgtctccctgcaactcctcacctcaaatgctgaccactgggtgtgctgaactttcagctcttctgacccgcaggatttggcagaggcatccccaccacttggagcactctcttcctttctctccagccctccaactctctcccatgctttgcaatgctcgctctgcctttctcccatcagagcactttccagctgcgtggccatgctgggttgcatgcctggacccctcatgggaatgtaaacttcaggagggcaggggccgtggctcacagttgtatccccagcacttagaacagtgcctagcagatggtaggtccccagtagcaaataatctgagtcagtaagtgagtgggcaagatgaaagggggtggggtggggagcaagagggaaatcttgagtctggggtttctggcttgaatgaaattgagatgggcaatcttcaggcaggacttcttgttgaggggtcattgttttaatgagttctttggagtagatgggcctaggtgagcttggcagtgggcaatggagatcaggcctcttgaaacaggtttatgatttgacaattagcatgggagatggatctccttccctgccccatcctcagctgccctcacagcctagcagggttggggcagagcacgcgcccactcggggggtggccatggtgtaggtaggcttcacaaggtttctttcctctaacattatcttgggctctgcatgggacagagatttcacctaggtctgtgaatcctgcaacaaactagtgctgtaacccttgtgactggcaggtttctgtcctgtttcatgtggcctgtccctaagaaccccttgttggggattgtttgggctgtgggtgggtggggtattccttgcagccgtctgtaggaagctacttgccactactcagtagttcctaggcaggaggctgtagtgcccactagggagccatgaaggtgaaaagtccccatttctcaaagccaacttttgccttcctccccaaatcaagcacaacttgcaactgtgatgaccttttaatcgattctatattgaagggtctggaggaaggaggggaagggaaagggcagaatcgggccttgtgccttgcttgggcatcttgcccccttgacctgcagaggggtgacagggctgtgcctgggtcctgtggccgcatggaggctccctgcatctttggagggtctcctgagttactccaccctgcagagtaatgaggtttctctcctcctactcctgcatcttgcaaattctgttgtcatctgctgactgtcagtggctttcctcagcccattttctgctggctctgcagagggaggcttgattccactctgaggggtgaggctggagagtgctggggagcagggagtacagaggctcacactttaggctggggctgatttctcctgaaccatcagcaatcaaatctgcctcaccactgtgagaattaattccttctcaagctccccttcagataggtgagaaatccgtgtgcctcctattaacataattgtgaccccgtttcttgtgaaatgacagccctggtctgattatgctcagggagcatccacagtctgtgtcctgggctgcgtgacgaaagcttcctcacattaactggcaaatgaacagtcccacagtccacatggtctctggaatctgcagacaatggccacgttttatctcagccataggatggggtcaagaagaagttccagtgtagcccaccacagctagttaagtacacgcccagcagcattttaaatgagcgggggaggagctctgcaaaggcgtggctggaaggacagtaggcttggagctggggggcctaggcccagcctgccatttgctaactgtgctgttggggtcaaatcccttcctcgcaaagagagcagagggctggtccgttagacctgatacttgctgattctaggctatcactgagtacagccttagaacctgtaaactgggttcccattttctgtgttggaggaagggtctagaaaactctctagaagacagagttaagaagtcaaatcagtggttggataaaggcctttcctcaaaatacgacactgcagaaggcaccagaggagctctcctccctggaggcaaggcagtgggctgagctcaaagcctagcctggccatgtgcctagttggaggcccatggaaggcatctgggactggggatgagacagtgtgtctgtttccttgttgagtcactcttgctcatcaaatatctatcgaccacctctgatgaccaagtggcatgagagaatggaaagaagtctatagtcaggggagctccatgtgcacccagcttaatcactaactggtgtgggcctgcgcaaatggcttttcaccccagcgatgtggccatgcgccctacatgcctcatcctgtgaggatgaatgaggcagtgttcctgacacagagtgggactcccccccaatcctgcgcccttccctctctctgtgtgcacagcaacatttgagacagcacagaggacactgaggccattcagaaaatgccactgtctttcagcatgaacaggcccgtggcagggcagctagtgtgtgtccagaaatgccattgctgcagagtggaattaaccagggtcccacggcctggggactcagaggagtaagaggcctgagcagaaagagttttatggatggtgctgagttgagcctagactggcttggcacttgaaggagaaggaagaaagatcatttcagggcagagaagagtttgggtcaatgcatgggtgcacagaagctcagaaaagaaagcaaatctgtgtggtggggtgtgtgcaggtgaacactccatacaagatggtatttctgtgcaggcacatggagggaggggtgtttgggtcacaatgttttgagcactggggagcacggatggcatctgggggtgctagcctcagctctccacttatggtgcagcatgttggggtaaccttttcttccccattcttctccaggactagacaccgttattcagttctctagtattttactttttgttagctcttatgcagcaggggagctgcactgccttggtgttggaataattgtcctcttgtgacactgtaaaccacccatgcaccagccttcccacccccccggtctattgttctccatagtgcttctcttcatccctgcaccatgtgtttactactttctgttccccacattagaatctcagctctgtgaggatggggacctcaccgctgggtttgctactctacccaaagcccttagaggactgcagcaaccagtaggcttttgttgcatatctgaagaatcaatgagtgaatggcagttggatggatggctccttgatcacctgtcgtggggcagattcatgtggcaagatgtcaagtaattcatccaagcccgaattcacattcattcgagaacttacaatgcccaagagtgggtggtaaatattgtaggatgcccaaagctcccaagatgataaaaatgaccctggagttatactaagggccaccctgcaggctgccccctcctgtgcctcctgataatcatggcttgttgtggggtgttaactgtcacggtgatggcagggctgaactggagctctcacaaaaggagagtgagtttttcagagagccttggttcaaatgaagtcttttgaaataagatcaaggagtatactcttttcccatggtgttggtaggtgttaagatgtgttagactgtttgcattgctatctgaggctgggtaatttataaagaaaagagatttatttttgctcacggttcttcaatctatcagtctataccacatagcaccggcatctgctcctggtgaggccttaggaagcttccaatcatggtggaaagtggaagggacccagtgtatcacaaggcaagagggagcaagggagaggaggaggtgccaggctcctttaaacacaccatctctttcttgaactaacagattgagaacactcattacctcaagaacggcaccaaaccgttcatgagggatccaaccctatggtccaaacaattcccactaggcccatctccaacactgaggaatcacatttcaacatgggatttggaggggatgagcatccaaaccatatcatgtgtcagtaacatttcctgaacttcagtaaacaccagaactgattgctgtcctctgttactcaggtccatgtgggaccagggatattaaaaggagggaggatcctgatggaaaatgcagcagaatatcaatgcttatgaatagacatccgatttcctcccccaccaagtgtgtgggaccgctctgtagatagccttccccctcactgcctgaggctatgggattccctgcttggtatccagccccatgctatgccctgaggtggtcttggaggtctttgctgccaggagttcacagctagttagggaggtaaggcacaaaccaggtcgagacaggtagaggagcaggatggggcagcaggagggtgcagggtcagggtggggaggtcacagaggctgactcctgaatgcaattgcagagactcgagatttagagcaaatttttaaagcttcttcagactatgagcttcttcacaaggtgagggaagaagagaattccaggcagagaaaacagcaagtggaaaggtgaaaaggcagtgtgtgtgtgcatgtgtgcctgtgcattgtgtgtgtgagagcatgtgtgcatgtgggcctgtgtgcacatgagcatgtgtgtgtgtgcgtgtccatgagtgaactgatgaagtttctggacagtgatgtgagggaggtgggaaggaggagggaggaggtgagaggagaaggagctggtgagggaggtgaggtccaggctgtgaaggccttgaatttccctggacatggcagcaggcccctgaagggtttaggtaagtgctagtgtgatcatttctattttagaaaaacaatactagcagctgaaggccgggcgcggtggttcacgcctgtaatcccagcactttgggaggccgaggctggcgggtcacctgaggtcaggagttcaagaccagcctggccaacatggtgaaaccccgtctctactaaaaatacaaaaattagccgggcatggtggtgggcacctgtaatcccagctacttgggaagctgaggcaggataattgcttgaacctaggaggtggaggttgcagtgagctgagatcatgccattgcactctagcctgggcaacaggagcaacaatagtctcaaaaaaaaaaaaaaaaaaaaaaagaatagattaggaggtgaggccagaggcagggccactcactagcaggctgttggaagaagccagaagagggggtagcaggagccccatcaaggctgcggcactaaggatatggacaggggatggctggaatggccatggcctggtgactgatcgactggtgtgtgaggagagggcctctcaggagataagagtccagggtcactccagggtatctagtctgctggcagggaggggacgagtggggacattaaccaggatggggcccctggaggagacctagtcccagggcggggtggggacgatttgcagccctgggtgggtgggaggtgagatcaccgtatggtattaggtgtcctgttctgggcctgacccaggtttgcttggtaaagcctacttctgggctctttcctcttccccttttcctttctgcttccattcccttcctccctggtacagtttcccagtctcctcccttccccttcagcagcgatctcaagataaacagctggggaagaggagctgtggaaacgtccaatcagggaaggttattaacccaggattctaattatggtgttgccctgtgtctcttgcatggtaacaagccagcctcaactgcttgagctaagagcaagctcagtgtttccttcaagcagcatcgtggacagattcctgccagacccttcagagcaagcaccccacacccctagcccagggtctcttcatcgatagggggtgatctgtctgcccctcactgttttctccaaataggtaagaccgggtggccaagcatgtgattggcagcaaagtgcacatcagcacagcagccctggctttcagcagctgaggtcagctgttgagccaatgcattttatttatctgcctaactgccaccatgacctcttctgggagccctgggctggggtggtgccctcacctctggtatggaggagggagccctggcccaggggacctttctttgagtaactgttctgtgcagggctctgggctcagtgctgagatgcaccatggatcagacagaggctcacggacctcagccatttctttggcatgaggtcattgcagctcagaggaggggctgttgcccttaactgcatgtgtctgtgtgagtggagtggggaaggttcagaaaggttgcttcttcttattgctcgtttctaagttgcttccaaagcccccgatgggcttctcagctctctcaagaggaaggcagaagagagtcagagagagatgggacaatggaagcacaggttggagggatgtgattgctggcttgaagatggaggaagggccatgagccaaggaatgcaggcggcctcaagatgctgaaaaaggcaacagaacagattctcccctagagcctccagaaggagcgcagccccgccaatacctcgtttttagttcaatgaaactcattcagacttccgatctccagaactgtaagataataggtttgtgtgtgttcagccactaagtttgtggtactttgttatagcagcaactggaatctaatgtcaggggccagatttcaagatgccgtaagccatgtcaaggggtttggattttgttctgtagggctcaaggcttatcactacttaggagtctgtgtatgttaagcacataagcttagattatgagggtttgaataccacccttgccaataaccagctttctcaaagctgcagcattttcagctccaaaagtggggaatcatagttctcatctcattgggctagtgtaaagattaaatgagatgatacctgtaaggtgtttagcccagtgtaggccaggaaagtgattgttacttttacttgcttggcaaccttaggtagcataatgcctcatctggcggctttgatcatggcgtctgcccagggaaggtatagcaacccccctccaacccccttaccccccaggaataagtgaatttgtgatatgattgtattagtccatttttatgctgctgataaagacatacccaagactgggtaacttataaagaaaaagaggtttaatgaactcgcagatccacgtggctggggaggcttcataatcatggtggaaggcaaaagtcatgtcttacatggtggcagacaagagagaaaagagagccaagtgaaagaggtttccccttataaaaccctcagatctcataagacttattcactatcaccactaccacgagaacagtatgggggaaccgccctcatgattcaattatctcccaccaggtcccacctacaacatgtgggaattatgggagctacaattcaagatgagatttgggtgtggacacagccaaaccatatcaatgatgaactggaaaagaattgaagggtgtgcccctattggcctggcatgtggctgtctgcccacccatggtgggagcaggtgcctattcaccctgctcacctagcccctgcttccctcagctccccataggcatgtctgcattcctgtgccccttatgggctgtattcatttctggcccctgcactgtgctccaggcataagctattttagtgacaagttccttgaaatgctacaccttccctgcccacccagacagagacctctccaggcccagctgtcaagtatcgatttcccctttaaatattactgcagcccaggagcatgtatggattaattgacgaggctaggcttgtacctgcacacttcattaacagctgctactaattagtggagtagtcatttagagacctactggggttttgaggataatagttttatttatttttttccatgactcttaagcatacaataaattggggagtgaaatgccatgggcccaagtttggatgggagtcatggggcagcctgtgctctggatctgccctaagaacacaacagaaactaggacatcaccacagtgggacccagagttaagcggcccttcaggtcatctggtctactatatgtggctactgtggctgggactgggataggggcagggcctcattctcaaggtcacacagggacagggaggcagacctgggatgagcacccagggctgctggccttgttgctggccagggctctgtttgctaaatggggactctgccgcatacatttggagaacccaaatgtgggaggatagaccaagctcatggccacgtcctccgcctgccccaatcttaccctcttttcccaagagggtgttgcccttcctttcccatttctgggcctcctcccatcccatccacatcactccacccttcccactcccactggagtcctgctataccttgctgctggaacccctttttctgtccttagcatctccaaatggactagactcgacaagcaaacagtctgcagtggaccccttgggtcatccattctgatggaaacagtgagtcgaattaatcctaagtctttgaatttgggctactcattgactctctcagctttatcctcaccagctcatggtgaggctgaatgcacagtagtaaaggggaccaagcatggggatggcatggaaagagtggttcctcagcagatggtagtgcctgtgcccctgtgctccttagggaggtggtctgtgggcaaaccatcgtgctttcctcaggctgacctggaccattcactgagtgcacgttgagagattttacagcaaaggaatagagacttatagagacttgacttattatttccttcttgttttacagataatgacagtaattcgcatcactaaccttccctgaaagcttactacatgtcaggaagtgctattctaaaagggcttcacatgtattcattcatttcatcctcctgacaatcctgtgatacaggtgtttttgttatgagtcctatttcaacaaagcacaagtgaatacagtaagttgcccgtggctacacagcatgtcagaggtagaggtgaacccggcattccagctcacagtccaaacccttagccacggaactctctgacctcttagagaggtcgatttcctggctaagggaaacccctgttccccagtgtgtgctgtgtgggtggcagctgtgttggtgccacaggtctgtgtcccctggacatctgctgatttatccggggtggtcacttgaagcaaagactgtccacactatataatttgagtgatatggctcaaaagtgcgggctgggccaatctgagttcgatctggggaaaggtatgaaagaagctgagcctggaggtgggtagagttgatgagcttgacctagggctggagactcatcatgatcaccagctatgagtgattggaggaagccagctggctgagaaaggagacagaaaggtgaatgaatgccatgagagagacctcagtcctggaagggcagctttcccctacagtctcagggtgctggctcccatggagtcaggctgctcctggcctcctgtttaggtattctggtgaggatgtgctttatatcaaactacagatgcccattgatttacgatggggccatatactgataaacccatggtaagctgaaaatactgtcagtcaaaaatgcacttttgggctgtgcatggtagctcatgcctgtaatcccagcacgttgggaggccgagtcgggcagatcacttgagcccaggagtttaacgtggcgaagccctgtctctacaaatatacaaaaattagctgggtgtgatggtgtatgcctatagtcccacctactcaagaggctgaggtgggaggattgcttgaacccaggaggtggaagttgcagtgagctgagaaatgcctctgtactccagcctgggtgacaaagtgagactccatctcaaaaaaaaaatgcactttttatttaagatattttcaacttttgatgggtttattgagatgtagccccattgaaagttcaggagaggactgaatgtgtattgcttttgcaccattgtaaagtcaaaaaatcccaggtggaaccctcataagttggggactgtcggtaatttctctctttgagtctctctggttgaactcgcagcctctctcttccttggaaacagaataactctaatatgaacagttatcttatcagctctatagagtagcaccaatgtgaggtggggctcaactccatctatcaagcaaggcttctgcacaagaacaatatcctttttaaaaatttgttttaattttttttttttgagacatagtctcgctatgtcacccaggctggagtgcagtggcatgatctcagctcactgcaacctctgcctcccgggttcaagcgattcttgtgcctcagccttctgagtagcttggactatgggcgcgtgccaccatgcctggctgaattttgtatttttagtagagatggggttttgccatgttggccaggctggtctctaactcctgacctcaagcaatctgtctgcctcagcttcccaaagtgctgggattacggacgtgagccactgcacccggcccacaatattcttaaatataactggcatagatgggtaaagtactctggacacagtgcccagctgaacataaacatctgtactagtcagggtaaggatgaggtaagtggcttatggaggactgaagtttctttctttttcactgcacagttctaaagtgaatggccagggttggcagggcagtgctgagcctcacagccatccagggattggggtcctccaaaccactgccccaccatccttgagacccttggtgtaatctcagtgttggagcagggaggtgccatgcctggtcctgccacagctggaagagagcatggaggggcacctgatgtcccaagtcatctccactccccttccactagtgagaacttagcacatggtctcacctagctgcaagggagcctgggaagtgtagtctttttcagagttggcaactgctgtctgtaaagggctggataggaaatagtttcagctttgtggggccatatactctccattgcaagtactcaactctgcccttgtagcttgacaaagaccatagaaaatatgcaaatgaatgggcatggctgtgttccaataagactttattcatggactcctaaatttgaatttaatatcactttcatgtgtcatcaatattattctttttttccaaccattaaaaagtgtaaaagcctttcctagctcatggccgttcaaaactaactagtggtttggaactggctggtgggtcatagtttgtggacttctgactcctggtctggacagcgattttgggcttggccacactttgttaggggagattggattttggcagagagtgagcgatctctaccactacgtctactgcagggcttgcttagagagaggtgtcttagcaaaagcagggtgccccctgcccccttctctgtacaaacagaagagcagaattcacttggtgaggggggaacagcaatgcccctcttcccaaacttttcaggagcaaggggagggagaagccatggtggggggctcctgatgtcaacaggttgtagagaaagtgtcagctcagccctggaaggtcttctgcaatgccagataaggagctacaagctggcctcccagggctagaggcttgccatccagaagcaaccagcggctgggccgggagacaggtggcagcacccccatccctgctactagggctcaaggacaccatgcaggaggtggctttcaaccagacaatgacaatttttaataattagaaagtgacagctacaaatataaaatgtgaccaaaaaatctgtcagaaggaatgaagataccattatttgaagagtgttttcctccatccctccctcctcctcatcaactcccaatgtgggggtgggagcttgccaagcaaagctgatatcagttattgagaaaaatagaatcattccctgtttgtacatcactgagtttatactgtcaatcaaaacagctacacatatttttagcatcaactgccaattattctttctgtctcagaataatcagaaccaaagactgaaaaattcacttaagggtgttagacatggagtcaggccagcctgggttctgacagtcctggttctgacaggtcctgtgtgacctccacaagccctgtgacccctctgggactcagtcccctcatttgtcaaatggaggagagtaaaacctattgtgcaggttcgtggggagaagcccatttcggagcattgctcaacagcaaaggatgactttagtttgtctctgtgggtctcagtcttctcgtgtgtcaagtggatggttggactccatgatctgtttccactgtgactttcagtcgctgcaccactgatggttgagtctctgactttggaggagaatgctgcccttcacaggtgcttctttctacagggaggttttgaagaagatgaaagcagtggcttgattaggaacttcctgctcttcaaccttcccaggctttctgggcacagtgcaagctgacctcctctgggatgtcctcctagatttcttcaggcacaggccatctctcctgtttattagggacccgtgtatttaaacttgacctctaccccagcctttgttgtctactttctggtctgcctggggaatttgctagaggtaaactccctgtagccactctgataactgatcctaaccctaaccctcaccctaagcccacctggagctctgtgaatgggtctgacatgcacacacacatcatagctctgtcggcgacactggccccacttactggctttaaccctccctgagcctcaggtcccaacatttgccttaaggcacccttgcttaaacagcccattcagacacactcacttgtttgaccttggtgttggacacaaggagccctgctgttcagttgctcctctcatcccataagtgtgggctggaggtgccctgttttggggctagcctgggagaggccaccaatctcacatgcctgtcatgcaaaggagacaaagcacccagatctcccagccaggagcccctgttgatagccatgtcctcttggaccctggggtgacgtggagagcacagcaaccagctggtccacagaccgtgcagacgttctattggcctcacattgcccactggcttcgtgcaagcaggaaatgctatctcaagtggagctctgtcccctcttcctgtcactgtacaaatgatggatcaatgaccaccctgggagagtgatgttcttagggaacatgtgagagagccagccaatgaaatgtataatgcaaaattaaggatgctggtccttgttcacctcattaaccatctaaactcttagtatgtgtgaggcatgttgtggtatgtgacagcatttaattcatccattcattaattccttttccattcagtgtttgtggtctgtccataggtgttgggaatatggggcaaataagacaaatagttccaggtctggtggcgcttacagcctgggaggagctacacaatgaaacaattacaaaagcatttgatttgacgagcctgcagcctgggctgtggagttgaaggtggccagacaatggtgagggccagggtatagggcagagcacccaaaatgttccaggcagagagaaaagaaaacaggtgggagagctgaagggagatgcttgtgtctggataccaaagcatgggggtgggcaaggtggttctccaagggggtagggaggggctagactctaggggccccaaaaagcatgacaatagtgtttgaactttagctggagagcaagggaagtccccaaagcttttctggcagttgtacagcaggacaagttttcacttagaaggactcctccagctgctgtgtccagggtacatggataggaggagagtggaaactgctgaggtcacccaggtaagacatgtggaaagctagagccattaggatggcatgcaatgggttgagatcggttcaagagctctaaggaggaagagcccacaggatttggatatagggagagggagcatcaagactgttcttaggtctcccttttgagtgtctggttggacggtggcgtctttaattaagattggaaacacagagggataaatggactttgggaggaagatgattgcctgtgagacccccaggtgggtctggagttcaggagagaggtctggggcagatagtgatcaagatgggaagtcggaggtatagaggtggagacgggctcctctggagggctcaagtcttccagagaggagtggacagggcctggcatggatcactggaaacttttctcaatgctccacagcctctatgtacagtcctcaaattatatgccaattatgcaccaattatataacccttcttggtcaaccagaggaaaagaaagataaaactaagagagtgtagtagaaatgggggaggttaagggtcatttttttgccttctcctactcatcccagccacagggcctttgcacttgttgcatgaattcctggaccaccccttccccagatgttggtctggctggctcctcagccttcaggtcaaatgtcaccttccctgatagccatctgattaccctgtcccaaactgtgctgctctcagctgtcccagccacagcaactgatttgactttcttgtcttcttgtcctaccttccttccttcctccctccctccctcacttcctcccttccttccttccttccttccttccttccttccttccttccttccctccttccttccctctttctttcctttcttcctctctctctctctctctctctcttcttattttagagacaggatcttgctgtgtcgcccaggctagagtgccatggcacaatcacagctcactggagccttgaactcctgggctcaagtgatcctctcagctcagcctcctgagtagctgggactatacgtgtgcactaccacacccagctaatttttttttttttttttgagacagggtctcactctgttgcccaggctggtcttgagctcttgggctcaaacagtcctcctgccttggcctcccaaaatgctgggattacagtcctgagctaccaagtcctttgctcattcctttgtgggtcttttttctgtttctcctgaccatgtaaaacccctgaaggcagggaccttatctgtgtattgttcacagctgcttctccagcactgtccttggcttgagttattctcaattccccttcccttctcctccaacaggcatgcagcagcaacacatgtgtgtgggctctagctcttgtgcctctcctgggtctgttcctgtccctcagccactgctgtctgaactgcatccatgagcaggtcttgcttgggtcacttgtctttcctccctctgctcttctattgtatgattcacatggcagccaggagcctctgtctaaaatggaaatcttctcatgtggttcccttacctacactctgcaaacgacatctgaaaacaactccaaatgccgtatgacccttttcagaggccatgatagtctagcccttgcctaccctgccagttttctctcctcctttgcccttcactctgcgtcagacacatggagctctcagcgtctccagtgtgctgctcctccctctcacctgggtgcctctgctctgcctgccatagcttgtaggagctctctaaatactgaatgcacacatgacaaatccaggacaacaaagggagaaaggatactcattgggacagatttgcctcctgtttctctccctttccagggaagcctagcagagcgtcttacattctcactgcaggtctctcgtaagccccaaacactttcccttgtcctagcatttgatgcctgagtccctcaacccagtaccttgaactgcctccagggccccagccatcccaggcagccttaattaattgtaaaattgattaagcagccccctttgttaggctgggctggtgtttatttgtattttcatactattatccttttatacttctctgggcgccttcagctctctactgacaccttttattggggaaatgttaatttaaaaatcatctataatgcaggtgtcacaaatcaaagctgttcggtaatgagttgctcttatgtcgtataaaaacaattaattaaaaccctttctgagagagccgtgccagcagatttatgtttcccagtgtctccccctcgaccttcctttctaaggaccctcatgcactcagctggcttctatgggggtatggtttcctcccacctctccccaggaaatagaattccagcccggtggagtggagaaggctccaggagggcgtcgggcccaaccaccttgcgttatggagcacagagagggattctgctgtggtcacatagcacctaagtggttgcagcagcctcagaacaggctgtcctgcctgagtcgttcctcgtgatcactgctggcgtttctcctgctggccttcatggcaaggctgatggccagggcacacaggagcaacggcactgctggtctagcaagtaccactctctggcctgctccacagcccggccacagcaagggaggtgagtcattctccgctgacagatgcagtcactccacagatgctttccatctttgctaattaattctgcacttaagataatccaagggctctaagttctggtcttgcctctactcctgacccatcctgtaaccttgggtaaatcacttccccttggttgggcctcagcttctctctctacaaaatgggtatattgattgaaaccaggggttgcaaattcaaatactcataggtaccatcaatgaataaggcagtcccggcgggacctgggaaaaaccatagaggagcatgccctatctgaaggagaccacctctatccctttcagatgcttgtggccataagaaaaagcaggcctggcgttgctctttgcagagaaactggaaatccagcttggggtttcaaaatgttgatgagcgggccagaccttgctcaatttgtcctcagagccccttcttccacatcccctgttctgctctcaggggctggccatgtctctctgtgacctactgaggttccagggtggctgggtcatcctggctcctgggcttcgtcaccagcacctccttcctccctccttacctccctagggtctagagctggtgctggtctctgggttgccttgctggtttctcctcacctgtgtctccagtcctcatgttaaattccctctgttttaaatacctcccatggtttatgggttcctggttggatcctgactgatacatttcataattttattaacagacattattattaatgaacacaatgaagagcaaaaatcttgtccgtgggtggctggatagggtatgaagattccaggttataatttggttcagggtagacctgggaaatcagacggtatcagtcactgtagaagcttccagtcttatatactctccagggcatctgcatctggcccttctgcctccactaaaaagtgacctctcattctccattgctgggacttcttctggccctgccctgctcaccctctccctggttggtggttctttttttgagactaggccttgctttctcaccccaggctggagtgtagtgacgtgatcacagctccttgcagcctcgacctcctgggctcaagtgatcttcccacctcagccttccaagtagctgggaccacaggcacaccacaatgcctggctaattttttttttgtatttttatagagataagatctcactatattgccctggctggtctcaaactcccgtgttcaagtcatctgcctgcctcgacctcctaaagggcaagcgggattacaggtgtgagccattgtgcctggcctggtgacttcttttatgaagggggattgggtgggctccatgcaggcaaatgactctctccctcccctgacctctccagccttctccacagcccagccacagtgagggagtcatcagcactggaacccggggtccacggccttggaggatccggaccctccgcatttgaggaacttggccttcagtcagggagccaagaagtccctgccaatcaaggagggggtgtgggctggtggggggggggcagccttggggcacgggagctgatagaccagactcaagagttctactcctgacttctagattgttccacctccatatggaatatgttccttccatctaacactgtgtgatttggggaccatccaactcaaatgaaagaagccaagccatgcagcgagccaccccctccccaatgtggggtaccccctgcccccgcccagctcccctgccctcccagctgaggggggatcgccgcctggtgatctcagcctcccctccaagtgggctgtgaagtgtctaatccaggctttcatctggcatccacaattataatgtcaagattgaataatctgcctttatctcccgggtgacagccatgtagaaacttcaaaagaaacagttttgctggcatctaacggcttttgttaattactatatcccaaagaaaatgaaataaaggagggagaaaaatgatatttctctgtgacaactttgtaaaaatatcagtgatgaagtggtgcggtttaagggctttaagtattcatgcggctgagatggggcctctaccctcccgctgggaagcttaagcgtgcccgagggtgcatgcacacacacactcacacactcacacatgcacacacgcactcggatctgctcccagaccccttcaaacaccatacatgtggttatgggcactcatcttcataaccctctcacaaagtcctgtgctacacacacgcacacacacacacactcatacgagtagagtactccttccttcattggatggttcagaacccttcctatgaccccagttgctgctagggacacaggcttgaaagagggtcctttcagggtagcgggacagcgaggaagacacacaggcagacagtagctcgttttctgttttctcttgtgtcacactgcacaggtgtcatgtgccatgtgggcacctaagaaccatgtgatggagggagcaaaagcacaggctgtgggccgggctgcctggatttgaatcctggggatatcttgctgtagctgtgtgacctcgggcaagtcattcaacttctctgtgctggaatgtcttcacctgtaaaatggggtcaataatcgggtgtcctggacaggaggaggtacaagatgaggtaaatgaagtaacacagttaaagtggtccccaaatgttagctgtcatttagaggtgtgcagagtggctgactctgcctgaggaggagtggcctggcgttaccagaaggcttcatggaagaggcgatatttgagtttgcagccttgaaggttagaggaaaaggagcacatatcccaggcagaaaaaacagctcatgcaaagacttacaggtatggtggtgcattcatgtcccatccgtggtgaacatctggtgtgactggagaacagtgtgaggtatcaggaggagaactggatgggtaaaggctctggaaaggtaggcgggatgtaccttagtggtgacagaccttgggtttcattgagagggtggagtttccctcgaggagctgggggctgctgaagggctgtggtctgttgaggacccccatcagatggggggagccatggagaatcgggggcaggtgggcatggcctggagtgggcctggaaacaggagaccaggctgttctgagaggtcatggggcacccccacactcactcgctgacacacacatacacactcacacgtgttcataaacacccacaggctcacagttccacaccggtacacacatactttcctttcctcttgtttcccaaatggcacttgtaggtggacttttaaattgaaactccatttctctgcagtggctcttgactcctcaattacctggtagtggattggcagagatgtgattaatggaggaaattgccaaaattaacccctggaggccttatgtgctcctctgtgatatgaagggagtgcctccgaggtagaggagcatgggctggcgacagctttggtcctgtggggcaggagacctggcatctggttcgggtctcagtctccctagctgtaaaatgggagaattgaactcgttctccaagagcccatctaatgacattgttctagggtcttcatgagggctaaacaatcacatcagtgtgtgctagaaatgcctcccacagagcagtgagctcatttcaaagcaaaaagcagttttgggataacagtctactgagtgccaggcacagagccaggcactgcaggggattcaaacctgagtaggagaggatatctgtgtcctacttcctcctggcctcagccctcttgttactttggaagtccctggaggacagacactgtctggaagctgatgccaaggtaccctgggcactgagtgagggagaggtggcaccccatttgattggaaggggcagcgtgtatagactgagccaggcctctgggggaaagggaaggtgaacatcccaggcatggggcatagcctgggcccaggaagaagctcaggatgtgtttgggacctgttttgactgcctggagctcagagagtgagacctggagggtcaaggccaggaaggtgtgggtatttggaggccttggtcttattttagacagtaacacaaagtggctccagcagaggcagggaggtaaaggaagcctccacaaagtatcctatgggcaccagggcgggaggagctgttggccttcaggagctgctggtcacacgattggccagcctgggggacccgtcaacctctgcttttcttatcatgccctttttactctttttttctacttgaggctggctggcttgtgaggaaaatggccaccccttctcagcttgccacaacctagactgaggaaccaggtttctctggggagaggatctgatgggttccacgtgggtctaatcggatttgacaaaagaggtggagtactactatgggcagagcatgacaaacccctttgcaggattgtgggggcttggctggctgccactctccctcccttcggctttggaagcttggcagaagattgcatggatgtttgtaggccatggggacccgtggcaggtggggtccgccacattttaaaaaggctgtctgactctagagtcataagtggacacaatacgtagggagggagccagaataaagcaagaatatcccaaccttgtgaggtcacaaacagagtctcttcccttagcgtaaagtggctttccggggagatcctgtcctcaaattctccctttcccatggcaatcagcaagggggttttcctggtatttgtggtcaggtcttgacccatggaagcaggcaggtagagaagactagtgactctctaccctggaaggcaggagactggggcaggaagtttgaggcttggactaagaggtgaccctgttggcacaagaaggacagcagggcaggcaagtggaatcccatcatctttgaccacctgcctgctccaggaagcaggcatttgccctgctgggatcttctgaaagtgtgcaaccttgaatggagccagagaggagaggagtctgtgcactgggaggagtgaatggaattccgctgttttgcaaacattccaaagcagcaggagccttcagtcaaatgagcctcctccccacataaagcagaaagacctggagctgctgcaggtgggaggcctgcaggcccactcaggacagctgcggaggccaggaggggtgccccctgcagttgtgtaaggcacaatcagcccagccacacaggctggccccagcccactccactggttgtcctgcccttgtccccaagccacatcctagaagttcactgaaaactcatcatctggatgaggccaagtgagggtcaccagcttggccaagagcacccctagatatcgatgactaaggggggattccatgcaagacagggctatattgaggtgactgcatttggaagtttggacaaagacactaggctttagcttgcattgcactgatgccctctttggccctggaagcctctgtgttaagaatcttctggggctaccttgtccctctggcccctgtgtcaaagtgtcacctgtgcacatgctggtgtgtgtgtgtgtgtgtgtgttttgagatgcagtctcgctctatcacccaggctggagtgcagtggtgcgatctcgtctcactgcagcctctgcctcccgggtttaagaaattcttctgcctcagcctcatgagtagctgggattacaggtgtgcacgaccatgcccagctaatttttgtgtttttagtagagatggggtttcgacatattggccagggtggtcttgaactcctgacctcaagtgatcctcccacctcagcctctcaaagtgctgggattacaggtgtgagccaccgtgcctggcccacatgcttttgaactgagcacaagtcattcatttggattatgtatttccctttcttcttagatctcattgaaaacccgcactggtgggatttgggttttagcatcacagtaaggggctccctctgccctctctggacccctgggcacatctagtgctgaccaccttctttccagaatgctgatcccagggtttcagggccctcaaagctctgagtgtcccctgtgatgctggcagcatcacccttctgccctagctaagcccccttgtccccagagcccctctgcatggtggtgaggagggagctggggctgttcattcccccccaattaaccctgcctgcctgaggggagcactggccccggaaccaatctcagcctcccttccactagtcattagtctcccccgctgcaggtagagtgacaggcaggctcaggagctcctgaaaaggcctttgttttatcgccttcagttcagatgcttcagagcactagcaggccatattttaatctcaggtctttgcaaacaaaatcgttaaaagcagatggctgtgaagactgccatgaatattaatagatattgaaaaaaaggccccttaatctttccataaatctttctgaggaggtgggggaagacttggagatgagggctgcagtgtagttgcaggtaccctggcccttcctatctgggcttgatcctaataactgaggaattagcacaaagataggtggttccagcccagagttgggcactgagatgggcctggagaagcagtcttgggcttgccatctcctgtcttcctttctccttcccctgcagagctgggctgggtgaggacccggatcctgctcagcaccctcattcatgctgaggccagctgtggatcggccctgttctcttggtgctctatgtaacgatgctgtttgctgtcacccattgtgtgccaatttccacacctgtcagccttgcatcaaccttttgaggtggaattatcatccccatttcacagattaggaaatagactcaggaaatagaaacagctggctccagatcactgggtcagtaagtggaatggaagcgatctggacccagatctgttggccctgaaagcctacgtgttaagagtcttctaggaccgccatgtccctctggcccttgtgcaaaagtatcacctgtgcacctgcttttgcactagacaccattcattcattcatttggattatacatttctctctctcagttgtcttttaaaatgcaaacactcctgggagaggtaacctattaagtggctgagaaatattaaaagctgttcagccgcataatccaggacctgagttgaagtcttagctcagccatttcctggctccatgaccttgaggcagcatttaattccacagagttcgtttcctctggaaaaatgtgggaataatgaaacaaccctatgaggtagacagacggggcaggaatttgaagagatcaaagataggaaagcactttgaaaaccacataccatcatacacctgcagaggaatacggtcttcatcgttgttgaaacacctgattcatttcccatcactttcatggtgatatgagggaataagaaccaggggtggggagaggtgaagcgggcagggggcacagcctggtgggagtggggtggtgggtggcaggaagggacatggctgctctatggagccaagggcattggtcctaagcttttcttttcctggccagtggctttccttgctttatgcttcaaatctaattcagtccatcttcctccttcctccctctccactcctcccttcttctcttcccattcctcccttcctcccttccctcctcattgtctgtctctctctctgacaacaaatgtttttggatcacttgctagtgttccaggggtggggaatcaatagcaaacatgagcagtgtggtccctgcactaaataagtaacaaacaaatagatccagcaggtgcatactggataaacactttgcgagaaacagacaggggacccattttacataggtggaggcctctctgttttcccaagctggttctacaaagctgacttatgttgggatggcaccccatatgaccaaggctggaaagtccttagaggacacaggtgagagccagacagtgagatgaacagaaagagtgagccaagggaagcatcttttggtgtgctgctttcaccaggcaatggcccccaggcccagcctcctggccaggccacacccctcccaaactcctcctctgtctgagtcccatccccataatggcccctcccctggcctggttctgcccacaggcactcttcttatataggataatctggctgacctgatactcctaggagtgggtttaagtgaatcccaaagactgagaagaggagagtgaggtgggggcctaggaggggctcactgcggttctctggctctaagttttcatgcacagggttcacaggaaccagttttgagagaaaactcagaaatggaaaaagtaatccatcacttgagtcccattaaactgttgctattccaaatgcaacctattcttggagcctgagtacaaagaggcagaaacttgtcacgtttcaacaaacatactttattatactgtataatttaaggtatcattttattcaagtgacattcaaacgtgtgaaaaacggttgcatatgccagagccattaatgaaatcattacgtacaaatggttacgctttaccaagtcattcattaaaagtaaattaatgagggggacagcattaagatatttcacaatcattaccaggtccagcctaacccacttttataaatattcatcaacaaaaacgtgcctcaagaactcacccagtaaattaaattctcgtcttgaagtgttttgcttctattaatggcatcaaccgtggtactttctttgatttgttttccggaactttgggatatattgtacggaaataatgacaaactctgagtaatcgctgataattaggccaaatctattattcccatggtatttacattttgattactattttccccccaaaggcaatgtcttgaatctattctaatacaaggcaaaatagtatctgagattttcagggctggaaggaaactcagaaattagctagtccagccttcacctgatgtttgagtcttctgtcaacatctctgccatgcagccctttgctttctacttaaatacctccaatgatagggaacccattatctctgtggcccattccattcttagacacctttgattatcattacctcttgttaactttcatgcacattcttagccccgtgcatctgggtggaatgaaaaattcttcacaaaaatgggaaagttgtcctgtaggtataatcacactctggtcttcccttaattctttggcctccagcctaagcatttccaggatatttgaaacttcctctaaggaactgaactccagcctcttctatttctttctcttttctgcagagtaggccttaccatgaagtccctgcaagatctggtctcgaactttatcttcccatcacccacagtttctctctgtgctttaatcaggtaatcctgaaccatggctggtgaccttacacagactgctcattaacttttagcctttacacaggctttcccctctgtctgaaatgctctttccccctttatctacctggtgaactcctattcatcctgcagaacccctgttcagtggtcaacacctctgtgacaccatccttgattgattcccaacccctccccatgacagactgatcacacctccttcctatactacttctgttctttgtaaatacttagtattttccaagggagtgggagagaagaaatgctaggttcatgaagggtctctaggttaaactttctttcttttttttttcttaaaacaacacacttattatcttacaaatctgtagaacagaagtcctttctttggctcatggccaccttccttcatcttcaaagccagcaacatcgggctgattcctcccagattggacttttgatgttattctctaaagaggagagttagacttgtagcctcagagcaacaacattcaaagagagatgattatccacgcttacattttttgccccatcgccagcccatgttacttgagtgcactctgaaatcacattattttttaaaataatgtagctatcttggaaagagcataatttttattgcattgtattgataaggctaaaagcattaatttgtgaaatgtaaacatttaaaatcatccacgatgtaactttgttttgacctttttttaaatataaaggattgattatgagaagttggctcagcgattgttgacattttaaaaaaccattactaatgaaaacaaaatatgatagtggaagcttctctggtccctaagaagtcgtgctaagtgcccacaccacacggagtgaatttccctgctcgctgtgtgtcctgctttctagtccacatacatcacacagtagttaagagtgcacactctggaattagactgcctgggttcatgtctagctaggggactgagtgactctgggccagttcctgacctctctgtgcctccccttccccatctgtaaaatgggggctaatactgacacctgcctcatcagaggctgagctcactaatgatacatcgtatgtcaagtgcctggtgtgcagctgtgctctaaaagccttccctaacacaattggcctcagcacagcccctggtccagagggtggagtctgcatacatctcctgcaactctgcagatcccatagtctaggcccttcatctagaaaagctgctcctagagatggtgcacactgcccccctctcctgcaggctccacgcatggcctctcctggacactgggagcatccgtgtggatgtctggaagaaaatagggacctattaccagctgacattttcctgcctccttagacaggaaccatcagataagggtacttccattttcctcttgccctcagaaaggcacagaatcggcggggcgggggggtcaagtaagattttcccaccatcagtgtgctatctatggctgcatttagttttatttttcattaagcaacagcctcttaaggagaagatctcttcccttcttgtctagcaaggagctggaaggacagccctgctcttctccaggtgaaatggctggtcccacctctgatcccgagcgacattactgccccagtgctgaggctcctcttgggaggaggtgggtgctgttgtgctggcaaactcggcgttttcctcctttaacgggaaggccttcccaatgggtatcgagtcctcattatcctctcctggaggggtcagttgagaaggcagcataatgctgtattgagaccctttttgggggaacaggggaaggagagattaagggatgtgcccaaggtcacacagctgtgggatgcagaggcagcatttgagggctgctttctgtggagcagatgagaacttcagctgctaggggtgggaggggcgacttgttcagcagagtcaagtgctcctcctgggcatgttgtctgcgcaaagcttagggaaccaggtgtgtctctgtgtgtgctggtgggagctggtgggtgggatgggaaggtggagagatgacttttgcagtctaattggctcattccaaggacagcctgtcaccagaggcaggtgccttgagactcggagagagacgcctcctcactcccccatgccaggtggggtacagacagagacagactcagccacatgaaactgcagagagagataaacacagaaacaacaaacagaaaaaggaacgtgaagactggcccaagacatagggagccacaggggcaactgagagaagagctcaccagcatccaaagagatgcaagtcagagagaaatacccaaggcaaatgaggcctgagagagtggtccagacttagagagacaggtgagaagccagagagatgcaactagagacctcggaaggcagagatgcaggagagatcttaacccatgcacatggaggcgtgaagatagcaagacaaggagagagacagagccagccacacaaaccctcttattcccaggaagagcagccaaggagatgagaaaacagtttgctgaatgaagcccggcagacctcgagagagtcagtcccctaatggtcaatcagcgcatgactcagaaattggggctggtgagtctgtggcggcagagagggtgctggggtgaaggccaagccttccctctgcacctggacgaggtgcccagagcccaacccaagggtgggtagtacagaccttgcacccacctgctcctggccattttactgagcctcagcagtggcgatgatcattgtcaggaaggtcccagccctgatccccatctgccagctccagcttggcttgcagggagcagacagcctgctctgttgtgccggctcctggctgcacagcctgctgtcgctctggcctccccacaactctgcccctcagaagcttctgaggggaaggaggagagggagcgctgcatgtttaggagatatggcatagacaaaccagatacaccagaatggtcacgttactctgcaagcataaattgagctcaggcaacaggcactaggtaagtgtttgcatgaaggtgcaacctgtttaaaaggaaccttaactggtctgggccagttgtaatgagagagcaccttgtaaatgggagagcatagccaggtgagcttggcagctgtcagattaaaaatcagttttgaccaaaataaatctattatggttctagaaatgccccctggaccaggaatgcagaacaggggctgtgtgactttattccccatcatctcttccacacctggcactgaatgggcactgaatccgttgaagactgaatgagttctaacatgtccatccatattaataactaagatttatctagtgcttgctacaggccagacatttggccaagcacgttgcattatatctaatccggcaatgcctctaagggatagggactcttacattacattttacagttaggaaagtgagacccactggggcaaagtgatttttccaagattacaagtgggaaatgatgcggctggtcttggtacctgggttgcctgaatctagatatggcaatcttgcagtgccattgggcagcttttcataaaacattgttctagttggcacagtttttcatacctgttacctgaatggctttgcaaaccagttagctctaagctgcccccatctctgggttggctactgcagcagcctcctccctggtcccctgactccccttccgcccctccaaatgactccccctggcagcagccagggtgacctcagcaggcaagtctcattagagtgtctcagagaaccggtgcttcccattgcttgtggggtaaggacatagttcctgaatgcagcccaccagaccctaccaagcacacggcctcttaaccagcagccatgagctatcagggggctgagaaatcaatgtcatggcttgtgaccttaaagcaaagacatagaatgagctagaatagaaatagaatagaaactctcagagaggtcacatttaatgtggcaagaataactgcttcatcagtctttttgaagtggatgtatgcaggtaattacacatgtatgcacatgtgtgtgttctacgttccgggtcagcaagcaaaatgtgtttcttaccatagggcatcataaaaaatgtgggaattcagtcatataggagctcctgatctaagctcatgcagcccacacccctttcctcttagctcacagccacatggtcagctttaagcccctttcagctttagttaaagacacagggcttttgcctggaatgttgttcctgcctcttcatttagataacttgaccattctttctttctttctttttttcttttctttctttttttttttttttgagaaagagtttcactcttgttgcccaggctggagtgcaatggcacgatctcagctaactgcaacctctgcctaccgggttcaagtgattctcccgcctcagcctccccagtagctgggattacaggcacctgccaccatgcccagctaatttttaaaaaatatttttagtagagacagggtttcatcatgttggccaggctggtctcaaactcctgacttcaggtgatccacctgcttaggcctcaaagtgctgggatcacaggcgtgagccactgcgcccagcctgacctcattctttcaatctcaactcaggcaccgcttcctccatgagccctccctggccctccccaccccgaccctcacccagtatccacccacacagcaccagggacttcccctttatagcgtttctcactgctgcactttgacatgtgctcaagtacttattccactgatggcagaccccccactagtctgtgctccatggggatgtcacctaggggaggacagcctgtcttagagtgcccgatggggtctgggacaggtttatttttgctaaccatcgttccctgtgtctagctagcaccatgtctggaatatagtaggtgttcaacaaatgcatggagattgaatggatctggagaggcagagtactgctgtgatctttatagatgaggaagtggagccccggagagccctagaatgatgcgcttaatgccccagccaggttaatctctagaagcccttctgctcttcactcccaccatggcatttcgcagtccccaaagtctggcttgaggtgtcagtctgagtcctccctcactctccctgccctcctcaccctcttgtccacagctccctcccactgtggcctctgggctccttttccctctccagctggctgacatagggggtggctgggggaggcacaactcagaaagtgacagcgacaatattaggagtgaaaaagatcaattaagcccatcgagctgatttgtgaagctgattaaattaggagcctccctgggggcagaggctctctcaggttgatagacccagctgctggctgctgtagggtccttgccagcccccagggtgcaatgggggccactttgtcctgctctgtccacggagaggggatgaggggaagctccctttagaaagccctggcagggccaagctcagcacccagcccatggtcccctgtgctttcttatagaatcccctgcaatcctggggcactgagtagattggcctgactttaaaataagatcctgggcctcagagagcttaggtggcctatgcggggcaacccagctggtaggcacaggtaagtgctggacctgggactggaaaccaggtccttctgttccctatgtgttctgtcctctccttgccctgtccccatatccggcttcaacatctcggtctattactctatttttccagtctcaaggctcctgtccccactgcccaccccctccccctttgactggctctaatcagattagctctccagtaacccgatccctctgccctggtctcaggattccctttcatggactgtctccagggcagctgtggccagaatattcttccagtacttcagaatccatccgcttctcctggcttctgggtgggggctggggagagggatttggacaaagactctagtgtgtgtaggggcaatgaaccctggggaggttacagaaatgaggtcggcttctccagagtgcacgagctagggaagggagcgccttgaaagccaggctgcagaatttggccatcctcaaacaccacctttaatggcaaaggagggatgggaaaactcctgaagaccaggtagccatggagtgctacatttctggatggaaaggggaccacacaggtgacacttggagtggcaggtgcccgggaaggagtgctgcgtgtgggttggggtggggtttgaggtgggagaacagaggagggcttcactcaggggtgggcttggggctgggtcaggaagaggactgacaagcctggaggggtgagagtatttcaaagatccctgagggtcctttagctcttggccagagatggggctgcagggggagaaactgacccttagacagggcctgatttctctctctctctctccctccctcccttcctttcttttctttttttgagacagaatctcactctgtcacacaggctggagttcagtggcacaatctcgactcactgcagcctccgcctcctgggttcaagtgattctcctgcctcagcctcccgagtagctgggattacaggcatgtgccaccacaattggctaatttttgtatttttagtagtgatggggttttgccatgttggccaggctggtctcgaattcctgatctcaagtgatctgcccacctcggcctcccaaagtgctgggattataggcacaagccactgtttccagcctgatttcttatacctaggtcttctttcttccttagagcaagtctgtgacaaatctataattaatttaaaaaaatacacacaagcaaacacgggctcagagttgtgtagatgtaagtggtagaatcagaactcacacctaagtctacggggccttcggagcctgggaccttccgtggactaactgctaaaacttctgcagtctcgaagtcagggggcagagctagggagccccacaagcctcagagggccagataggctggtggttaggagcacaggttttaaaattagactgagttcactctcctggctctgcagcttgcttgctgtctggccttggccaagttaatttgcctttgtgtagtttactttctttctctataaagtggggatattaatagtacctacctcatggggttgttgtgagggttaaataaatgtactcccatgaagaattccgaacagtgttgtcatttgataaatgtcagccattcttactcaggatggagccaggatataggggcattaggccaggccagggaaggcaaagacctctaagccagtgctccctgctgtcttcacatgtctgtgagtctgagctacctgtgctggtggggcctgggctgtctggctgcccaaagtggctgacacccataagtcattgtccatctccagatttgagtcctacagcctcttcccatctaactggcatggaaactgaggctcagacaggttgccgcagatctgctctttgatttggggcaagttagtcctagagccctacccccaacccagaatctgaatcctggtccggggtctctaaattaccctgcaactggtttaattttttccaggcggacgccatcctcatggcagaaacattttttctgtaatcttatttgcaactgctaatgagaagcagggccgctttctgtttctaaacctcatccacatctctaatttgtttccagaggctggggctgaggcttcttccatctctgtgaaatattagcaattatttctcaattacttctcatggggaagggattcttggagacggaaatctggaagctgggagaagccataaggatgatgttttgatctgacgtgaaccttgccgagaggcacacatgctctgtcatccctgctccaacttgaaggctaggctgggtggcatatgactctgtccccgtctctttcctcactgagcctccggcccagcttggttcccaaacatggagctgctgcaggtctcagaagccacagagaactggggagggaaagggaggagaaaagtcttctttgtagtctcactaaacgcagctctgtcactacagcttataggatcacaggccttagggtcatccttggctctttctctcacaccacaaacccaatctatgagtgaatcctctgggttctaccttcagaatccatccagaatctgactgcctctcaccatctccacggctcccttctagtccaagccagcaacatcatccacctggattattcagtaacaccctgactagtctgcctgctatcaccctttgcacagaagccagggggattgttttggaattccacttttcacgcaactatttgtccttttagctatagtactttgcattttttaaagtggtttttttttcagttctagagattacacatatgtccttaacttttcacagtcagtttagagttaatactttatcactttatgtaaaatataaacctcttacaaatatttgccatccccattgtatgctatagttttcatatgcattacatctatatacattataaaccctataagacaatgttatcatttttgctttagttatctgcatattaaggaaattaagaggaaaattaacttataattttatatatttagcaatattttaccatttctgatgttttttattttttatttttcttgaggatccagtgcctctttgattttattttgcttcattctgaagaacttcttttagtattcttatagtccatgtcttctggtgacacaatccatacattttcttttaaatgaaaatgtattttgccttccttattaactaatattttcactagatttagaaatctgggttacagcttttttttttctttgccctttaaatgatgttacaatgctccttctgtactcgtggggaattgggttcaggacctccccatggatgccaaaatccgtggatgctcaagtcttttatgtaaaatggcatagtatttgcatataacttctgcacattctctcatacactttaaaacatctctagattacttataatacctaatacaatgtaaatgctatgtaaatagttgttgtatcatttaaaaatttttactcttttttatcgttgtattgttatattttatctttgaaaaatattttccatctgaggtcccatgactgtgttctgcttcaggcctccatagtttctggtaagaagtctgtggttatttgaatctttgttcctctttgtaatgtgtctttttttctctggctgctttcaaggttttctttttatcttttattttagcagtttgaatgagtgtatgtaaatttgttttgcaccaatttgcaaagtgggtgttgttgttttttgccactatttatttctttttttctctttctctctctttttttttttttttttttttttttctgagaaggctgctggtcttgaactcccatgctgaagcgtcctctagcctcagcctcttgagcaggtgggtttgtgccaccatgccgttttgccattatttcttaagaaaaaaaattatgctctcttattcctctccttccttctggcactccaattatgcatatattagatctctgacgttatcccacaggcctcttagacactgttcactcttttatacccccccttcccctgccctctttttttttttttttaggctaaatggcttttgttgatcaacttaagctcacagctatttatttatttatttatttgtttatttttgagatggagtcttgctctgtcacccaggctggagtgcagtggcatgatctcagctccctgcctcctggggtcaaggcctcctgccccagcctcccgagtagctgggattatagctgtgcgccaccatgtccaggtaattttttgtatttttagtagagacagggtttcaccctgttggccaggctggtctcaaactcctgacctcagtgatctgcctgcctcggccacctgaagtgatgggattaaaggcgtgagccatcatgcccggccatcttcattctgttttaggcctatacagtaattgtttaaaatattccaggtattgtattttttagtactggaatttccacttggttctttctatatttttatttctctttagaggtttcctatctcttcatttattatgaatgtattttcttttgccttgtttagcacagttataataactgtggtacttgtctgatagcttcaaattctgggtcatctgagagttgatctccattgactatctttacccttgaggatggattatattttcctaatttcttgtgtgttgattttgggttttatcctggacactggaaatgctatgttgtagagattctggagtttgtcatagtcctccaaagagtgctgacgtctttgtattagcaggcatttcacctggttagactcaaactactaactgttttgcctttagtgggctgcacctcaaatcacagctcagttctttaagccttagttgcaagttgtcttgaatcttctctatgcatgtgtgattcagaagtgagccagatacttgatcagagtttactaacagaatttgggccttttctggcactttcctttccagaaaatcccccttcctttccaggggctctggttgctctaggttctgtcctctggttcttcaggccatataaacagcattttctactggacttttagcagccctgaacaaggccacagctgcagcctgccctctgggtaaagtcatcaaagtggaaaacttaccacatactggtcccttcttacaagtttcaacatccttccaaaatctgcctgcttttggtcattctggtcttttgatcattttgattatttcagagccctccagcaattgttttctgtattatatccagaatttatagatattatttgtggaagggtatacctgttaggagatcactccactccactggaagaggaacttccagagtgtcctttttaaaacttctcagactgtgccattcctcccctcaactctccccactctcgatggctcccattttactcaaaagcccaaatgctcacaatggcctatgaagctgagaataatctagcttcagactgtgtctgacctgtgcccttttacctcacctttgctcattggtggcctctttgttgttcctcaaacatacctgcctgatacactcttacaagacagctccatggccggcaaggccctgccccctccagccccatctttagccatttgccccgactcttgacactccatccccactggtctgtggtcagcctcggctcaggccatgtccttttccaccgtagggccacttcttctgcctgcagcaacctttcctagacttttcttctgtatattattcctactaatccttccctctcgtagaaatgactgcttctggccaggcgcgatggctcacacctgtaatcccagcactttgggaggctgaggtgggtggatcacctgaggtcaggagtttgagaccagcctggccaacatggtgaaaccccatctctactaaaaatacaaaaattagctgggcgtggtggcgctgcctgtaatcccagctactcaggatactgaggcaggagaatcacttaaacctgggaggcagaggttgcagtgagccgagatcgtgccattgcactccagcctctgggtgacacatcgagtctcccactacaagaggtgattggtactctcagggtatgtaacacttcttcataccatatcacacacttaacaatcatttatttactggaaatgctttgtttgctcattaattttgagtgctgtgagggcaggcattccatttgttttcctcctttctgcaccccaggcacccagcacatactaggcacccagtagatacctggcatctgactgtcagggcccagcatggaagccgaggcaggtcagtgaggaacctttaagaagtccttgctgtgtacacagccttacaatgtatgtgggtagctatttcacctccttgttacttttagagaaatggaggctctgagaggagaaatggcttacccaacgtcatgcgactagaaattccagcttgaagcctcatggcaggagagctcagaccagcagagagacctcagattgctcccagccttggcctgcctgtcacacttcctctttgccctggcagctgcagggttgttgactgcacagagtttttcttcccttttcctttctttctctctctctctttccctccctccctccttcctctctgtgtctgtctctggtgtctgagttagttccttatggtgagttcttggtctccctgacttcgagaatgaagccgtggaccttcgcggtgagtattacagctcttagaggtggcacagacccaaagagtgagcagcaacaagatttattgttaagagtgaaacaacagagtttccacagcctggaaggggacccaaggaacttgccactgctggctggggtggtcagtttttatttccttatttgtccccgcccacatcctgctgattggtccattttccagagtgctgattggtccattttacggagtgctgattggtccattttacggagtgctgattggtccatttacaatcctctagctagacacagagggctgattggtacgttttacaatcctagctacagagtgctgattggtgcatttataatcctttagctagacacagagcactgattggtgcatttacaatcctctagctacccagaaaattttgccaagtccccacttgacccaggaagtccagctggcctcacccttcactttctgtttccccaggattcacaactgggctcctcttgctgtgttggagggagatgtttcacctgagcaccatgtttcacatggcagtggggcaaggcactgaggctgtgtggcatggcaccacagggtggccactggtccctgagtcggcagacctggctctcttttccctgccatgctgacttcatgtttatggctaagaagcctctcccagggagcagctgagcttcaggggcattcctggagcgtccaggagagcaatatggccctttgctggtggagaacctgagaccctcaaggagaaagtgaagaaaattctctctgcatacagaccccttcccattttcccattctgggttgactatcctccctcatagatgtgctcatgagtcttggaaattctcttgactcattgccatttaaaatatctgtgttgcttctgatgatagatggttgatttataaaatggtttggctctctttatgatagaatattatacaggcatcaaaaacaataatgtaggagacaaggatatgaggagatgttcaagctgtattctgtgaaaagaaaaaaagattgcagaatacagcatatgttcccattttttttttttttttttttttacaaaaatgtggacctaggtacataatgtgtgctatgcataggaaaaagcctggagaacttgcacgaaatggtcacactgtttttcagtgatggtaagataaagggtaattttaaaaattcctattcttttccagattgtttctaacactgcgcatgcctttcggagacaaattttaaaaataaacattatttttaaaaggaaacaaacaaacaaaaccaaacagaagggaggctgggtttcttggggatttcgggagtgcctgtgtctccacgacctgggcagtgctcttctgagaggactgagggctggggaggcagagagagcaacgacaggctaccagcattgagaaagaaggcctcaaggccacattgagaaggacactacgctctggatcacaggctgagccctgcattcttgacattggagcccttcgggagtgccagaacgagcagtccctctcctggaggagcctgccttcccaccacggaggctaacaccacaacagccacagtgagccaccccttctgcccatcttcttacgtgtcaagcactgtgttcagtgccttcacaggtaacttcgataagtcacgatgggcatgctgcgactaagttggtactgatattctattggttttaaatggggaaactgaggctcaggaaggttcagtattttgctggaggtcacacagccaggcaagggcagagccaagatttcagtttcaatctgtctggcttggaagacttccttatcttgtggcagcatctccagagatcatgggtcagcctcttcttgccagaggcgtgtgtgtgtgcacagacacatacacgctgagtgacagagggacaaaaacagtgagcacccacccaggcactgtgctcgaaattcttcctgcaaacctgcaaggtaggttctaatgatgttcccatttacccctaagcttgcgcggtggcacgatttaccaagcatcaccggctgcccagggtgacctaggattccagctcaggtttctctgacactgatgttgaccctagtgtgcttccgtgtgatcttgcttctctggctactggtgttctgcgggtcttggacaggtgaggcaaactagggccaaatactgccctctgcctgcctttgcatggtccctgagctgagaatgatttctacatttttaaagggttgtaaaaacaaaactcaaagattatgtggcagaaatatacatggctgggcaaagcctaacatatttacttcctggccttttagagaaaaagttgacgactcctagcttagggtcctgaggtccaaggaggaactcctggtcctgcacatcttcatcctccacatttggtggtcccaatgctgcatgcgagctgtggctgtggactcaaagcactgtggtgggggacattttaaaaatgagctgtaaaaatctgccacacttagggcactcattttcccacttatattttggggggatatctgtacccagggaaaagctcagtgatccttgttggatttctagggtgaagggcttttatctcagcatggggtcaagtgcagctatgtgtgggtggcaatgaacttcaacatctagcgtgattcccctgcaaattggaaggcaccagtgccaccccaggcaccagccttgagtgtcaggcatagtgccaggtgcacaagaagaaagcaaggtccctgcggatctcatacagcccagtctggggaagcaggggagcccctcttgggtatccgagttggaagaagaggctatgagaatgggaggaggggcagggaggacagccaggaaatgcaggcggtgacacctgcgctgtgccctgagagatgaggcgttacgcggacttgggggaagggacgtggggaagttggtgctggccaggcgcggcggcgggaaaggccctgggcaaaggggcccagaggggcggcggaaagtggagcggggctgtaggtgtcagcagagacgcggctttggggccggcacggcccgcccctcggcccgcgcggccattgtctgcgccaggcgccgccttggcagcagaaggtgacatctggtgactaatggccgcggctgcgcgccgcgctcctccctcccgcagcgcccggggcgcagctgccgcgccgcctcctccccactcttctcccctccccttccctccgctctgtgggccagcgcgggggcgcggggcgggcaggatcgatgccctggtttccgaagggcagaggccgcccgacctccagccggccgggccgccccgccccgccccaccatcgcgcatgcgcgtcctccagagcgctcccttggcagccagcccgcgaggacgcggctccccgccaggggcagtgcagggaacagtcatgcctccctgcccccggacggcctcactagcggctgcaaacaccggcccataccggagcctatatgcatgtgcattaactcgcaggtgcacgaacccacggtcacacgtgctgtcatgcattgtacacctgtgcttgttcatgcgtgttcacagacgcatacgtgggggccgtgctcgcccacagacttacctccaaaatgtctttgagtgtgttcacataggtacacgcatcacgtgtggactcgcgcagccatgcactgcttacacactcaaatataggaacacccatgggcatgtctatatatacactcacaggcacagcaagtgatgcccttgttcttgccaaaggttgagggagggacaaagcgcctaatttagatctgagacaggatctagtgtggactaggtacccctcttccccagtgtttacactacttataaattagttgcgtttgagaaactacataaaaaacctggagatttcacctatagatctggatttctggcttcttttgcaaaatcagaagctcgggaaaattaaggcatactcccagcttatcacaatgcgctggggctgagctgcagggtatccctcagtctgtgattaaagttcccctacctccacccaaaggccccctccccatgctggttccttcttccctagccaggatttcccacgtggagcctcagccctagccctgactttggagctgggctaactagctttagccctgatgtccacagcaaggagatcctctccactgtatgatgttgggggggggggtgctgccagccataaggaatccctctgcagtctgcaaagtaccctcttcacgcaaggacgtggttcaccacagcagaaccacgtgtggttctgctgacagctccgagagcagagcgctagtgcttccatcttatagttgagaagatggcggcttgggagtaatgatattaccacctagttggaaagtgcagatggggttgcaatcactgtagctgaagtgtgggagggggagcagggttcctctactttaaggtgcccctgaagctggctcctgcctggctctggcacatctgtctcccctctctgatattgttcctctcagcctctggcctggtggggacgcctggttcactgagggagaggccagttcctgaagcttctgggtgtctgcatgatgtcaggctctggctaaactagcgagtggcagcccaagaggcagtggggagctatgtggatgttagtgtcacccactgcccaccagtcctggtgccccttactcctgcatcatctcatccactcaagggctctggctacctctgagggctgacaccctgcccagtggctcacctgagcgcctgtctcacttattcttctccactggaaatctggcatgtccttgactctcagcatgtccaaagccagtctgtgaagtggggtgacctcaggtggggtgtccaaagtgggtatagcctgagctcagatcccagctctccttctccctccctgtgtgaccctggacaagtaattgccctctgtgccttcagtgtcctcctctgcaaactgagaaccataatagtacctgctttgaggattgcccagtgaggattaattgaggaaatttacacaaagcaatctgtgtggtgcccaacacagatccggtgctcagtcaataccagtgctttttaactttagctggttcttccttccgctgctcccaccttggttggtttgtactttcaccaacccaggacaggatgctgagaattactcctgctcctctctttgcatcttccacacattcagtcctgtcaatttgacctccccaatatctctggagtctgcgctctcctctcacccagggtgcctctgctctggtttggtttggtgtcacctctggtctgcacacttgtgtcccctagccaggttcccaggctgcaggctcctcgaacttaaatccagtttcattgctgcctttgaaatgcacatggtgtcactccactcttaaggtgcacatccaagcttcatgacctggcattcactgtgggtggctgaaaggatagccatgggtctagggtgaaattttaggaagtaaagctggatgtgtgctttttctctcaccgtcctgtgtctgccagacctcacatttagcagccagtggacccttcactcccacctatcatacacattttctcccctccatgcctttgcccaagctgtactctctgcctggaaatccccttccccacaattccaactctgctttctgtcttgagctcacctatccagaccctccagcctccctttatattcagttgttacctctctctcatgatctgcttagagcaccctgcatatattgccttgattttgcacttaacctcatttgtcatatttctctgtttacataccacccagaccaatgcttctcaagctttatcaggcacatgaaccacttggggctcttttccaaatgcagattcagctggtctgggctggtgtctctgtatttttaacaagctccctggtgatgctaatggtgctggttcaggactatattttaaataacaaatacttggatagtgagtccctagagggcaatgacttgtgttcagttcatcttggtatccctggtacctagctaacagcttgacaaatggaaaatcaattaaatgcctactgaagtaaacgaatgaatgaatgaatgaacgaaaggcatctcatccagatgagagtgttggaaagtcttttggagttgttgacacctgagttgcattgttagggaggtataggagggagccaggtagagaaggcagtggcgggttgagatactccaggtgaaggtcagtgctaaggcatagggatgtacagaagtgcaggtgcaggatagtgtaggaatggaagacttgaagttcaaggtgttggggaaagagaccaggtcgccaatagccagccctggattccgtgctagcttgtttgatcctagagcctttggagaatggcataattccaaccgtgggccactcctgcagcaagctaggaagaaattccagggaggagatgtaagactgggtagtcacctaggggacttctcagtcaatggtgtggagatcagcccatggcggtgaggatggagtcagggaacagattaaagagaaactgaggaggaagtatagacagaacttgatgagtgagtggaaaagagggtgaaggaaggcctcccccttttactgggaggcacctgggtgagtggtggcactgtagaccgagactggagttcaggaggaggaggagctggtctaatgggaaggctgagaagtttaatttcaaagctggcaggatgttaagagcctgtgggacgtccagagcataggcaccaggagctcctgagagagtccagggctggagatgacagtatggaggcatcggctgacagatgctcactgaagttttgggaaagaatgagatcatccgggaaaatcttagaaataagaagagaagaagggagaggggggactctggagggaaaccattcatttaaagagcaagaattaatgacaacctgttagaagataaaatgggaatagaacacatttataacagcaacaaaaaagataaaaaacctgggaatcaacataacaagaaatgtgcaaaatctaactggagaaagcattaaaatgcttccaagggacaaaaaaacatttgaataatgctcttggatggaaaactaacatcataaaattgtctattctccctcagataatttagaatttaataaggttttcaataaaaatgaagcctttgttgttgttgtttagacaaactgattataacactcatatggaaaaataaataagtgttgagaggcctctgcacgagcagaagtaatgactacctctgttccagactatctttgtaaagacagactagtgaacatgtttggaagatagagatagtgttttcctctggagcaaagagcaatttgtttactgtccagtataacaaagataatgtccccttctagggcaaaaatcaggcaagcttactgcccattgtaaaagatttaggctctctaaactgaaagtttttctcctgtaacacaactcactgcttgtgcaggtatcacctgtcatactgtggcacttggggcttgtgtaaccatcacaaatgctgacactctggctactgctattgccacgaataataaagtcctttgtctctgactcagaagtcttgtgtcttctgccagcacagaaacaggacaggctaacttgctggtttgcaggcagagtaaaaaccctcttagacccttcacagttcttgacaagaagaataactagcaaatatctgaaagcagaatagtaaggagtaggggctaccttgccctgtcgggtattaaaccatactataaaactatattatataaaacaatgtagtactagacaacacagcagaacaaaatcaaattccagaaattacacatatgcattattcaataaatggagttgaagcaactggagaaccatctagaaaaaagtgttggatccatatctcatactttatactagaataaactccatatgaaacaaaaatgtaactgtaacaaaatgataatataataaatgtaccagaaatgtgagaattttaaaactcttagaatggaagaactttctaagtatgacacatgacccagaagccataaaagaaaagactgataattttaactttttttttttttttttttttgagatggagtctctttctgtcgcccaggctcaagtgcagtggcgcgatctcggctcactgcaagctccgcctcccggattcacgccattctcctgcttcagcctcccaagtagctgggactacaggcgcctgccacaacgcccggctaattttttgtatttttagtagagatggggtttcaccgtgttagccaggattgtctcgatctccttaccttgtgatctgcctgcctcagcctcccaaagtgctgggattacaggtgtgagccaccgcacctggccaattttaacttttaaaacgaaacttctgcgtagcaaaaccccaacatacacaaagctaaaagactttgaaaagatttgtaacttatattactgacaaaaagcatatttcctcataacataaaaagtgtccacaaatcactataaaacagatcaataacccaaaagatagatggacaagatataaacagttatcaaaacctaggagaatatgccactttactcataataagagaaatacaattaaaatttcactgagacatcattttcatctctcagtttgcttaagatcaaaacagtggataacacactgtgtggatgggaaaacagacactcattgctgattgaagtgaaaatttgggggtacaactcaatggggggatatctggaatatctacggatgttacaaatgcttctgaccccacaattccacttgtaagaatatatgctatggagagattcccatacatgaaaaatgatgcatgtaagatgagttgttacattgtttgtaatggcaaacactgaaagcagcccaaataggcatcaaaagagagatgttaagacaaatcaggtgcatgcatatatgagtattcctgtgatgtacagatatggaaagattttcaagataggttgttgtgaagaaagcaagacatacttcagtgtgcatagaatactgccattcttgtgaaaaagtaaaggggtgtgtgtggaagaatttgtagacatatgtgtgcatacatgcacacttctacttaatatgtctgtggaggaatatataagaaactgataatgttggttgtctctggggagaggaacctcaccattgggaggcagggatgagaagggaaacttcttgttacacacatttttatacctttggaaatcgagaatacactacctctatagggcttccccacaaaaataacaaagagagtgagcagaagatagggagcccatgacagagactaagcctgtgcaggtggagtctcagagagaaagcggaagagagctgcactggaggagcccaccaaggaaaacatctcaagaaggaggtaggatcctggcctgaatgctgcaaagacattaagaatttagatgaggatttggagacgtgcagtcgatgtgttcatcgggtccatggtgacctcggtgagagtgcgttcaattcaattgagtatgtgactgtgtaagcccgaatgcaatgtttaggagagaacgaaatgtgcagaattggatatggtaaacactttcagaaagcttggtcatgaaaggaagatgagaaggtggaagctgatgggagacagggcagcttgtgggtgtctctttcttctcctcctcctcctctttttcctacttctactccctctcttccttcttctcctcctctgcctcctctttcttctccttttcctccttctctttctccttctcctcttctcttgctcctttccttctgatttttcccttcttttctttttcctcctccttttcctcctttcccctctcctccttctttgtccccatcttctttcccttcctcgcctcctcctcattataattattattatttaaaagaggcaggccgggggcggtggctcacgcctgtaatcccagcaggccgaggcgggtagatcacaaggtcaggagttcaagaccaggctggccaatatggtgaaaccccatctctactaaaaaaaatacaaaaattagctgggagtggtggtggatgcctgtagtcccagctactcaggaggctgaggcaggagaatcgcttgaacccaggaggcggaggttgtagtgagctgagatcaggccactgcactccagcctgggagacagagcaagactctgtctcaaaaaaaaaaaaaaaaaaaaggaggcaaagtgtgcatgtttggctagtgatagcaagctagtaaagaagaatccctgcaagttacaggagtcagaggggactgtctggttatctgttgctgtgtaacgaatcacctcaaaacttagaagcataaaactgccactgttttattatgcttgcaattctttgtgtctggaattctgacagggcacagcagggacactttgtctctgctctacaatgtacaggcctccgttgggatgcctttgacacagagggtggctggcactgtgtgagagcctccacttttctctgcatgtaagatggcttcttcatgtctggcacctgggctgggatggctggaacagctggggtctggccagcatcactcattttccatgtgagttctctacatggctggctcaagcttcttgacagcatactgagggtccctgggtcccaggaccccaagtgcaaagtccaaggttcttatgacctagtcttggaagtcatgcagagttacttctattgcattctcttagttacatatggccaggccaaagtcagtgtggtgggggctatataaggatctgaataccaggaggcatggttcattggcagcagggggcatctttgaatcctggctaccatagggatcatcaagaaagtgagctttttggccgggcatggtggctcacgcctgtaatcccagcactttgggaggccgaggcgggcagatcaggaggtcaggagatccaaaccatcctggctaacatggtgaaaccccgcctctactaaaaaatacaaaaaattagccgggcttggtggcgggtgcctgtagtcccagctactcaggaggctgaggcaggagaatggcatgaacctgggaggcggagcttgcagtgagccgagatcatgccactgcactccagcctgggcgacagagcaagactctgtctcaaaacaaaaacaaaaacaaaaacaaaaacaaaaacaaaaacaaaaacatgtgtctagaagtgcttgattgcctaagaagtatgtttctggaagcgccatgaagtgtcctaactgatgattcctggaattccactgttagtaccacaaatctgtgtcaactcaaactcattagagcatcaatgattcaccatcaaagtcaagaggtggccagctagagcttttccaatgaaaggggtgccccctcctgcccaaagctattctcatctcaatgctctggatcctaatcctgttggatttctcccttccttccttcctttcttcctcccttcctccctccctccctctgtccctcccttccttcctctctctcttttctttctttcttttttttctttctttcttcctttctttctctcttctttctctctctctttctttctctttctttctttcctttctttatttctctttgtttcttccttcctttcttctttctctctcgctctttctctctttctttctttctctttccttccttccttccttccttcctttctttctttctttctttctttctttctttctttctttcttttctttctttctttccctcttctttctttctttctttctttctttctttctttctttctttctttctttctttctttctttctttctttcaaataaatcacccattctgtggtattctgttaagtggccaagcagcatggctcaggcagtcaggacagattgaaagaggagggttggagaaatctagcacaattctattttcctagatgaacttctgagaagtcaccttggcagcatccaacccagctcaacttgcattcgaagtaggctgtgccggcctccagaacaaacttcagctatctgattacctggagaggggatgctctgatggccagagcttctggctttccatcagacccacacagaatgttcactggttgtgggagggcagaatccctgccctcaaatctctcatccatctaaagaacatgcttggagggaaattaagcagaagtagggcatttgcgtgtgtatgcgtcagagttgaggtgagttggcgggtgggggagaggaacaagtgaccccctcccttaacttcccggagggaggggaactattggcaatggccagaaacaggatagaattgtccaaaggacatgacctcagctacaggaatctgaaaacacaagtcacagttcttatgtaaaaatggcaaatttcttaccaggaaggaaaattaaaaacaaaaaagagctatgagcactttagcatgcttttctggggatgacccctctgtggtgggtctcagatgaagcctgccatgaccatatctgacaggctggtgcctccctagacacttccctcgccttctatcctgagtgtaatcccagcgcgctccagaggtttggcctttctgagaagtgagggcatgactcagtcaaggttctattgttgtaagtaatggaaactgacttgagttaacttcagcagggaaggaaattcactggaaagaatctggtttatctcacacaagacaagggctgctgggcctcctgaggcatgggacccaggagtcaacatttgccaaagtgtgttccatggtttgctactcctagcagatgcctgagaaaataaaacgctctgtgatccaatgagttcgggaaatgctacttatcttttttctcttaatatgcacgctggcatattaaaggctctgataagtcttgcagcaagaaagctcatttaagtagacaagcacttccctaaaatatttgtggaataaggtatacttgttgagaaggtgattaaagaggaagagtttcccaccctggctctcaccctgttgtgatggggagctgactttactgtgaagaatatatactagacaggctatatgtctaatggttaggggcatggaccacctgcttttgaatcctgatttcaccacatgctagctgaatgatctaggcaacttatttagtatctctaggtctcaatttactatctataaatcagaggaataataataatatctcttgaggttgtagtaaggattaaatgagctaatcaaactgtttggttcacagtaagtacgaaagtattgagctattattacggattgaatacacacactctttgctatgaaattcacagcactgggggtagctcctgtttaacaatcacttgttggtgtctactcctaatggactggggacacagagatgagtctggtggtatgtcccagccttcatggggctcccaattctgtggggtagaacaagcatattagagattattacaaagagggatggtaagaacagagtactatgacagcccacaggaggagcacctagcccagactgaggggcaggggcgatagcggcatgggaagggtgttgcaggctaacggcatgaaggtgccagccagctttgggcatcccaggcagtctggtgtggccagggaatgaggtgagaagtgatggtgttgaagatgttggtagagactgtcacagggaaggccttgaacaccagaccaaagagttggggtgttattctatgggggctagggagctagcagaatatttctgtcaagtgagtgtcatgacaagtgtgcatttaggaagctccctctggaagtgataggactcactggttggagaaaccaagcctggaagccaagagattagggagagctggttacagaaatcaaactgggagatggggaaagacttggcttgggtgacttgatgctgctgctaattgaattgatgattggtactgatttagatgaaagtcctgagcttgaatcatgttgacttggaggaccctgtgggcaatacaagtctcaatattcaacaggcagttgaatatgtgggcctgaagagatagatctgggagccgagggtatttcaatggtaattgagttcataagagtggatgggattgttcggagagggtcaagatcaaggcaaccctgggtagcttgacccttcaggggagcagggaagcaaattctgctaaagaggttctgcagacacctagcagtccatatttcttacagattcaaattctcagaggaactggtttctctcctcaagagaaacctcccctctcctcaaatcctgtctgtctgtcttgaacccaggctattatgattaggccctagtatgacataatggcttcagggccaagagaggatatccaaggggccctgctcttcactgttaccttgtcattgctacactttgccacaccctgtaccagtttccatctctacaacagggagaactggattttgtcagctgcttcctcccaaaagttgttactacagacacaagaaggatggagtcagcagagtgacagctgaggaagtgatgcaggttgtcctcatttctggggacttatccaaacccttctgcacctttgggtacctgcacccgcagccactacttggttgcggtgagtgctagactagcctgatgagagaggaagcaaggagattttaatgcatagggtttagtgaacacatccaggcactctgttccttccttctactgttcaacctgtagaataacaggcacacaggtgaaattgtcttaccttcataggggttcacgagggttggagctgacaaaccagtttaaatgataatcaattgagctaataatgcccatgtctttccaaagggagaactagtaccaatcgggagtagtagagggagttacaggggaatagaaagtccctcttgatgctaagcatctttagaagtgatgcctggaacagaataggctcttgggcctggattattgggtgacaactcaatgcttccacactctcctctctgcacaaagggctagaagcctgagaactacatttccaggaatctatgaaacataggttccaggttagaatctttccatgagaagcagatgcatgagattcagaagtcagaaaagaagacgaagccatatgggaggtggctcctgccagccctggagttactcaccttcagctgtggtgagtagagtggtgggctttggcagatggcagattttaaaacaacctcaaaattttcctgaagcaacagtgttgggggcatctgtgatccttgcaggagctgctgcagatcctgcaacttttttactttctgaaaatttatagagaacctttattatataaatatccaatgaccttcctttttccagctattccaaaatttctgttaagtgctgtataacatttgctgtataccaaatcacccaaaacctagttgcttaaagcaacaattatatatttagttcacaatgctgtggatcagaatttgtgctaggcacagctgagtggttcttctggtcttggttggactcactaatgcattttacaagaacaggccgaattcaaatttatatcacatggatacagggaagagaatcatcagggccaattttacagtctaccacagcatctatttcttgtattaaataaccttcctgcttcaaagacccagagagtttttatttccctgagcaaaccttgaagatgtaacatcactctgtatttctggtcttggttgggctcactaatgcacaaaggctcactaaagaggcaggtattgagacttggattaagtagtgggctgagggttaaggatttgggtttaagtcctggactgtgccacttcttgcaagtcaaccttgggccagtttcttcagagtcttgaacccttctctctcaaatggacatggttaaacttatgtgcagccatcaagtaaaacaatggttgtaaagtaagtttgaatagattaatgatcatatcctacatttgaataacaccacgctgtgaaaccttcccacctggggactgctggatcaggggccagagggcaggggctgctctggtgggatagaagtcagaaagatgttggtcacttgcttttctcccctcttggattccttggtgtattttggggcttagaagtaaagaatgaatggccagccaaatcttccatttgcagcctctgtgttggaattaagccagagtttggaaaagccctagaactgctggagccaggacaaactccagggctggcaggagccacctcccatccactgctcccatctgccctcttggctgctggtgcagtgaggccctgcttgtcctggcccatcctctccccaggcctcatgtgctcagctgcttgaaagaccactcctcagctccttattagtcccaactcaagctggacatgattcacagggataatgagctcgtaaataaattcctgctgcatcagctcatggagctgaaggttaggctagggatgtgggccagggcaggcagagggaaccaggcccagagattcaaatgtcccctgtgttttctccaggggatatataaggagggtgatgaaaacttaagagatcctgtgaatccatcactggaatgttgcacagtggcctggttatgctctcagtgcagagatcctggatccataatcccatactctactctgctttcagaatccagttctgctagagatagattttttggaggccaatggccagtggctgtgtgttcagcagagcagaaccagggcagcaagctctgtgaagagctgagctggctgctgaggaataggggatgtgttcacatttgttggggtttaccagtagagagaggtcacagggaaataataaaaaaaaaagttcagcacaatcccaaaataaaatgagaggtcctagaaagacatgcacttcctattagtggaaatgtgcaagaagaggcaggaaactccttataagcatcaatgtgggagagtgtgagacagtagctgagggttgatgaaatgccttttgaggcccctttaagctccctgtgtctacaagctgtgtggaaggcaatctgccttggtgtttggctatgcctgcttctgcttaaaacctaccagtggcttttcatcacacttagaataaaatcacgaaggctgggcgtggtggctcatgcctgtaatcccagcactttgggaggccgaggcaggcagatcacaaggtcaggagttcaagaccagcctggccaacatagtgaaaccctgtctctactaaaaatacaaaaaattagccgggcgtggtggcggccacctgtaattccagctactcaggaggctgaggcaggagaattacttgaaccctggaggtgcaggttgcagtgagcggagattgcaccactacactccagcctgggcgacagtgcaatactctgtctcaaaaaaaataaaaaaaaaataaaatcaagaaaaattttcccaagtcagtagtcacttctgtattatttcagactattctccccattgttcactgtgctcaatgccacctacctttttctcacccttaaacttggcctctagttgggatagactgggctgtgctgcagtaacataacaaaccctggaatctcagtggatcagctccttatgtgtttgattcttctttatggactattcatatgggctggcaggtctgttctctgcctagtgactcaggaatccaggttccctccattttatgatgctgctgccccaaagcgtggcatccaatgtggccctggtgggaaatttatttggcccagcattgacacttgtcgcttatgctcacagtctgttggctagaactagtcacacagcccaagcacaaatgtaggggaggctgggcattggaggggagcacatggatattgggtgggcactcatggtctgggcatgtatctgtcagggttccaaattgcaagcaatggagagtgacttcaggtgtttcaagcagaaaataaatttactaaaacaatattatggagtttactgaatctcctaaaaagccagaaaactaagattaaaggtgatgtagctagaaatagcatccccaatcatgctgtagagcagctctgagatgttgctcctgggcgcagacaccatggccatccctgccaacagtgctggcactgaacatgaagtctgccacatagccatagccatagctgccccagagactggatatggttactgcattaaggacacccttgtcagcctgcagcctgtacagccccagctcctttgtgtcactcacttctgactcaaggtctaggatcagcatgtctgattgaggagcctaaatgagccatgtgctagctgcaaggcaggctgactgtattagtctgttctcagactgctaataaagacatacccaagactgggtaattataaaagaaaaagaggttccttttctttttagaagaacactggactcatagtctcacgtggctggggaggcctcacaatcatggaaggcaaagaaagagcaaagatacatcttagatggcagctggcaagagagcttgtgcaggggagctcccatttataaaaccatcagatcccatgagacttattaactatcacgagaacagcatgggaaagacctgcccccatgattcaattacctccccacgggtccctcccatgatacaaggggattatgggagctacaattcaagatgagatttgggtggggacacagccaaaccatatcactgacaaaacaaatatctggcattttacctcctatggaaggccctggttttcaaggggagcctcaactgagagtgatgaatattcactgcattatctcagggcctttgcacttgctgcctcctctgtctacaggtatttccccagatgttctcaaagctggctctttctctgctcaaacgccagctctgacaagcaaatctaatgcagtccccgtgaggcaatcacatccacctgacttgttttcttcgcagcacctgtccctaccttgtccattcatttgtttactgatttaatttctgtctacctgtaagaggtaacaagcacaggccatcgtaggagacaggttcaaaccccagccctgccatttactagctgtgtgaccttggacagcttacttatttgcctttgcggcgcctgcagtttccacatccagcggtggtgtgtgcacgtgtctcggggagcaggttcgggctgactcaacatctgccctgtgctggccactgtgctaggcctctgcttctgtaatctcattaatccccagcacatcattgtgaaatgccccttatttgtgtcctggtttccctcaggctgtgagaggtaatgtacaggctcaagtccacaccacgggaagcagtgcaaagcctgtgtacttcctgcagtcatcacacagcaacccccttcagactccaggcctctgtgtttgggggtgtaagggactgtttctctagttggtgagattataaaataacctccacggagtattcctgttgtagtgggctgagaatcccttcctaacctctaacctttgtctctggctgtaattttatcccagagagaaggggtgtggcacatgggcctagggccgagtgtgagcccaggtgatagaagaaggcagttacaccccaaaggctcactctacccttggagcagtcagatctggggcaggcatttaagaattcaggcacaaaggagaggccaagggcccacaacagggaggcagacatccctggcttccaggaacacatggagcgagacacagtccctcctcctgtatccttgttccttggctgagcacatggaagagggggtgtctccaggcccaaagaggaagcctgaaggttgtgtggaggtggccacctgggagtcaggtggagggctcttttctttgactatgtagatcttatgtactttccttgatgacaggctggatttgaccttctggtcatagttgggggacttttactctagatcatctctaaggactattccagctttgacctcccacctgggtacggaaagagactgaggctctgacaggtgaagtaggtttgccccggtttgcaaatgtggctggaagggaggtggggacaggctttattcatttctgatctcttagggatctctgagagcctggcacagagcaggtgctcagagagcctttggtgaatgaatgaatgaatgggtcctgaacttgggtaacaagaatatggcagggattatgtatttttgttgatgggtgttgtgaacctgtaaggacaggaaggaaggagtgctgaggctgacagtgagagaagatagagggagtttccggcactctggggccgttcactgcagtatcacagcaaacagcaatcatgtgccctggacgggcattcctttgttaccgagaggcacaggaaagaatggtaacacagtggctggtcatcagaaagagatgcaaggatgctgagcgtataaagctgcaggatgcattgcattatgcatgcctgagtcctgtagcttgctttgtaaagcacagtgcttattttaataagtgacaatctttaatgcagtggggggaaaatcacagctttgtagatgtctcattgttctcagaagtgatgcttagcttcaagaaacaccaagttggatgggcagctaggcagggactttgatgtccttctggtttgctttctggggcaggaaaaggatgagttctcctagtgtcttgtacacatcagatgctcagtcaaagtctgataaataaatggttctctccctacatctgatatagtgctgtcttacagtagaaaacctaaggaacatgtgactacattcacccattcatctcctagttgcttgctgacatttgaaatttatttgcagactcacgtgtagtggtgatagataaggcttcatgtgtgggcttgggccctgatgagaactcccaccatggctcatatggtgtgcacgtgactccactgtgctggggtgctttcagagatgagctaggacaaaagaatggggatggtggctgggtggggagtggggagttaggagtgggggagtgtagtgttatgtcctgagaattaacctgggggatggagaacaactctctctgtttcacagtgtctcagaaaagagacctcagggatattcaatttctccttttcctacaaattgctagcagcagaatcaacctgaagttctaactaccctggtcatatatttggctggccatggctgatgcagcagaaagtgtagagcaggagtacttggctgaggtgtagccacacatgtcctctcatggcgggtgttggtggacccttgagtacagatgtggccctctaccaatctaggggtataaaggcagctggcgtctaagcccctttgacctggtgatctccttacttcatgcaagctgcctggcccactggactttgctcatacctcctgagaacaaggtcgtcgctaggggactgtgtctacccccttgcaggctcatcttgtgtccatccctgacactgcttgttttctgagcacttccttgagacatggctgaggcatagtgttcacaagccttccaagcagacccagcccttggggatctggcccagttcaaacccattcctagaaaacccagaattggatctctgtggccacaatattgaaagactagtttttcatgaaaaggatgaccctgattgttttattaaagtattgaaagacatatgaacgtaaatgtctttttaagttgatgtataataatcatacatatgaactcatttatgcctgaggttgcaatttttttaatttttgcaaacagaccttcgtgatgaccttgagcattaggacataaataactcccgcatgcttaatgttccattattggtatgctaaacataaatgggctagccccatttatggggtacatgtgatattttgatacatggatacaatgtataatgatcaaatcagggtatttaggatatctattgcctcaaatatttatctttattttgttgggaacattttaaatcttctcttatagctattttgagatatacgttaaataattgctaattctagtcaccttactgagtcattgaacagtagaacttacttcctctaactgtatgtttgtatccattttccaacatctctttattccctctttacccttcccagcctctggtagctatcattctaagctccacttccatgagatcaacttttttagctctcacatatgaataagaacatgtgatatttttctttctgtgcctggcttgtttcactaacataatcacctccagttccatccataatgctgaaaataatatgatttcattcatttttatggccaaatagtattccattgtgtatatatgccacattttctttatccatttgtccgttgatggacacttatgtttattccatatcttggctcttgtgaataatgctccactaaacatgggggtgcaagtatccctttgatgtactgatttcctttcctttggacaaatgctcagtactgggattgtgaaattgtatggtagttataattttagttttctgaggaaacttactgttttccataatggctgtatgagtgtattagtttatattcccaccaacagtgtgtaagagttcccttttctttgcatccttggtagtattttttttattatagccattctaattaggatgagatgatattttattgtggttttgatttgcatttccctgatgattagtgatgttgaacattttttcatatacctattggccacttgtatgttttcctttgagaaatgtttattcatgtcctttgcccactttttaatgggattatttgttttgatgttgagttgtttgagatccttttatattctggatattagtcccttgttggatgaatagttgtaaatattttctcccattctataagttatctgttcaatctcttgattgtttcctttggtgtccagaagctttttagcttagtgtagtcctatttgtctactttcgtttttgttgcctgtgcctttgaagtcttagacataaggtctttgttagaccaatgttctgaagtgtttcctctttgttttcttctagtatcttgtggttttgagtcttatatttaggtcttcaattcatcttgagttgatttttgtatatggtgagagatatgggtctaatttcattcttctgcacatggatatccagttttcccaacaccattcattgaagagagtgccctttccccagggtatgttcttagtgcctttgttgaaaatcagttggctgtaaatacatggatttatttctgaattctccattctgttccattgctctatatatctatttttataccaatatcattctggtttgattaccatagcctaataatatattttgatgtcaggaagtataatgcctccagctttgttctttttgctcggtgttgctttggctatttggggtcttttgtggttccataggaattttggtgttttatgaaaacttctgtaaagaatgtcattgacattttgataggaattgcattgagtctgaagattgctttgagttgtgtggccattttaacaatattaattcttctgatccatgagcatgggatatctttccatttgtttgttttctcttcaatttcttttatcagtattttgtagctttcattgtagaggctttcacctcctgagttaaatttattcctagggattttatccttttttgtagttattgtaagtgggattgttttcctgatttctttttttcagctagtttactagtgtgtagaaaaaaactaattttttttgacttttgaatgttgattttgtatcccacaactttactaaatttgtttatctagtctaagagttttttttggtggagtatttagtattttttagatataagatcatattatccgcaaagagagaaaatatgactttctcttttctaacttgaatgcctttcacttctttttctggcctgattgctttggttagggcttccagtactgtattgaataagagtggtaaaagtgggcatctttgtcttgttccagttcttagaggaaaagctttcagcttttccccatttagtatgttaggttagggtttgtcatgtgtggccttttttatgttgaggtatgttccttctgtgcttagtttgttgagttatcatgaagggatgctaaattttatcaaatttttttgcacttactgacatataatatggtttttgccttcattttgttaatgtaatgtatcacatttattgatttgcatatgtggatttgcatccctgggctaaatctcacttgatcatagtgtgttatctttttaatgtgttgtaggattcagtttgttagcattttgttcagaatttttgcatctatttttatcagggatattggtctgtagttttctttttttgttgtgttcttgtctgattttgatagcagggtaatgctggcctgatagaataagttagaaagaatttactcctcttcaattttttggaatagcttcagaagaatttgtgttagttttttaaaagtttggtagaattcagcagtaaagctacttcagcttttctttgttgggagacttttcattactaattcaatcttattactcattattggtctgctcaggttttctatttcttcctgattcaatcttggtaggttgtatgtgtccaaagatttaaccatttcctctaggttccccagtttgttagcgtatagttgttcctgatagtctctaataatcctttgtatttctgtggtatcatgttgtaatatcttatttgttgctgattttatatatttgggtcatttctcttttttccttggttagttgcactggtggtttattgattttgcttgccattttataaaaccaactttttttcattgattttttgtattgttttataggtctgtatttcatttagctgctttgatctttattatctctttccttctgctaattttgtgctttatttgttcttgcttttctagttcctcaaggtgcatcattaggttgcttatttgaagtctttctactttttttgatgtaggcatttattgttataaatgtccctcttagcactgcttttgctgtatcccataggttttggtatgatgtgtttttattttcatttgtttcaaaaaatttttaaattttcttcttaattttttcattggtccattggttgttcaggagcatgttatttaatttccaagtatttttatagtttctaaagtttctttttgttatcgatttctagttttattccattgttgtctgagaagatacctgatgtaattttgatttttaaaaatttgttgagacttgttttgtgttcttacctatggtctatcctagagaatgttccatgtgctgatgagaaaaacgtgtattctgccattgttggatgaaatgttctgtaaatgtctgttgggttcatttggcctaaagtgcagtttaaatccaatatttctttgatgattttcagtctagatgatccctataaaactgagagtgaggtgttcaagtcctcaactattattatttgtagtaatactgctgtggtgttgggtgtatatatatttataattgttacagcttcttgctgaattgatcactttatcatcatataatcatctttaagtcaaaaatgataaaaagagacaaagatcattagtctgttttatctaactactcttgcacacttttgatttccatttgtgtggaatatatttttttcatctcttcactttcagtttgtgtgtatctttacaagtgaagtgaatttcttgtagcaaatacatagttggttcatgtttcttttttcccctttagccagtctgtatctttgaagtagggaatttaatctatttacatttaaggttattattgacaggtgaggatgtattcaagtcattttgttaattgttttatcattattttgtatatcctttgttagtttcttcctctcattgtttttttgcagtttggtggttttctgtagtggtaatatttgactcatttctctttctctttttgtcacttttatatctggtctacaaatgagttttatacttttgtgtgtttttatggtggtaggtactgttcttttccttccagatgtagggcttccttgagcatttcttataggcctggtctagtggtgataaattccctcagtttttcttgtctaggaaagattttatttctccttcatgtttgaaggatagctttgcttgttaaagtattcttggctggcagtttttttttttctttcagctctttgaatatgtcattttattctctcccgttctgtaaggttttggctaagaaatccactgttagttgaattggacttccttatatgtgacttgactcttttgctgttttttagaattctctttttatctttgacttttgatggtttggctataatatgctttggagaagactttttgagtttaatctttttggagatttttgagcttcctgtatctgtctatatttcttgtaagacatgggaaattttcagctattatttcattaaataggttttctatactattgcccatatcttctccagtaaatcctaaaatttgactatatgatcactttatggtgtcctatatatcatgtaggttttttcattcttttttcttttcttgttttgtctgactgggttatttcaacattcttttgcttaatctagcctattgttttaactctcaattgtttttaaattttatttattgaatttttcattttcagaatttctttttttttaaattatgcttatctctttgttgaacttctcattcagatcataaattgtttttctgacttatatgtattgcttctctgtgttctcttatatctcaccgagtttcttaaatataattattttaaattctttttcaggtgttttatagatttcctttttgttgggaactattactagaggcttattgtattcctttggaggtgtcattttccttgcattttcatgtgtttttacattgatatctgcacatttaatttaataattacatcttccaattttatagattggcttttgtaggaaaagactttttttccataggtgtatctatagtgttggttgggtagggtgttttggctttgattctggatagttgcagtagtgtggtctttgtatgatttcttcatctgtaatcagcatcagtggtgtttgtgagttcctcggtggcttaggcagtggtcattagtaggggctgtggcaagactttactagggacagggatgctaggcaggccagtcctttggtacccagtggtggtggcagcaggctgagcatgctggtcctcaggcccctgatagtgtatgtgggtgttgttggtcatgggtccaagtgggccagtccttaggccaccaggcagcttgtttggatgccagaattggcagcagtgggccaagtatgtgggcatgtctttgagcccctggttggtgtgtgtagtatttatttgtggtggcagcagtggtggagggccaactcttgggcctccaagcagcatgtgcaggcatgagcagtggtgggcaggtgggtgccagtggtggtggcagaggcagactagatacactagtccctggactccagagaggcacacatgggtgctggtggctggcaggatgggcctatccccaggcctccagtcagtgcattcaggtagttgaggtggtcaggacggacctgtcttcaggtccctggaaggtgtgtatgtgggcactgggaatggtgtacaaggtgggtcaatccccagacgcccagatggtttgtttatatgttagcagtggtggcagtgggtgggtcaagcttgttgtcagctactagagagtgtgtgctggagcagacaggatggatcaatccccaggatccaagacaacccatgtggatgctgatggcagtagcaggcagggtgagtcaattcagcaggtggggcaggcctgtccttaggaccctggaaggtgtgcaagagtgccagtggtggcaggtgaggtggactgattcctaggaccttaggtagcgtacacagatactggcagtggtggcagtgagtgccatggggttgtcctcagtccctaaatggcatatgcaaatgccagtgatggcagtggcgggtgaggacagcctgtcctcaggccctagggtggcacccagatgtcccaatccctagaccccctgaagacacatgcagctagctgcccagtagttttgccactggagtggtcgggggtgctgtcagggatatcagccccaggcagttggctcttaggagcatgtgcttcagctccctttgtctcaggggaagcctccctggggtgctgcaccactcattccctggggtgtagcacactgtgtgggctggaatgctggagacctggcaggagtggccaggtcctggcatcacaacgctgcaggtctctgggtggatgtgtgaaggatgtcagtggggctccagggatatggagatgcaggggatgttgggccccaggacaggatgcagtctagtgggtgctaggatctcaacatggcgctgtgctgcagctgattgcatctcgggggtgtgtggcacccagcatgagctgtctttctggaacaaaaccttcacacagattccacacagctccctctactcgtctcagggcccacgaaggccaaggggctctcccgtggctaggattgcaggagtccatgatgtgggctactgggatctctccttaccttttccttgcagtggggagtttatccaggctctgagctgatcctggccaggccagctgcttcacttccttcttcttccatgcctctgcggctccctgctgcctccctgctgaatcccaccattctctcttagacacgtgagtccacctgtagttatctcctccggtgccaggcacctctattcagacattctgaagccctcttggtaaatgacttgctgaagtatatgttgggcttaatcccagctctgcccctaattagttgtgtggccttggacaagtcacccctctttccctaaccccgtccttgatatcacagcagtttaccactggaagcatagcttccatagagtccacagacctgaatgtgaaatctgcctcttccatctctgagatgcagtgctctgagcaggatttttggttatttttgtgtgcatttgatttgtgtgtttgtactttttttttcttttttttttttttgagacagagtctcattctgtcacccaggctggagtgcagtggcgtgatcttggctcactgtaacctccacctcctgggttcaagggtatcttgttcctcagcctcctgagcagctgggactacaggtgcacaccactacacccagctaagttttgtattttcggtagagatggggttttgccatgttggccaggctggtctcaagctcctggcctccagtgatctgcctgccttggcctcctaaagtgctgagatcacaggcatgagccactgcacctggccatgtgtataagttttaagttctctactcctcttggttttcgttaagtataaaatggcagtggtaagtgcccacttagagtctgtcaggaccacacaagtatattgtagcaataatagcaaacatttattgtctactctgttgtcctggctgtattttgcaggtgctgctcctctcaatctttaaatcaggctggtaatagcatctctcattttttagatcaaaacctaaaaaggtgggaatgaaagaagctcctaaccctcctggcttttttcccaaagccaggaggcagctcctgaatggtggattttggactactggtgaggctgtcagcaaagggcctggcccagagagatgctcaagagtaggatgaaaagaccgtgggcttcttcctctgcaaaaggaaaggtttgggactgatggatgctgaaaagtctagatcttcataatcctcaacagcttcactgccactgcacacacaaaatgagtgtgccctatatttccagccctctgatgaatacgaaaagagcctgaagaactcatcttcctggtcgcaaagtactttaaaatatataatccctcaatcttaaacatacacattttattgctttttattatacaataatacatatttactattgaaaatacagataagaaaaaagaaaatggttcataataatactacccaggtttaaaaaatactattcagccttatgttgaagaatctgactcttttcctatgcaagcatgtatttcaagcaaaactggacacttcatgtgtaccttgttttgtgatctttttttcccaaattaatatataatcaatatctttttgtatcaatcttcaatcctttcttctgtcacttatttttaatggttaacagtcatctactatatagatattctgtaatttattaaagtgatccctcattcttgaatactgaagttgttgataagaaagttccaatcttgttgagaagaccaagcctgtgaggaatagttccatgaaattacaattggaacttgctatgtgctgagtggcagaaatgcaatagagttctgaatggaaggagtggttttggaatgaaggatggtggggaggctttaaagagtacgtagggttggagccaagctttgagagaggggctggatttccacaggttaagagattgtattcgaaataggagaaccagcagcagcaaaggtgcagagcccaggggttgggtaggtgtttaggccctggggagggctcacataggggaccagctccagagagggttagaaaaggaggacaacagattctagagtggacagtaagtgcaagtctggcaagagtaaattttacccttttgggcaataaggagccacagagagtttttgagcggggttgtggcatgagtagatctcggtttatgaagtcactgtacaagcagttagggagagaagagaatagcaggagatggtatccaaggcagggagacctgttagaaggtggggaacaagtccagaggaggtgatgagacctggattcagggagtggcaggaggtgagggaaatgggttggatgtcatggctggagagggcccaaaggaggagcccctggggctcacgaagaggggagactgctgcctgatacctggggtcctgggaagagttaatgggctgcctgtggacgagctaattggtcctccagtggggctgactcattccagcatccaagccagtcattactaatgctggggagggagagagagagagagaaaataaaacaaaagccgagcagtgggaattctgtctgattgaaaagttccagggctggcctcccatttcagacaggcaggattgggaagagggccctgctgtgtgggggtgaatggcaggggtgcggctggcggaagtgacatttccatgatgcctgcttgaaactcatccataactgccttgtgggggtgcagctggggagggctgggtctttccctaaacagcccaggttttctagtgacacccaaggcacactcagggcaagagagtgcgactgaagatgtccacaccagggaggagaggaggaccagcaaaggccaggggtgcaaggtctggttctatttacttaaaaactggctgaaatctcggtccctttgtttgccatttccttgggtttttagatttttaacatgccatggtcaatttcatttgctaagcgagaaatcactgggagcagccttcccagcacagtagagtagggctgtttgggtacaggatgtgtcctggacagtgcccagaggcgctggcagaggcgtaaatgggtgttgccgggtcctcctatcctctctgcctcctccttggtatgggcttctgctgcctttttctgcagcagtggtggagcaaacactgtccagggcttacagggccctggttcctacccgaactcgctggggcactttggcccagatgattccccagtgagggtctcaggtgtcttatcagggttcctctgttacttgaaggcagacggctgaacctgataatgtttgtggcattttccagctcaatgtccctatatagtcatttttctcccatgccacatgttcagggaatgacatctctcatttctatctggtcatcagggatcaagtgaaggccttaccttcaaggctgtgggactcagccccagctagaccctgtgggtctaatttggattgtaaagagtttgtcctcgtaaaagggtgctttcgtgtcctctggctttccatttgggattttagtggtcggtaggcacacatggggccttatgttgtgtggcagccaaatgagctgcatctttgggttgtagggcttggtgtgggaggggtgccactaacacatgctgtgccttgagttctgcatgggtcacatcatgatgttatccccatgcctcccatgcatgggtcacaggcacctcccactcatctgctgcctagggccagtcctattgctaacttcatgttttgggtccagggcctcccctccagaaatcccacatattgtcaaggggaagccagcctaaaataagggccaggccaacctgaggtgtggtggctcaggccaaagggctcccccttatctggagtgcatggaacccctccctgtgaggcttatttggtggctcaggccaaagggcctcctccatcttgaatgcctggaatgcctccctgtgaggtctcagatctggatgcggaacctgaggtgggacatggatgaaatggagcagagaaggagaaggggtgaagcctggaccctgatggaaggggaggaaaagaacaaactggggctgccatgacggggaaggaaaggcccgtgtggaggagcatggagccatctgctcatgaaggaaaggcagggatggggcagaggtgttggggcttccgtgcgactccagaggccaagcccagagctgtgtgtggagcccatgaggagcagagattttccagcaaaggtgcatttgtgggcctccagatggaggccctaccttctcagcaagggaagaaacccctctctctttgacctctctcccctgcacaattagaaggttctgaagagtgacttcattattggtgggtgagtatatgtttattgggcatctgtggtgtgccagatgttgtgttgagtgctgggtgcagaggtaaatgggatatctggttaccgcccacatggggcttatagtgggggaagtgggggagtaagtcaggacacacgtaagcaaacgctagaatggatagatattgtgattagagcattggagagaaagaacaggatgtttcaagaaaggacagcatgaaggactgctgtgtgggatcaggaaggtctccgtgtgtgtggtggggggtgatggttaagctgaggcccaaaggatgacgggagttacccaggtgaagggttgtggagacgagagcacaagcgagggccaggaggcagctgggctcagggcacttagggccctgaggaaggctggagtgggtggcagggggcaaagggggtgctgaggtgagcctaacaagggctgtgggccaggaaacaggactttgttttgagtgcggtgggaaggcatgtggcaggcagccaccttgaggctgggtttccttctctcaagtgccagagctcagtggctgctttctgggaagctggtgaccaggacgactggtgcatggcaaagggcatcaggagactcttctttcctcctccaggagttgagtttctcagtctcaagcaggcagcatgggaggtccccagacctgccctggaaaactcccccagacctgagcagtaggcagcagcttgggggtgctgggttcatgtccaccctgaacctgtgaatgtgaccttatttggaaatagggtctttgcagatgtaatcaagttaagatgaggccacagtggatcagggtgggtcctaatctaataactggtgttcttataagaaaagggaaatttggacacagacacacagatggagaggccatgtgaagatggatgcagaggtcagaatgatgctgccacaagccaaggaatgccaaggatggccagcacccaccagaagccaggagaggcccaagcagagccttccctggtggctgcagtgagagcacggccctgctgataccttagcttcagacttcggacctccagaattgtggcagaataaatctctgttgttttaaatcaccccatttgtggtgttttgtcacagcagccccaggaaacaaatacactgggcccaggaaggggaacctggtgtattaagcctgtcccacatgctggcccaccagcattccttatcttgtttacatgacaactcagagaagttccaaccatgctcttcattttacagaagaagagctggatggtcagagaggtgcagcaatatatcaaaagcccacagagacacaataacaaagctggggtttgagcccaggtctgaattggcccctgatctttctgtaccgcctatctgcagagccttgatggagagtgatccaagagggtcagacaatgatgaggaatcaaggctctgcagcactcatgtatttactggtggaatcccatgcccggcatttgttttgagatgccctaaaagaaaaaagagtaggaatggggatagatgaaagaacagcagagtgttggtaatcatagaagctgggtaatgggcccatgggagttcattgaattattctctttatgtttgctcatctctgaaaatctccacagcaaaaacttaaaaagtaaggccagagagatgcaagcttaaacaaggaaaaagattaaaaactatgagggctctgaaatcagagagcataggattgggatctcagcttcgcccttcattagatgtgagatgttggacaagccacttggccacactgagccttggtttcctctgctccatggcctctcactaggcaaaacctcatgggatggtggaggaatcaaatggtggaattcaagtgctcagcccagtgccatgcacatgggaggcattctagaaatatttgcattattatggttactgagtgtgcaccttacagcagctcaagggtcaagactcccttctttttttgtgaaatagggatgagaatgaggcttagaagtggaggaactcgtctaagatcccaaagctaataagtgacagagacaggcctgacccagaaatctctccctgagctaactgcttccattacccacagagctactcagagacctgctctcatgcagtgtttagggcctttcccacaaggaggccagctttcttccccttggtttagggatcaggccaaggaggggaaggaagatgaagccgcccctggctgaccctggcgagctctggtcactctgtgtttgctcagctgcagggtgcaggtggcaggagcggatgctgagcaccagctgacatgctttcaaaggtgacaggcctgtggtaattgatggtcaatgagggccatggctccatgcacactgttggtttaaggatgacattgatctgacacactggccacagcagaaacagcaaaacaaaggaaggccaaactggaaacaggcctggcctcccttggccctggctgccttggctctgagcattcccagaatgctgtgccctgaggtctggccaggatcctggtgccctggagctctggggtcagccaggatggaggaagtgcccaaggcccccacccatctgggtgcaggtcagggaaggagtgagaaggagcaaagcgggagcaacctcagaggttcccagagctgtgcccacacactgtttccagccttcccctgcccaagtttccatgccctgggagtaaggtggaggagggaggggcctccagaccatgtcccacacagcacggtgcatgcagtggatgtgtctgctgaggagagaagatgcaggggccctgggaggtaggcagggatgggctgggggataagagaggcaaggcctggtggcagaggcctgggtgtgaattcagggctctggcaggaaacagaattcactccagatgcttccagtgaagagacaaggtcattctgtgggcagcatcagggaaattctcaagagatgaggatgctctcagtggctagcaacagtagcacgtcatgaccctccctaaggctgaaggatcagtgggggtgggagggacagtgctagccaaaccccaggagaaccagactcacaaaagagggtgccagcagccactgcctgggaggcggcctgagcaggaaggaagaggggaggaaatgcacaagccctctccttgctcctttccagatccttgccagctgctggagggagccactgatgtagtcagtaggggccacctcccaggctggagcagggcagggaagggcaaggaatggagaggcagcctgggtagaatagagaataccagcacacctcttttctttccctacaatgacgactgtcatacacactgcacaaacccaaggggaggattattgataaggcgtgtgacagtcccagcacaaggcccctcatgtgctagccttgacagacggtagcttcaaactctccatctctctttttttcaaatgtgcacacacacactccacatttcctcaaatctctgaatggctgtcataaggaagaaggagcgaacatgttctgggagggccaagggggagcccgaggacaaattgtgtagctgtcagaattctgtggctcctggaataggcatgccccaggggcactgcctcctgccatgggaagcatggtgctcttaacatgtgcctgctgtgtgtgagtgcagctcatgtcacatgctccccatcctccaatccacaccagctctcagggcagctgatggtcatgccttcgctttgcaggtgaggatgctggcctcagagggacgggtgcttgcccaaggttgtcctggagccaggctatatcaatcaggataggccaggttttgctgctgtaacaacccccagagctcggtgggtcaagacaatatgggcttggctcctgctcatgttacctgtccatcaggggtcagctgggggctctgcatttcaccatccttcctctgggacctaggctgtcaaaactgtagccatctgagatattgttctcacgctggagattttatttggtctggaggtcacgcacgtcacttctgcttacaattcgttggtcagactggtcacatgcccctatccaagcaaaggggccaggatggtcagtcctactacgtgtccagaaggtggagagctggaactattagaagaacagcattagtggctgctacatgagccatggcttcctttcaggcctagggaactccaggtgcagagctcttcctgctgctccaaggttgacgtcaccctggcagaggctggtggagtgccatggcacagtgggaaaggctagagcaggggctgtctcagattcttgtgggctcattctgtggccacctaagtaggatgctgaggaagtcagcagatctcaagaaagatggccctgggccgtcagagcaagatcaggagaggcagcatgtagtgcagagaggagagggcttggtacctcccaggaccctgagcttcctgtctccactctcctgggccacacatggagagcccttcgctgcttatggaggcgggatccctttcggaggctgtctttccagctgcaagtgctctgggcaggctggaaacggtgttctgaagagccgcatgaggccatttcatcagagtgctactcaggctgctagaaaactggccacagagccattcttcttccacaacccctgactgcaactagatggaatttatgtacttgtcatccccattcggtggccaggctggggaaggagaggagtgtgattctacacagtggactccacagagagaggaggtgagtggagtcagtctttctggaagccctgccctgtgcttggccctagaagggcaccacgctgctggttgctgccacatgcattagctcctgtcgctctcccctccctggccaccctgcttcacacactttcactcttcttgaggaagctgtgttccctgccttgtggactccatttctgcatctcccaagccaccaatgactcctcttacacgatcttgcagaagcactcaacacggctggccatttttgatttcattctgttttattcttctgtgccgtcacactctcttgctacccatctgtggaatattctttctctctccatctggcccctgggtgcctgtggtctgcagacctccatgcacagttcatattttctctttttggccgtctaatccctaccatgagcttctgcagcccatcattgatgaatcccaaacccagacctctttctggaattcaaggtatgttcatccatgtgcctagctgacatgtccacttggatatccaacaagctcctacaactgaacatgggcctttcccccaaattgtccttgtgtccagtcattcttgtttcagtcaatggcgtacttatccaccaaccgtggaagccagaaactcgagagccctcccagcttccttcctctgcctgtctccagagtaggtcctgaagcctgacctcctccatagccaccaccaccatctccaacctggaataggacagcaggctctttggtaccttgttcccttcaatccatctccctgctgccacagggatttacaaaaatctggtccaaaaaattccctaattcttaaaacgttcaagggtccctttaccccagttttaaatccaaactcctgaacagggcacctttatgatccaggctcctgtcccttctgcagcctcttctctcccctaccctgcaccccatgcccaactctgtccctttgcacactctctgtttgtcctgcaatgcctttctctgcctcctctctgtttggatggctaattccttctcaacttttccaactcagttaacatatcatttgttttaggaagcttttcttaacgtccccaaagcaagtgtgcctcctccacattcttgtagactcctgtatgtaaacaccctatgggaaggcagagggggtgctgcccctcctctcccgagtgtttttggagggcaagcttgagtccagagcccagcacaaggcttatctggcagtcaatcaattcttgtgaataaataggcaagttggcctgcccccaaagtccctcaacagtggcctcaaatcacagagggaccttggaaatcatgtagcctaatgattcattccgcagacgagaactgtgaggttcttcaaggaggtgaaagttctcagtgaaggagtgaatattgaatctagattggtgaacttccaaacaaagaccacttttattttttaatattgtactatgtaatggagagtttatttctcttgttgactttatacagaagcactgaaagttcatgtgaaatcattcatcaaatacagacaagcaaaaagagaaaagatagaatttgcttagtaattgtaccaccaaaccagagataaccattgctgattgcttggcatgttacctttccatcttttccctgggcagataaatatatgtccatttttaaaaacaatactatgattgcactacaaatctgtttcacccatgctttaaacatatttataaatccctattcatatttgtcaaagactgtatagttttaatgtttttagttgcgctacaatataattcagtaatcagacatgatttttggatcttgaagttggttctattttttttgttattataaacagagcaatgaagaacatcattacagtgaaaaatttggtcaattcttaattactactttagcatacattcttagaagttgaactgaagtagaactggtgggttgaaggatttgcacttttgtgcattttgccaaattgccctcctaaaaggctgactaatcagagtttatatttaccagtttattgtcttgtcaacctgagaggaaactctttgcaccagagattgaaggacttgtctctggtagcaaatttccctccagtcatatgtctcagtatggaggttgtaaactggaagccatgggccatcttcttttgaatccatgatgttttaaaatatttgaattaaagccaggtgcagtggctcacacctgcaactccagctactcaggaggctgaggcaggaggatagcttgaatcctggagtttgaggcttcagtgagctatgattgtaccacagcattctagcttaggtgacacagtgagactctgtttttaaaatacacacacacatacacacacacatataaaatgctggacgtagtggctcacctgtaatcccagcactttggaaggccgagatgggtggctcatgtgaggtcaggagttcaagaccagcctggtcaacatggtgaaatcccgtctctactaaagatacaaaaattagccaggtgcagtagcgtgcacctgtaatcccagctattctggaggctgaggcaggaaaatcactcgaacctgggaggcagaggttgcagtgagctcagatagcaccactgtactccagcctgggtgacacagcaagactctgtctcaaaaaaaaatatatatatatgtatatatatacatacatatatatttgaattaacagccaacttttttctttttttattattatactttaagttctagggtacatgtgcataacatgcaggtttgttacatatgtatatatgtgccatgttggtgtgaacagccaactttatgtattagtaaatttcaccaaaaaaaaaaaaacaacctgaatttctggcctctacttctgaagggcatgtgctgtcacaatttgccatagtctctacctctccctgttgccacccagcctgcttcagtcatttatttgccaggcccctctaggtgttaggatttgtaacccctatatcagttccttttccccatttaaaaatggcccaccagcatataacaccatgctctttattctgattaactacaaaattaattttttaaaaaacaaatcctatttgtaataataatattcaggttaatcatttaggaagctgcttcagagaaaccccgaacgtctttagccaatataaaataccatgaatcactttggactccacagtgcattatgtatttaaaaacagaaaattagacacaggagaattcatcttaacttcattagatatgaaatattaattctcttctgggtttcatattatttacatatttaataacatgttagctacagtctttgactgagagcaattagaggccaggggctgtctcctgccttaatcttaaagatgccaaaatgttttgatattgtgggaagaagggattgctaaggagagttggatgctgttgcctccattcccttgctcatatgtcgtaattggttaaccatgtatttctcttaaacaggatattgatgactttgcctgacccagtgagaattccatttctccattcccatccctttctctgctctagctgggaagaggagattgtggccattttgttttactaaaacacaaagacaaatgttcatccaatatttttggatccctttttgcctttcttaggtccttttagagcctcagtttcctcataagtaaaattggggtaaaagaacaaacgtgctggactgttgtgagggtaaaggggctgaatgtggaggaacacacagacccatgtctcacaaggggctgctgcctggctgggggtaggtcctttctcgctgcatcagtgaactgtgccttgggcctctgcactatccttggtgcctctctgcaccttagcatgcggcccctgtcatcacgtcaccaaaggcccacatgaatgctatcagaagtttgcaatgatgaatgtatctctgggagccacatctgcagtcattgcaatgagaatcaggtgaggctcttcaggccttgggaggctggtgggacaagttcagccttgacctgggcctgggagggagggagggttaggacagaggccctagagagatagggtgtgtatgatgagtgcagagcatagagctggctggtggtgagcttggtgcagagggtcatagagaacaagtcagcctggtgatatgggagtgagggggtgggcagagacagggctggggaggttcaatagattgcttttaagaccagagagtatcaaagttataagggacctcgggaaaagcctagagtcggggatcatcaaccggtggccctagacaagatcatgcccgttgcagatatctctttggctcatctgatgttaactattattattacttttgttaattttcaaaatcttttagatacagcctgcattttccagttacccccagtctcctccactccatccatttacatgacttactggttctagcttccaaccatgcccctctttcgatttgaagaatgagggaactgcagtcttacaaatagaagctgcctgcttgggctgcacactgggtgagaggtgcagcgtgattccatgccaggttgcctgtcacctggtccagggaccttggaggagcttggatggagccctgtggataacaaggagctcctacaggcccagagctgggcattgacgtctgggaatcctgggtatgctacggaggaaattgtgggttgcggggcaggcacagtggtggctggagcccagactgctgtctggacctcagaaccccatacctctccattaagcacaggcttcccaggcaggggctggctcactgcagccagcattgttacctcccacactgctgcctccctctctccctcctcagcggagggccttacgactctctcctccactccttagtgggacactgagacgccagtgtgtctcccagtcacatctccacttcctgataaagacagttatctgcagaatcccaggtggactttttaagaaaagggtttcccagttattctggaatgagacttgggtggttcacggagaactgggtgtgcagagtgctctcaccttataccccaattgagtctatcaggattaatgtcacgctaatgaacacaagaaggattaagcatgatttgtcacttgttgtaaagtgcttccaggcatcaccaatccatcacagccactctccagaaacaagaacccagtgagtctgtgagatgcagtctggggaatcaggatcaggagaatcgctttttatagttaacctgccctggtgatgattccaggaagcagtggagcttgaggctgaggctcaggcacacatgagataagtatgacaccccaaaccgtgctgtaggagcagtgctccttcttccctgaaatcctgaacctttaaacacatcctctctgttttcagcactagaaccagggtttgggggataaaggctgaaggggagtttccatcttacaaatagggaaattgagtcagaggatctatgcagcctcaaatctgtggcagttagagagcagttctagttctggccctgctacctacatgctgtgtgacctaggtttggttaagacccttctctgggccccgcctgtttcccaattcacaaaatgacaaggttagagtggaagatgtctccgctaaaattctaacccatcccatgtgttagagggcatgtggtttttttctttcttttcttaaaaaaaagttttctaaaacagctttattgagacataatttacatactgtacaatttgcccatttaaaggatacaattcaatggtttggggtatgttcacagatatgtgtaaccatcacaattttagaacattatcatcatctcaaaaaaccccctctgtatcctttaactattacctccctgtacccctgtcctgcatccctacccctaagaaaccactaatctattttcttttcttttctttttcttttctggagatagaatctcactctgtcacccagggtggagtgcagtggcacgatctcggctcactgcaacctccgccttccaggttcaagtgattctcctgcctcaggctccccagtagctgagattacatgcatgcagcaccatgcccagctaatttaaaaaatatttttagtagagacagggtttcaccatgttgcccgggctggttttaaactcctgagctcaggcagtctgctcgccttggcctcccaaagcgctgggattacaggcgtgaaccaccgtgcctggcccctattttttatttctacagatttttcatatgaacaaaatcatatagtattttgtgactggtttttttaacttagcataatgttttaaaagttcatccacattgtagcatgaatcagtacttcatccctttttatggctaaataatattccattgtataaatacaccacattttctttatctttttgtcctttgactcacatttgggttgtttccaccttttgtctattacacataatgctgctataaacagtcatgtgtgagtttctatatgtacatatgttttcatttctcttgagtatctacttaggagtgaattgctgggtcatatggtagccttatagtttaatcagttgaagagctgccagacagttttccaaagtggccacaccattttaaactcccataagtagtgtatgagggttttaatttcttcacatccaacactgttatctgatttttaaattccagctatgctagtgagtataagtactaccttatcatggtttggatttgcatttccttaatgactaatgatattgactagtaatattgaccatcttttatgtgtttattggctatttgtgtatctttttttgaagtacagatctattcagatcttttgcatctttattaattgggtaattagtccttttattattgcattgtaagaattcattatatattctagattcaaatgttttatcaaataatatatgatttgcaaatattttcttccattatgtgggctctcttttcacttccttggtggtgccctttgaagcacaaaaggttttaattttgatgaagttcaatttatctgttttttattgcttgttcttttaatgtcttatctaacaattatttatcaagtccaagatcataaagacttactcttaggttttctttaagaattttacagtttttgctctcacatttaggtctttgctccattttgagttaattttcgcatatggtgtgaggtaggcatctaacttcattcttttttttttttttttgagacagggtctcactttgtcacccaggctggagtgcagtggcacgatcatggctgatgcagccttgaccttcctgggctcgtgtaatcctccaacttcagcctaccacttcagcctcctgagtagctgggaccacaggtgcataccaccagcctggctaattttttattttttgtggagacaggggttttcccatgttgcccgggctggtcccaaactcctggactcaagcaatctgcccacctcagcctcccaaagagctggaattacaggcatgagccactgtgcctggcctctgacttcattcctgggcatgtgcttatccagctctcccagctccattttgttgaaaggactattcatattttcccacggaactgtcatattgtaacccttgtccaaaatcagttgatgataggtttatgggtttatttttggacttttaattatatttcattgacatgtacatttattcttgtgccaggaccacaatgtctcgattactgttgctttgcagtaagttttgaaatcagaaactgtgaatcttcctactttgtgcttctttttcccagattgttttggctcttctttatcctgtccaattccatatgaattttagaatcagtttctcagtttctacaaaaaacccagctgggattctgatagagattggcttaaatctgtagattggtttggggagtgttattatcttaacaatattaagtctttcaaatcatgaacgtgagatttttttttctatttatttagatctttaatttctttcaacaatatttttttgttttcagagcacagttttacatttctctttttaaatttattcctaagtattttattctttttgatgctattgcaaatggaattattgttttcttgattttatttttggatttttcattgacagtatatagaaaaaggattggtttttgtatattgatcttgtatcttgcaaccttgttgaacttgtttactaattttaatagttttagtgaattctttaggattttctctatataaggtcatgccgtcttcatgttttgcttctttctttccaatctggataacttttatttctttttcttgcctaattgccctagctagaatcaccagtacaatgttgaataggactggtaaaactagacatccttgccttgttcctgatcttagaaggaaagcaccctgtcttttaccattaaatatgaagtaaggatgggcatagtggatcacacctataatctcaacacttcaaaaggccaaggcaggtagatctcctgagttcaggagtttgagaccagtctgggcaactgggcaacatgacaaaacctcttctctactaaataaataaataaataaataaataaataaataaataaataagcaagacagccaggtatggtggcatgcacctgtagtccctgctacttggggagctgaggcgggaggttgaggctgcagtgagccatgtttgtgtcactacattccagcttggttgacaaagagagtccctgtctcaaaaaataaatgaagatagctgtgggtttttcatagacactctttgtcagactgaggaagttcttttctattcctagttcatttcatgtttttgatcatgaaactgttgatgttttttcaaacgatttttatgcatctattgagacggccatgtgatttttgttttgttctgttgatataatgtattaattaattgacttttcagatgttaaaccaattttatgtctctgggataaatctcaattagtccatggtatatgattctttttatacgcttttatatgttgctggatttggtttgctagtattttgctgaagatctgattattgcatctatatttataagtgatattgctctgtggttttcttgtcatgtttttgggtttggtatcagggtaatactggcttcataaaatgagttgagagtgttcccttctcctctatgtttttggaagagtttattaaaaattggtatttgttgttttctgaatggtggaaggcagtggtgaagcgatcagagtttggggttttcttgttggatagtttaaaaattactgatttagtctctttacttcttatataggttgattcaggttgtttatagaggcacgtaattttgtgtgtgggcccttacacagttaaaagccttttgtggggcctgagctccgtggatcatggattactgcagttactagtaagtccataggggtcttctggttaggtaaatagatggcttagacagaaagtgggctgtaatttgggcgtctcagtcctccagagcctggagaagatcctgcaggtgggtctgcatgctgagtgcggcaggcagggtcagaggagaagggctattttagtgagctgaagtgggagggatgggtgtatattgcgattctagctagaaggattgctgtggcagggccctccagctagtccagctggtgccttcctgacatgtgtacaccccttccatccacactccctcccaagtagtggctgtgtccctagcactctgggagtcgttcagcaccacagaggaagggaacctctctctgttattatcatgtatccccagctccctgttgtgggtggatgtacatggcagggggtccaggtcgcccagaaggttctcaggattattttttgaatggaagaatggtcagaactgcctcttggttcttgtctcccagcaatccgcaggtatacctggcctgaagccagaaagccaaaggggtccaactgtatccaaaagcccacttttctaagtaaatgtgcatcaggtgtcttaaccatcaagcatggatccagaaacgcttatcactgtctgtagcatatgcaaagcactgtgggagataacataatgtgaggtgtctggtctctgcccttgagatgctgacaatgtagttgctggaaaaacaccagtggattcagttgaatgagtccttagatggcctctcaggctcagccctgtaatgatcaccattgttgttcctgcattcctggttccggtaagagtgcccggcatgctgatgctgattggtgcagggactgcataagaaggcccttcagccctctgggctcttctcattctccacttttcttgatgggtggtccaatttctgaaaatatgcccagcttctactttgtacttctgcaattgtctgcctcagccaagtcataactgtctcctcaccacccccaactcctgggacattgtcctggcagccttcagcctctggtctcagtctcataccctctcagaaaaggtaaatgggatgcacacacacacacatgtgcacacacacgaaatttctcaattctcccaccaagtggagagcctccaagttccattccttaccatccactgtggcttaggggctggagattttggtagcctcttcttgagacaacaattacacatcaatctcagagggaggcattttggaaaaatgccaaaagacttggcctagtttggctgagctcacctgagagccgggtgttacctcaggcaccgttggagaaataggctccacagaggagccacgggggtagttattctctgttcaggaattggagtcagtctctgttaggtgtgtgaatgctgagtgatggagcaggaagtgccatccttaccatctcaggcctgggctggagtgtgttaaaggtggctcctgcctgccgggggaggttggcaactctctcaaagcagtgagcacagattccacaacctatctttgcgcagtgctggctgctgatcttgcggatggggactgaaagttctgccctcacgctcctctggcatttcagtcctgacccaggtgccagagtcctgggttggcaggcattctgggcaagccagagatggctccactctgtgaaaggtcagtcacttagttgacaatattaggtggtgctgactctgtgccaggtatactctcacctgtggttctcaaccagggtctattttgtgcccccccaaccttacccaccaggggacatttggcaatgtctggagacatttttgattgtcacagctgggaggcagtggctactactggcatctaatgcgtagaggctggggatgctgctacacattctacaaagcacggaatccgtctccacagcaaagaacaatctgccccaagatgtgaacagtgctggggttgggaaagcttgctctatacagtgggctcccagaggtgttggatctggacaaaatccctaccctcagaaaagctaggcgctagtgggggtggacagatcatcttagagctggtccctgtcctccaagtggtgtcctgaagacagttcatttgttagtttcccccttgagttttttcattcacttgttcagccttcacaggttgaggttttttcttgggatacagaaatggcatggatctggtgcttcccctcaagcagcccatgtccagtgaggaaccaaagcatacacatcaacacgcacatacacaaacacacacaaatgcatatatgcatgcatgcataagcacacacacgcatgtgtgcatgcaattccaacactatgcaataagggctgaggtggatgaatatctggagactgtaggtgaggaggggtttgtagctcagccttgaggggtgtcaaggaatgcttcctgggggaagtgagctgaattttaaaggacagggagaatcagtagggggaaaagccattcccctaagaaagaactaaccctctgtagaaacccatgggcaagagagttcaatttcctgcaggctctgtggagcagccagaggctgctataaccctctgccacaatccacactaattgctccttcctcctgtgacaaggcatcccctctcccctctgccccacagcccctcccccatcacaccttaaactcatctgtgaaattgcatttctcaccctctctgcctccagcccctccatcactgccaggagaggccatcagttccctgacccagccccagccctcagatgggagtcagatggtgccctcaattattttcctaacaaccaggaggatttgggggagaagtagagaaggaaagggaagataatgtggcttccaggggcttgaaattggacagagtgcccttttatacctcctgactgcctttggtatcttctctctcatatgtaaacagcattaaacataatgaaaggccaagccctggaaggccttgctatagagtccattggggagagaatcaaaagatgctcacagctggctgtcctgggaagggtctagtggaagatgctaggggtctggggttagcaaaaatggatctttgtcatggctgtttcattgtcttgctgggtgacctcaggtaaattacttcacctttctgggccacaagcacctctgctgtgaaatttggagggagcccatccccaggatatcgtatcacataacaataacatctggtgacatcactggcctttaatagacaggagcaaagcacggaatttgaaagaaaatatgcctgcatttcttccttctcccctacagcccatgttccccagaggtattagtggccacagctgatagctgatgagtccagctgaggtcgataggatacatcagcattctccagataagcttgatgcgttcatgctcccgtaccttaacctatgccattctgttgcccggaatgcccttcctgccctctccccacccttcccgaaggggatattctatcaagatctagctaagaaggcctcccctttgggacgcctccttgaccttccctggttgctgtctcttctggcccccaacaaactttgcttgctcctctgttccatcttcaatgtttacttttgtgtccctggccggtaacaaaaatccaatagctcagagtgtgtcccgccatggtgcggcaactcgcatttcatcagcaggtgagctgtgactgtcaataaaatattgcagctaatgactttggcatggatctgggcatttctatgccgtgacttccccctttcacttgtagccaggacacagagatcacaagagagggctgtgcattggaaagttgatattcctgtgtatcttggaggaggaaaggatggaccctgtgaactggcaaagactagttggagacataatcacagacaccttcagttgggctcatttaattgccacggatagagacctgctcaagcacctggagaatacaaggctatcatggggttccagatgcaggacttgcaccctagtggggcctcacaggattgagcccagtgaggaattacagtgctgtgtggagcagcttctttctgttcaggtgttactgcttctccctgcacactggttctgccctcctccatcctcagattggcttcctccttctgttcataacttccactccctggaaacttggatttgtcaaagcccagtttggctgagcttctccattacatgcctgtgaactttgggctcctggcccttttgctacgtctcacagtttcctagttctttggatctcaatttctaagaaaggaatttataatccaactcaatacaacaaaggttgctggccaacgaatggatgcagtactcttggatcagcaccagggcttggtgtctggtggacagggtcaggtggtacagaagacgatctcttagataatggtggttggggtgaggcagattatttttaagggggttaggaaaaagcagggagtattatacaacactgatttttatacatgagtagctactgtgtggcatatgacagctaaaagcatgtgaggatggatggatggatggatggatgaagaatggatgatggataatggatgatagagtggaatctctttgacagaaagttgaaatggttttgtagcaccactttctagattatagtttataatgcaagagaggagatctcatatatatatatatatatatatatatatatacacacacataattttatatatgtatagatacatagatatagatatatttaatagtaagtcatatctgcttaaccagagccatacatggccatatgctgtgcagaggaaccaaagatggataccacatgtggctttggggaggactagtgtaaagtctaccaatgtccaaggcatggccttggtagaaagaggaccactactgctactcactgaccaagtagtcctctggagtggaccaggatcttctagccttcaaaaaccctttataacccccaaacagcaccttcatcctgtcatccaggctcaaggtgagtcatgtgttcccactgtatcaagttgacactccccatgtggcattggaaggttgcatgtgtacagcattatcagtcccactccctccactgctttggccacacctcctccctgctattccacacactgtcttttctagctgcagccttaagtactggccaacaatgttggcatgcttagaatacaccaggtactgtgcttttctctttgctcatatcatagtgttttaagctttacaacaaccctaaagggtagtggttattctcctcattttacagatgaagaaaccaaggcccagggacttcaagcaaccataagcaacagccaataagcagaagagcctcttctgcactgacttgtatggacttccagccttgctcattttccttttgcagcctcaaccttatctagattttaagagacagccctttttgtacttcctcccaccccgcaccctcacctcttactcttattaagtttaaagtgcaaaaatgatgcaattaaaacctatattgcctctcgaccttttacttgtgcccatgaaatatctaagacccgacattcagaggtgaatacacacctcttcttctcacctccagagctgggcaatattcaaactcaacatagaccagtggatggagaggcgattgtggtggaggaaatagctatggctgggtgtacatccctggttctgcaatgactgatgaggcctgcgagttctgtatggcaccttgccaggcctctattggccctgccattggatggagatgacccttgtgtcctgctgaccacacggatcacatcatcccctcatctagcttcaaaaataatctaatcaagacatctgttaattctaagctctttccttctctggcctctgggggcctcagttccctcatctataaaatggagaggtctctttctaccggctggctctgcggacttgtgggaattggtgccaggcatggggcttgggtgctttccttcccccggctgctaaaggggatgcccttagaaggcagtcatctcagctactggtttgcactgtcttggcctgacctccaaacctctggatgtgaaacctttaacctcttatccagatgtgctgttctggtgtcaaacagctacatgtttgggaataactgtataaatgctggccaaaactgaggccataaccaccccacccccaaaccagagatttatgctcactgactaagatttatgaaattgccgccttatgaatagttcacgggcattcagggtcagctgaaggtttttagaggaacatttgggagtaattttggaaacattttgcttctttctcttttctttgcaagtggtaagaggagagggagagaagcccaggaaccatccctcccacacggctaaggagggaaagcaggactccatagtccctggctcctcctggcagaatttatagtccgcagcctgcaaattactggagggaacatggaaacctgggtaatgatgtgggagagaacattctccagtgctgacgtgggtttccctgcgccagagaaccagagatggggtaattgaagctcatgctccgaacagttatagcaaaggtaatttccatggcggcatttgaaatatccccagtgcacagggaggagggtggtggcggggaagccagacctgatgaatgagacagaatcatggatgctcgggcttggacccatacaaggccccagggtctccagaaacttagaactaagttgggcccttactcacaaaatggggtcctcattgggtagtagaagtaggatgaaggcgagcctaaagcataaactcagcaaagggagggactctgacttttcagcaccatatccttggctccaagcatggctcctgccacttagaagatctttaatattttttgttcaatggatgaatgaatgaatgaatgatgggtgaataaatggatggctctagaataagtgaattgacagttctgttgtgttctacctgtgttcatctcatggcttacaccttggcttgcccagaggatagcagtcagaatagtgaggtgatgcttaactatgtcattcaggaggcagtagaaagaatgaggggtatttaatggttagcataacagtttcctgtcttcaagtttctgaacgcaggagacactagtgggttagagctagggccaatgcttagaactcagaggcagatctggggtcccccaatatcattgctcacattgattgagtgcttcatatgtgctgggcatacttttgccattgcagatgatagacactaaggcttagggagtatataggtttcctgggctgctgtcacaaatgaccacaaacttggtgactttaaacaacagaaatgtactgtcttacagttctgaaagtcagaaatccaaaatcaagatagcagggccaggcacggtggctcatgcctataatcccagaactttgggaggccaaggtgggtggatcacctgaggtcaagagtttgagaccagcctggccaacatggtgaaaccccgtctctactaaaaatacaaaaaatttagctgggcctggtggcagatgcttgtaatcccagctactcgggaggctgaggtgggagaatcccttgaacccgagaggagaggttgtagtgagccgagattaggccattgcactccatcctgggcaacaagagcaaaacttcatttcaaaaataaaaaattaaaaaaaagatagcggggttgcattctgtctgacagctctagggaagaatccttccttgcctctcttagctcctggtggctgttggcaatgctggcactgctcttggctgtggactcatcactccattctctgcctgtcttctcatggcctgctcctctgtgtcttgatttggattgagggcctactctgacagtccagtgtgatatcatccaaatccttccttttagttacatctgcaaagactcttatcccacataaggtcacatgcacatgctctgagtatgggggggttatggactggatatctgcatccccccaaaattcatacattgaaatcctaacccccagtgtgatagcacttggaaatgaggcctttgtgaggtgatgggattagtgatcttgttacaggagaaaccacagagcttgcaggaagaagaggccatgtgagtagagagtgagaactcggctgcctatgagcccatacgaagaagcctcaggatgaaagctacctgaccaacaccttgattttggactcttctagaacatgggaaataaatttttgttgttttataagctacccagtctgtagtatttttttaatggcagcttgagctgactaatacaggaactaccattcaacccactatggagtgggccagtggtggtggaggtcaggggcagccaatgctcctcttctcttccccatgggagcctttgagagcctttctgactttccagcatggacgccacttccccaggaggcattgagttcttatgcgggcgttcaatgggctccacagatctgggacaatgtggtggggtccccttgaattctgtgattgcatggtagcccctgaccatgccccttacgttttgtccactggcagcaagcttaaaccaactggcagtggaactgaaggcaagtgtctaacatttatggaggatgacaccttctatgggagcctgactcgtgacctctgtgggtatttttggcccagagaaagggctggtctgagctgtggctatcagtctaatagtattagagggtcactacagagaaggcagttataaatcacccagagtgggctgggaagtgagtggaacctttctgcctcttttggaagactcaacctggggaaaacatttcatgtcaagggtgggagggggaggtttcttagatccctgggctcggccaaatgtgaagtcagcactcccctcccaacctccccgcaatccagccttcctcctgtcctcccctggcttctataattccgtttgttgtgctcgcaaacaccgtgttggaagatttcatgctaatgaaagggtttcttgattaggttacgctgttactgtaaatgttccctcattatctatgttatggtaggaatttgaaaaagtataaattgagcgtcttgcataatttataaaacctgaatgtttcctaattagttcggttaggttaatgatggtgcagcgtcacttcttcctggtcccgttaatgacctttccactcttcattttgaacactttctgttatttacaagccccctcccaacccaaatccaacaaccagcttccggagtgtggccccatctagcctctgatgggaggatgaaatgccttgcagaatgtgaatggctccttttttctctgcatgtcccccgcccagctttgaggccaagaggcagcctgtttaaaggttggccagcccaaatttggctcaggccaatcccctgaagaatgccggtgaagtgcattctttcggcatttgtatagagattggtgctgtcccccattagcagccagagatgtgaaaatgccggaggaggtgggggagggaaaaaccctctcaaaaggattctaaaataacattttgcatcctcaagtaattcccagttctccctggcaaccattcatttcttccgaacagcagaaatttgcaatatgaaagtggattggcttctccctcccttggggcccctgtatctcttcatccagcgccttgggtaaaaagcaatgcatacgtttacaatataaatgtgatttaatcgacctccctgtcagggagaaatggcaagcatatcaaacaagaccaagatgttagaaagaaaaatcataaattattccagtgacgagtttcggagccgcctcccagactactagctgatgctatataaggctgttccttgaaacaataattaagataattctgtatgacaaggagaaaaatgtccagctttgtatgaaatgtgcttcatgttagcaagctgaatgcttggtattgattactctctccccacaatctcccccacccagtcgctgtgattcaaggctaaaattaattgaatgatgcaacatttcttttctcgaatccttatttaccgtacatgcctcctagaagccatgcaaagtgggctggcctctaattctctaaattgatctcttcctttggcagtgtctgggagaatgccgacatgtacgcacacacactcacacacatcctcagctgggtgtccattgttctcctctctggaaggtatgattcccccctcaggcagatttgagggacatatcagtacagtacagccctcactattctgttattaggccaccatggggctctcctacagaaatatggccaatgccagaggtccctcaatgcagaaagctgcagacgggactggctcaccccacctgccaccctttccctgcttgcagtccatagaacagcatctggcctctgtctagcagaacatccattttccccctctcccccttccaacctcccagggtatggtgtggatcaaggagggacctcttcgctctcccctctcctattctagctgccatatcctgagacagtcgtcccccctcctatgagaggcactgggcaattcctggcagagagagatggtttatggcctcagctctgctggtttttctgaggctctatttcatcttgactgcagttgctgccgcagtggtggctgggagagagagcgaggcacagcttcaggtacttaatccacagtacatcccctgggcacccgcagcaaggctgatgccttcccctgcctggagaagctgagagagtagtggtaaaggtagcgactgcaggcaaggtgcccatgggcagtggtttgcccctggagccaggctggggctggattccagcatctctgggcttgttgggttactgaacagggcccttcccaccctgaacccagcttcttccctgcagaaggtggtggtggggattcaaggtggaagcctgtgatgggcttgacacgttgtgcacaatcaatgatttttaaaaaatcagagacatttagacaattgtgcgatgagtaaatggctcttggtttgacaatcctgtttgtgacaacccagagccttgtccccaggaaaccatcctttccagaatgatgacagagaaggactcttgttttctgccctggatgtgagggggtggttgtggttccactaagccctgaggaaccatcctttggggacaggcaccaaaggtgcccaaggaccccatgccctagtcttcctcaggagacgtggcatcatcactcagctgtagccacagctcatgaagccagatggtgataagcacattgcacggaggctgaagtgggtgggccgggagaaaaggcagcgctggtgcccagagccgactgctatgggagagagggctgcctatgtgggctcagagttgggggtgaggagtctagaagataggatagggagaaagcaggcagccagtgggagctggacccatggagcattagtaacccattaacccatacccttaaattagcagataactaccacactagaggctacactccaggataagggctgtgtgaatcttgtccactctcccagagctgagtacagtgcccagcacatactagtgcccaataaaggagtggagtgataggtgagggcccaggaatccctgctgaggggagtgggtgccaaggcatcagtctggaggactctgaggctgttgcaccttgagaatgggttgttgaaaggcaacgtggggaggctgtttgcagccagtttctctcctcaccctccctctgggcggaggggggctagtgcagcatctagaaggcttgagtctcacttttgctgggagcctcacatctggcacgaggcctgggccaagcagtgtctgaactgtcctcctctgaccccagatgatccatcaaatcctcaggcatctctgaatccctgcgcagcctggtaccccgtaggagctcaacaaggactcctgagtggttggctgcttgacgaagaagcagcccttctctgttgatgaaagagcaattaagactttaggagtctgcagtctagacagggagctgtcaagtctcacataagtgggtctgggaactggtaataggagattagggggggcttctggagaagagaagctgctttagaggtgagcaggagggagcctgggggcgggtcccgggggttgggtcctgtgcattgctcagcgggagccagcgtgtcgaaagttccaacccctctgcctgcctgctctgtgtgtcttacaggcttgtttttacactgctttctttaatgacttctcaccatagtcaaaacaactctcctgtcaacttattaccttaaaaatagttgaaaagatgacacttgggtagaaagtgctttaaaagaacagctactttcccacacgctcctctagctctgccttagagaagagtcttgtgtttggagacctgggttttaatcccagctgtctctcaaggtgactatgtgaccttggccaagtcatggtacctcttggagcctcagattcttccactgtaaaacacggttaaagctcattggtgcataggaatagaacattcccaatgtttagctccacacctgtgtgttcagcccattttctcacgcagctgcctgggaaggcttcctggaggaggtggcacagaagctagttgctgcgtaaaagccaaggccagcgagtttgaccgctgcaagctgagcttttgtaggactcccagcagtaagcctgggtggcagccattccctgcctcagttcctggaccttctcgtcattgcctacctccccatccaggaggcatccatccctgtaccctttcctctgccttgcttctctggtcctcagaacagctccctgccacctgcaccctcctggctgggagaagggtacagcctcagctctcagaatttggaagacttttaattgctgtcttttgtccatggagattagagtgactccagcttggagacaattagtaaattattatgattagtttccatttgtgtggtgctaccctttgagaagcccagctgatttaatcagggttggttaatgggagcgctagcagctcccctcactcctgacgtgccttggaaaccaagagtgaatccatagaccgtgttcacaggagctcagcattttgtgctggagtaagaccctctgcattgcaggatgccttctgctcatggcttcttgccccacgggtctttggggagctgaataactggagagagggggacgtggggacgtgggcctggatgggatgtcagggacctagggtgtttgcctggaaagggcctcactgccccatgctcccacagttctccttaccccacagcccacaccaccacttcctccctcctcccctgcttcaccttctctcttcagatagactctagtccagtggtttgcagactttgactcatgtcagaatcacctgaagcacttgtcaaaaccaattgctgggccccacttccagggtctctgagtcagtggaggaggggcagggcctgagaatctgaattcctagaagttcccaggtgctactgctgcttctggtccaaagagcaacctttgagagtcatcttttcttatggttttcaatcccgggtggacattcgaatcccttgaggagtttttaaactgatcatttcccagccctctgaccaggctgggttctgttggtctgagcagggtcagggtagatattttttaaagattctccaggtgactctgatgtgtagcttgggttgagtgggggccctttcctggaatgcagacctatttccaggagttcaggggagctcttgcccagttgctgagaggctcagcttggattagcaatacgtagcaggatgtggacacctgggttctggctttagtgcctgcttctgagtgttgacttctgatgtccaagtctaccttcccttcctgccccattctttctttcttttcctttcttgcaacacctctttcatctgcctctctttcttcccccgtaactagtttagtgaagatcccacgcagtggaatggagttattacaaggttttgttttctcttgtccccctcactctgttgactccttttgtcccataacttctggccactttcatgtatcaggaccttctctggtctgacaagaaacagcagtctcaccgctgtgtcaaacccgtctccttggagtggggaaggagaaacggctttttcatgttgaggccattcttcttcctcctttcttgggttttccaggatgggaagggtggagaccatcttgcttcactcgcctcctctcagtgaggtggccggcttttgcttgggctggttaaggctgcatctgcctggtgtgcgtctgcccgtcccagtggtggctcctctctagtggtagtctccatgcagaaggtgagtgtgggttcttcaggggcagcgtccagcttcacttcacctctctcattcctgagtgtgccctcaggaaggacctcatctgggtggcagccacctgggcagcccacacctcctgcctagctctaacttccgtgcttgtgtatgtggagactcaaggtcctctccgcgggtcctttctcctgggaaagccaggaaaaatgaggtcggtgatcccccatcctattcccagccctctaaactctggtctgttttcattttgcaagtgcaggcctctacagcaagctgcagcctccttcctgctgagactgccagacaagaaggcaccacttcctgtgttcacattccaggggcgtatgccatgccttcccctaggccgcacttgccacttccgcattcagctagcgtccagctagggtggggaggtgctgatcttcttttgctggaggcatccctgtctctaggcatgattctcctggaggcctttctcctgcttggcttaggggaggagagcatttttctcaccatgaattcttcccttgcgctaggccatacgactcagcagttttgcctcttgcctatcctgagtgcttctagatggggacaggggtgagatgaagcagagggcagttggtggtcatcccatagacagcctgctgggcctgcttgtcaacagctttctcagcgtggagttggtgtttcttcatcacattgggggcccaagtagccaaccccagacccacaggagggacccactcagcttcctgttgtctccccacccaatgatcctcctccctattatgtcctccctgctttcctaccctggacattcagtgagcctgactctgtcccaggccctgctctaaaccctgggggggcatagacatgggacagctcccactgcactcactgagaggtggcagaattctccaacagttaccagccaccatcctgcatccgccaggagctcctgctctgccaaatgaccaggctgtgatactagggtggttggactgtagtggaggcaagcccagggatgtggaaacacagggcagggccaaatcaccaactttggggatttaggggaagcttcctggcttggaagaggtggtgtctgagtggggccttgaaggatgagtaggagtttgccactcagacacaagaagaacattttacgctgagggaatgaaacatgaaagtgggggctgaatgcaaagatgctgagtgtgattggagcatagaggagatgacatgatgggaaggggcgagggacaggcagggagcaggtcatgaagggtcctggagaccgtgccatggtagggagcacttcccagaaacatctcagagtgagctgttgggcactcctcccttcaccccaaggcttctgttttgaagggtctagttggacactttcttcacatggtggcagctctgaagctgcaagcacttgagtagccagcatttctgagaagggaggacttcccatattgattgcagcagagcaggtggaggtgatgggtgggcagcagagatccgagcaggatggaggatgaggcagctccctttgggtcctcactccagtggctttcataggaggggcctgagcgtcaggacaattcctggcttggtttgtctggggaagtctttggctaaaataccaggggcagaaatcttggctgggaaagaggaattcacaggactcgaatgatttacctaaaagaaaaagcagaacagggattattttttttggaggtgggactctggcgtgacattttaaaaatgcatgtttccatttctcgtgttctgtgagcatatgttgcttttcaataagaaaaaaccccatgtttgttccccagctatttcaccagtgcctatttatcttgtgccagccttcagagaccctgcgggtagagggatacactagacagggcagccaacaccttcccagagtgcgaccctctctcacagttagtgggcacccacagtggtgggtctaggggcacttcctgtatcacatcactcgtcttgacaatgactcttgaggatgggtataattaacatcaacttccagatgaagaacctgaagctcatagcagttaaatcacttggctgaggtcacacagtaaggtgtagccacgttgggcttccagtccagatgagcttggccccaaagcctgggccatttgatgctgattcttttggtctattggactcctatgcaggctccctctgccaggcctgcccctttgcaccttgggtaccgctggggaagtcatacagcttctctaggcctcggtatccccacctataaactagggataattacatctcccttgcaggctcattatgaggcatagggaagtgtgattaatgcacgttactcaggacagtgcctgacactggatgcctggctaatgaggtcttctaatcatggtgtgggacaatgtgagctggcgttgattccctgcttctatcacaagaaataattcacttctgtctctttccagtttctggcttcagaagatgtaggtcctcggcttccttaagctcctaaactcagactcaggggagggatctgtatggaaaaggcagtggcctccctgtcctggttcccacatcattgtcccctggcttcccatggctgtttcttctcaggcccaggctcaacccagccctggagatagcccagacatgggccttcagcatggaacatcaaccccattcacacgtggtcttaagattagttacaaagaccaaggccagggtgagcctggagcaaccatgtattcaacgctcctactgctgtaagtcttgctgtttgggacctgttttctccaggtgctccacatacatcactcacacccactgcttggaacacagcatgtttgccctgctggttcccttccaagatgacaaccataaactctgcagtctgaaggagaccctctgtttctggagggttaccagaaggttgtgctgcccatccatctcccagaagagcctgtgcctttccttcatttgaagtcagaccatcccctaccttgccgtgtgttctgttccaggtagcattgccttgccacctagctccacttaggtgtggtaccctgggcttgtattgaaggcaggatgttgggagaagcagcccctaagaagctagttattgtgcctattgcaggaggaagagtgttaaggaaattgctgggagacatttttctcacctttagaaccaggaaaaggagggccgattatggagagttcctttttatctgtggaaaccaggctgaatgagactgcgtcttcctctccgctttgtctgctaggaagcacagagcccaatgcatagcccatttctaggaggtgcccaggaccacagcattaacaccatggtgtgtaacctcacccttgtctagtgattgactggagcctgctggtccccaggactgctctttgtgctgtcctttggggtccagctctgcatctgacttggttccccccagccccatcaagtcagctggagagcaggacctccctgggttctggctgcttctctttccagcagacctgtgtcttcctggcatcccaacagccatggttgacttttcacgtttccatgggaacagtctgactgtagccagacaagtaactagagaggctgaggaggagcgtgtgtgagtgtgtgttgtgtctgaggctgctcttggagcccagagatcttgtgtacttcccttcggcttgcagtggctgcagcagcctcctcttggtggtaatcatggcccatttgcacctcctacatctccattgctgacataatattgcaccggggtccatccatctgcataatcatcttaacctgctcccataagagagtttaaaaggtctgggctgttggaaaatgaccataaagcctgaacgcagatacctttagcagcaacgccaacatctatcacagggtaattagaggcaaggagtgagggctcctggctctgtgtcggggaactgtttggggctgcgtctgctctgactgttgaaaagaaagggagggaaagacccaagaaggcagtccaggaaggagaagagcagtttctgcagcaataagaggatttctttttactggagggtgtgcagcttctccaaggggaaggaactttgcctaagactgtttggggactcccgggacctctgttcacacgttgaatgcgccatggttttctgaaactagaaaaatcatgaccaggactgttcctttcttactgtgttctaggtcccaaactctggagtgctgtgtggtcttgaacaagcgcccttttctctctgtgatcccatttttctatttgtaaaatgtggggattggacaaatccgtcagtttccaaactcttatttgtggaacactggggctcactggcagggatggggagagggaagggggtaggcaggggtgagacccacctcctttactccaaccacagtggcttttctttcattggtcctacattcagctttctaaggaaggttatacatgaagagcagttttctgctaccagaagcactggacccccactgggctccaagatcccttagagtctctggtgttcgtatgataaaagtactaggcttggaaaaccagattttgctacgtcctttaacaagtgtcgctttattgtgctgaatttgatctctccagaaaaatagtggcgtctgtgcagacaggcagtgcgacttgagggagtgtgaggaccccacggagtcagacacagaggggcaagaacagctcttgcaaagcagagaccaggggccaactgcccacagccggcctcctcaggcccagtggggctccaagtcttcgggaatgccccaggcagtgggtggctgtcctctctgtgttgaaacaacagagctgttttcttctgggtcccccgccccccttggctgtcagctctgagcagggtgtgcagccccctggctcctatccacatggagcctggtcatctccttctggggtctatcaactgcatgagctgtcagtggaggccacggcggcctctccgttgctgacctcttgttccccagcctcttgaaaactcgctgcaatttgtctctgatcctgctgcagtctccccgccttcccctgaggtcggggcctcaggctctcaagactgtaaggctcactgtctccgctgctgcctcatttgccaggcacttcaagctccaagtctcccctccttcctcacttttaggtctttgaaattttgcgcccctatattcgaaagttatcctggtcattgacagtgcagggagagaaactgctgaaagcattcccccttgtttggagggtccactcctgtcccttctaaactctggagttttccacacctcctcttttctgtcaccttttagatgcctcctgatacctggtgtctcgcttatggtgtgctccctgtgtgaagctcagtgctggtgtctgtgaggctttaaccaaggtatacattgaaaaaaaagaagaagaagaagaaataaaagaaacttttttctgtctgactttctgtgtgtgtcagcccaggcctggggaagtgtgagggcaggctgggtgagtttgccaatcttgtcatcccagaaccccagaaacatcactaccctagtgctccctgcacacccaagccatgctggccagatgtgtcgctctggtctctgttcgactccagcccagcctattctccttggcagcagctcctggcatgctctgcagaaggggcagctatttcaaaccaggctgagggccctggatgtggccatttaaagaaaagatgatggtagctgtcttgccaggcagcaccactgtggtctcacagagcacctggcagcctgcttcagagtacacacattgcctgcaaagagtgctggttttctgttccttctcaaaactttgccttgggacagtggctgggtcggaggctaaggccgtcttggggcatcctttgcccaagtgcagttcttcccactgagccacagtgtaacctctgacagagtctgcccaggctggggctggcgggtcacctatttattttaatagggcaatctcttttgggatgactgtaagcagaggccccaagtgaaagacatttgaaaacaagctgcctggaaacaagcctcttggaggaccacaggggggtggattctggagtcttctcttaacgtgcatccatgcctcccctgcctccattcatgttggcctagtccatggccctcccctcctacttgaggagaacagccttccagactcctggaggcccaggcatgggacgtgccacaggtggacctagaacccaggtctctgagtctcagtccacttctcatcactcctgctgaacccacacgtccctcagcaggtatattaactagaagagccttgttgtggctgtggaggtctggcagttacatggaggcgcaaataaactcttgcaagatactgtggggtgctagaaggagtaacttcctggaaggcaagagacctggttgtggtctcagatctgccaagcggctgtgtgatgttggatgagcagcttgccctttctggccttggcacctgtagttgtacagtgagtggtttgactctgggatgtgtcaaggcctcttcagggtacctctgctctaggtaatgtcaggatctttctcgaggcatgaaggagaagcttgtggtagcagacaagagcacgtggagcaggacgggatgaccctggtgttctcatggaagaaggtccatgacagctccttttccccacgtggcctcgtctcggggccccaaagtgagtgcagtgtggggcctgcctgctgcccctcctggaagccctcgctggggcagtgagcagttccatgctctatatcttcatcccatggttcttcctagggatccacttgtgacaaatgcctccttgatgggaagtgggcaggaaacatctcctgaagtgcagggagccggccctctggatgtagcaaagtcccacctattcatgtgggcaccaacctgggcaggtatgaagtgacagagaggaggaagcttagcacctgctgtcagggcgtgtagactggcagggtaggcagcagtactgctgctgaggtcatgaatcttagtcctctcactcagctggtgacacaaatcacttgtcccacagctgcttccacgatccattctgtggggctggtggaaacccatcacctcggctcctctggggttgtcctcctgcctctcagattccttctctgggcatggctcatcccaggagtcagagagagggtcctctgggtgtcacccctcaggcccctgggccctcactctccctgcctgtaaggccccttcagggcacagcctgctctctgctgccttccagccctgactaaggcacaaggctcctttctgtggctgtccccagccctggcccccagaggtctccccaggagcctttgctgtgggctcttgctcagcaggagcagagaaggcagggtccctctctcgaggaatagctttcactactctcctccctccagcttggggaaatctccttttggtttgggagcaatacttccacatttacgtttcttccaagatcccctgcttcttgctaagaccctggctctcctgctttctttctccacaaagcctccacatcttctaacagatttacaccactggaaacaaaagccaggacatctcatgggtgccttctgctttcccctgtgtagccggcatcttgtgaaacaagggtgcacagagagaacggacaggaaagggagagcagaaaactcaggaaagaacaggccctctgagctgggattttaaagtagtatctgggcaccatcccggatactacgttcccatgtagaagcacatgtgaacatgagcgcctgcccctaggctagtgactaaggtccccatgaaagaaggagagctcagatacagactggattctgcagtgctgcccaggccccaggatgtggacaggataggacaggtccttggctgtataactgggagccaaccatgatatgaagccacacttgggtcacgcaggatgtccacagaagcctcagtcttgaggtggtatgcagagagagcgtagccagatcctgtgcatcaggagggaagtagaaacctagcctgagattcagaagagaggagaagaggtggagcctgggagtggccccagatggggtatggttttgcaggtcaggcttaggagttcaagcccggtccttaggccacagggagccatgggtggtttttgaacagggatgtgagtggtgagagacaggaaaggtcctgagtgagtttgaagagaaaggtggaatggataatcactgagctgggagttctttggaaggcttcctgaaggactcattcattcattcattcattcactcaacaaaggcttctctagcaccttccatgtgccagacactgctcatggtgatgaatataatagagtgtctttcctatagcacttacattgtgggtaggggagatgggcaaaccttaaccaacatataaacattttttccaggtggtgatgtagactcagaagatatcattgcagggtaaggagactgagagtgagaggggatgctcttccagctagggaagccaggggaagcttctagaggaggtggcattggagtagagacctgaagagaatgtgggggttgattttgtcctaaagaacacgttggctttgcgcagctatgatggacagggagtgtgagtgaagcctttggggaagagttcacaggagctgcaacctgccagtcttgttgctgcagagactctgtgggggtgagctttgggtggtgaggttggaagggagacagtgccatttgggatgagagttctaaggctgggttgaggacttcagtcttgctcggtgagcctcagaaagttgctgtgcaggaggtgagcaatggaatgaaaagcgcttgggtctctgcagaaggctcccttccaaaattacagtgggttggccagggcagggatccaggagcagactgagcatgcccagagagccccctcctttgcaattactacaagtcccagcacagggcagggccagatcccttggggatcttctccacatcaaaggggagattagctccaagcccctaacgatgctggatgtgctggccacactcaccagtgctgcctcctctgagactgtcagctttatatctgcttctttttatcaatacgggcaaataattctctagacatttatcattttaaactgtcacagtccagtgcctttcccgaggaccacaatcaatactgatctcggtttgaatacttttctgacaaggttcctatttgtagattcacaagtagaactaatgtgtgttaaagctattcagtttggcattttgcagctccattgacacattaaatataggcgttcaccacgacgattaaccttacaactattaagtaataaaaatcccacatacatatttattagctgaacatcctattccggcatgatgccttccccgacgaggtctttccatgatgggaaaccagagaaggtggaggtgctgctggagagatgagctcactctttgcagagaatgtcaggagggatgtgggatctccaggccacagtgttggtgggaggaggggaagctgctctggggatggaggcccggatggaactagagttgacggggtactgaggtgggtagcagcagagctgagatgttctaggatggtggatccagctgctctctggggtgagatcccagacttcctcattcctggtgcttctgaataggtatcctttctcttcttgggcctcagtttcctcatctgcataatggggtcagactagaattggtgcctcctgggatttttataaggtcatggcatgcgtacagtaggataaaatttgtaaagcctacagcatcaacagacaaggagtgaccagcttaggagaccctgggtgccccaaagccccctctggtgatcatgagggttaaggcgattgacagctcagtgagtggggcacaccagcggggactatcaagtagatgagctcagatgtcccttttgcagtggatgcttggtgactctgtctccctgcttattgatgtggaactctgcttcctggatctgtcttttctgggccagcatccatagggaccctgagtacctatttcctggcacaggggtgcatgggccccagtatcctgggtgtcagctgaggcagcgacagggtggacatctgctcatgtctactgccattctgaccagttggtgcccaggcccttcccatgactaataatatgagctggggggcttcataatgggacaggcgcggggttctagaatcagcactcccaaatccagacacccttgccagccttgggggcatctatccacctttaccattggtccatattcgtgagctctggctcagtcccaggcccaaggccagctggggttggggagtgggtaagtgacagcaggacacactgtgtagtggcggaaaggaggagtctccacacagttgcagcacatggcagaaaagggggcagagatcagagagggcttcctggaggaaggagcctctgcttctagactcactggacaagccaggattcttcaggcaaagagtggagaagagtattgtcggcaggagcatggcacatgagaggggatgctgcagtgcctgtgaggggtgccctgaagactgcactgtgggagcacagccccatgagagctccagctgccgtgctctgatgtcactgctgtgtctatgctcccagccagcgactgagtatgcaggcgtgttccaggagacaagggccgtgccctgacccctagatgtggccttgccaaaccttcatgagactgcatagcatcttttcttcactcatggtcagacctgctctgggatctggcggcagctctcccagcctttcctcaccccctctccattttctcgcacacggacgtttccctaataaattcctcgcacgttgcatcccatatgggtgtctgcttcttgcaggacccaaactaacacaagcaggaagtgcttcaggaactgaagggggttcattctggcctctgggtaaagtgtgagggtgaaattgtgattttccattttacaacaagggaacaaagtgcctgcaaagttctagatgcaaaatactttttaaactgcaacatgacttgtgaagataggccctgttgatggctgtggaagaggttaggtgctggagcaacacttcctggaaacctgaatgcacatttgccatctcataaaatccccccaatggagaaagggaagtgcacttgtctccatgaacgccggaggagagaggggctcagatatgcaccatctttggcgcatcaactttgggtctgggataggaacccaggtgtgtctaacagcaaagtgtgtcccaatcttctgaggtgtctagacactgttcatgtgccaagggacaatcaaaacctgtcacctcggctacagttggcaggaggatacttccacccacactccagttgaaaccgcagaaaatgctgttaggctggctggcctgggatgtgaagctgtatagagaaaaggcaactctccatttttaatttatttacaatttatttttatttatttattttttttagggacagggctttgctctgtctcccaggctggagtgcaggggtgccatcatagctcactgcagctttgacctcctggactaagctatcctcctgcctcggcctcctgagtgggaaggactacaggtatgcaccaccctgcccaccatgcccaccatgcccagctaattttttatcctttttttttttttttttttttagagatggggtcttgctatgtttcccaggctggtcttggactcctggcctcaagcaatcctcctgcctcagccttccaaagtgctgggattaccggcgtgagccaccgtgctgggccatgactctctagagtgggccacagaacccctacacagctgagagatgtgtggacaacttttgcagcactgtggttttgctcaagaccgctgtcccttggcctcttgctgcactcccagagtcagaaggttggggcacactggctttctcctgacctcaaatgaaaggcaaggaggcctgggattgaggctggctcttttaccaccgtgagacccgatctctgggacctgtcattggagggcagctagcgaccgtggggcaatggggagcagctgaccttgcagcgggaagggccatgcctctactttctaagacagagggacacaaggggcgaggtgcctctcctgggaggtgaaggctggtatggttcagtgccggggctggggcagggaagcctggagcactcagacctgcttctgggggtgtcccctgaagatggtgagctggattagccactgtcagtgaggtgcttctggtttttctctgtttctattttctatcttgacagaaaaattgtgattttcacactgtcactaaaccaataggtccctgacatgtgtttttgtaatctgtggagctggtttcctgtacttctgacagttctattacatctctgacagttatataaaatttttcctctgggaagttgatgggggcttttgcctctcccctcactgtaactccccagtcccccatgctaacttatgtttggagatgatggagcaggatgaatgcttttctcgttcctgccagtcacctcctgggaggtggacggtagagtgcacagccaacagacaagggagggagacccgaacctgagctccctcaggtgggaaaggggagcaggacagatccagccctggtgactcaggaacccacagtggaaggacgcttcattcctgctgggttccaaattcggctgattccctctgagagtcctgcccccaccccttgcaaaccacagggcactgtactgagggaggagtgccaccctgcttcatactgatgcctggaaatatatgggggcaggaggttggggcagagccttggctgcagtgtgtgcatgcttgtgagtgtgcacacgtgtgtgttgaattcagggtgtcacatctgtgcacatccacccttgccagacactgtgccaggccctggggtgatggggctatagcctctgtacctggggggcccaggtgtgggtatgaatgctagagctgcacccatgggtggagcacctactctgggtaagtctgtccctgtgctcacactggaagcacatgcatccatgggcatgcatgagtgcgtggtgcatatgggggtagatgtggggaacatgtttgcttctgactcggttgctactgtctggtgctaagcacaatgtctgtcttcgagacaactacttctttagcagaaacagtgatagaagggggcgctggagggacgggagcaggggccaacatcacctcagccacaggcattgcctgtccatgaagtgggagctttgtcaccctggtcctgtcactgcccttctgtgtggcattggacagatcccattgactcagccaaattaggaggaggcactgaacattatcttgggtattctctatgaagcacatataaagtggcccctagacccccaaatagcacctcagcctctgcgaatgcctttgccagatctcagcctggtcttgagacattatttggggcctttcaatcgacttagccactctgattttcctgtctatggaaaacgaggcgttgccatggcaactgccacattacacggttctgtactgacgatgcctctgagatacagagcagcttctcaaagagatacacttttcaacatgtcatgtagaattctgtacttgttagggaaaatcgcatttccagcaaaatgacatgtctctcccgggcttgcggacgcatggctcacgccttccttaaacaaagaattttattcactgcctccctcctgcctctctggtctgctacttgctacccacccctcccgagccccaattccctttacataaaacatgaagctggagatgagggctgcgcagagggcagggctccactagccagggtggaggtgcccagagtgggctgtcccttacagcggaggggcccagaggccaggtctgggggtgggtgccttggctctggctgtggggtcagctagctggcctggttctcctatgtccctccactggcttccaggaccctggcctgacttctcggggacatgcttagaggaaggattgcaagctccccagccccactccttggtcagcgctgcaaagggcctaagtgaggagctgttgtcctcttcaaggtcatggcctccacatatctcgtgtgttcagcagaaccatgtcagctgctctgtccctgtcaggcagtgtgttggggataaagccagcctcactggacccacttggtgtgacactggacccactactttcccttcttgacctcagatctgccatctgcccctgagcaggtgggctggatgcccctggcagagcctgctctgagagtctgagagcctgtccccatgctcccacagatctccagaccccagctctccttgtggttctacctagagagtctgaagctctctttctctcagattctgtgactgataaattggccactgagatatcccaggaaagtctgtgtggacacagggatgagcttcccctaagggaactggctgcctgtacttctgagctcaaaccagaaggctcctatcctgggagcccactcctgcatgttggcctttgccggagggatgttggaccaagctgctgagtgaccaggccaacacctccaagcactgatgcattcagattacttgatgaattgatgcaacatgcatgtgttgagggtcagcactaaatgagttaatacatgtgaagttgtttgatgagtgctcggcacatacgagccatggtgctcattggccacagtggcatgagaagggtgtggagacgtggaaacacttgcacagccactgcctccaaggagcttggagagaggggacagcccagcatcgaacagtctcagcacaggtggggtgggagtgctcaatgtagcctggtcctcgaggctggggaacccctgagggtctccagcccttttcgctgggctgaggggagctcttgctttcaggagaactgcctgaggccccttcattctttcctattagaatggcctcagaactaagactccccccaggagttaatcccacagtttacattggcctctctccagggagtgagtttgaggaccattttctccctctgccttccctaaggcaatcacattgttcctggaaaagcttggctatggagggctttgtaggcccctggggctccctgtgggtggtgaggaaccctcaggtcagcctcctttcacaggctggttatctgggaatttggctcttagacaagttgatcagcagttgtccttctgccaagggcaacagggaacctctggaggggtgcagtgggttggttcagggcactagagagagtaaggaatagcaaggcctgtgtcagatacagaggagcagctttacacgaggaattcagttttctttccttgagactagtgatgttccaagtgtggttcacaggtctgtgttgctggttcacaaattgttagtggtgcacgaaggagtaaggaggttgcatcagagcataaagcaaatacaacattaaacacatatttaattcagcttatatatgcacacaaacacgcatgcccataatttgtatcacaagacactcttgatgaaggcagcaatgcatcgattcaggttctagtgcaagctttgaatgccattgcagacaagctctctgagtaacactgctctccaccacctctcacctgtctcccagtggagatgggatctgcctctgtgctgcccaggccaacattccctctctagtggcctccaggagcttcccactgggtctccctgcctccaatcttaccatcttccagcccaaagcatcctccaccctgctaccagaatgtgctttctatgcaaccctggccatgttgctttcctgccaaacaccttccagtgggtctccgagtccaagttccttagggcggtgttacgtaagggccctgtgaatcttgctctcttaatgccttcccacctcatcgcccacccaccttgctttgtcatctagtcacaggatttctttcagttctccaaatatatggcactttgtcttactcctaggcctgtgtgcaaactgttgctcctgggacactgctctcccttcttttgtcctggctaactcctatcccttcttcatcagagacattatctttctgaattaattaggatggcctcaattgtatgaaagagactgtttattttctcaaatatccttctttcttatctatggaatccccccttttggttaggttgatggctgcccaggacaaatgtagctcccagcctcccttaccgccagatgtggtcatgtcgctaaattctagtcaatgggatatagacagaagagtttctgggaggtgttcttaaaagaagagggggatatttcttccacctctcctcctccctgctatctggaaagcaaatgtgatgcctggagcctgggcagccctctttgagccatgtgagtggaagtcacatgctaagaatggcagggcagtgagacaaaagatgcttggttctctgatgactttaaagctgcccctgtcactctgagctgcttatcttcagacttcttatacatgaaagagaaatgagcctctatcttgcaaaagctactgttattttggggctttctattaatcacagtcaaatctaattctaattgatgcaggtgcaagtaattgaatacctgaaagtaaggaagacattttagatctctcttttaacaagacatctggagggggcctgttccagaatggttcgacagtctgatcagtgtctatggttctttcagccttttttctcgtggtcacaggatggcctctgcagctgcaaatatcacatcctcacatggaaacatctcaggtagaaggatgagcataggttggaaaagatgaaagatgttccttctcacacccctgtcctttaaccttggaggaaaactctctccgaaagctccaagcatgcttcccactgcatcttcttggccagaaccatagctgcaagggaggcagggacagttagtttctgggtgagacaggcaaagaccagggttgggagtggctggtggctggaaagtcagtgatgccttgacattttccctctgtgtagtgtctgttcattggcctctctctagagcaggagttccctaagcacagcagctggcaccaggtgctcttaagagtgcatcctttggagcctgactgcctgagttcaaatcccagctatgctgcttgtggctgagttaacgtttctgcacttcatcatttaaaggggagaggcaagcattctcacctacctcagaaggttgtttgaggagtaagcgggttcatatatgtgaagcacagaatgccagttctcaaaattggctgcaggctaaaatcatatggggagtttgaaaacttaatggtgcctggctcctgaactttaccctggactttctcaggctggttacctgggaatttggtgctcttggtcaagttgaccagcagctgtctctctaccaagggccacagggaacctctagaaaggggggtgcagtgggttggtcctgggcactggagaaagtaaaaaatagcaaggcttctgtcagatacagacagtggaatctaactggtctggggtgtggcttgggctttgggatttttaaaagcttgctagatggctgccatgtgcagccaagaacagtggctagcagagaggaagcatccagtaaaggttagctctgattggtttagttcatcattgtggccccagtcatgagcccaaagcctggcacagagtgggccttcaatagctgtttgttgaaagaatgaatgaaacgttggggacaggaagagggagttgaggttgtttagtccgaccctctggcactgggattgctaccctgcccacttggttgttgccttggttggaacatctcctgtgggctccagtgctgcctgtttcctccttctcccaacaggcccccaaaggctctgcgcagaccagcactgtctcctccttcatccacagagaggatgaaagaacatggcaagaggaagactcacagaaccccacagagaagctttgagaattgggctgtctggctctcccatcacccatttggccaccagctttggtcccagctgctgtgccctcgggggatgcattatggccctgaaaggggcccttgtccctttttggggtgtcatcctggctgggtggtatggatttctgctgtaaacatggcccatctgggagaagcccaggtgccacgttttgaacagctctgaaacttaaagctcagaaggctttgaaatgcaaatattttgaaggaaacataaggtaaacatgagtgcttatttccccctgatgaaaacaatatgctgtttgctctgaaatgtaaataggacctagatcgcttttaaagaaagccatgtctcatatttttaggtccagggtaatatcgttcctaagaatatgtgcatccggcagccttcccacctgcctgaatccacactccctttttcattcctgatgcccctcattccagccattgctatcttctcccataaatattccaaatccacctccccccttcccaatccggaatgccacactcccccgccacaaccgtcatctaatttttccagtactctctgagtgcttgggagttccttttggatagaattggggaaaaaaaaaaatctgtagccaaaggcgtttcactgacttgaaagagattttatggtgcattgagttctaatcaactttaataagtatttaatgcaggatggagactttgccctcagccccgaggcccagccatgcgtgctcgcggccccctgttggccatgagagtaaggaccgctgctgggaccggtgttttgggtgggcgcggcgagtgacagctgcagagaaacgaataattagcgattgcaacccctgataatgagtagctccatgatccttcttggagccattaggaacatctatcttattaatgatcccgctcgacagccacgggcccgggtgcccgctcctctctcgctcctcatctgtgcacagaaaagcggagatggaaggtggtcatttttcatctcccttagtagtgggggctcgagctttctaggccggccacatccctagggctgattgggatccacccatgccccatgtaccattcaccctgggcactcctcctgtcgccagcagagaacacctttcatatgtgcccacctggtgcctcttgggccaggggtgccatcacccacagtatgctctcttccctccctgccatttgcctgggatttgctatgatcaccatatttgggcaggtacccgctaagggttcagggccttatccaggttcacacaggtagtaagggccagcgccaggataggatgcttgtcttttttgtgggttttcctgatgctccatgttggcctactaagtgaattcaagaaatagcagcccttcctggctggttttcttaaaggcgatgtccaagccagcagttgcagactgtctaccagctgcatctggtttgtaggtatgaatctgtttgacctgcacatgtcttaataattgggaaatagccacttaaatttccagatttactgagaaattggaagacttggacacattaaatttgtagttctgtatggctagatctcagggggcacctgctcttttaagacagtttgccacaggtcccaccactccctatcatcccatgccttgcctgactgactcacttatgttacctgtctgttcccatatctgtctgtgtttgagcttgctgtgtttgagatgagaaagtcaaggtagataggtcacgtgactcgcctatgctagtaagtggcagaattcggttttaaacttagttttcttggctgtagcttcagggcagtttttcatatagccagataattcagttatcagatactgaatggacggcgatgctgaaaggagggtgaattttgcaagtgacctagaaatcttttctctgattcaacttctggactataatagatgactatgtcatgaacgagtacctgcccactttaactggcatatccccctcctcctaaacatcctccttcctctagaagtttctgttcttgctccctcccttagacccctgcagattctgccatgtttttagaggaccctacttctctagtctcacttgattggcctggacgtggatatgtgaccaaagttgagccaatttcaatgctttttcccatctggccagggatagttggttcagggctgagcattgcatccaagttgtgtgaactatttagacctgtgatgttcaaatcttattttatcagcagatgccttttcttaaacaaatgagatgggcaatagaaaacatctaccaggaataacatggttaaggttggcatggacttggaatcccactcacttggatcccacattctaccccagtagttcttcaaagtttgtgggaactctagggccccacagaacacagtttgcaaatggttttccttgagaacaaataagtggcaagatcccagccacccactgaacacgccagcagatgccttgctgaaaccatcaccttggagacaagatgggcagagcttgagaagcccttagcgactgttcatttttatagggtgaaagcaagccttagaatgaatatctgaatcagtgcttcaacctagagtttgaatctccttgtttttcctaaattttttttctggaagaaccttcacccctctgtcccagcctcacaccagtactctatctcccatcctgaaattgcaagcttttagggaaatgaagaatgactccactcactaagcaaacagaacttgttacttaacaagtggtaagtagtttaaacattgcttttatgtgaaatgtatacacataaaacagaagagaatgcaacattcacctgaggcttcaaaataaaacatgaagcttgaaagggatttgggggttataatgctgctttggataaaatcttctggtgctcttgaacagggccctcaaaatttctctgtaaaaggcaagatagtaaatagtttaggccatacagtctctgctgcaatcactcaactctgcttttgtaattagaaacagccttagataacatgtaaaggaatgggtgtggctgtgttccaataaaactttatttagaaaaacaggtggtgtgctgggtttggctgtagttgctggtccctgctctaggtcaatgtgggtaccctactttgtttttataggtttcttagtagacacatctgagagcagtatatgacactaactaggtatcctacaattcattcaattctgacacaaacttcctaaggcagaccccgcaagttaagggctcagcctccatttcatatgcacttctgtctggccaactacaaattcccaggttcccctatccccaatccaggcttgaatatttgccagaatgactcacagaactcaggaaagtgctatccttatgactgttgttttattataaatgatacaaatgaacagattcaccaggcaggtcttgggggtgaggggcccgtgaagcctaagatactgactatcttgccctttacagaaaaagtttgatgatcctgagcagtgcatcaggaaatgttctccaaagccacattataccccccagatacccctgaagttcaactgttttattttcaagccttaggaaaatattgcattctcttctattttatgtatatacattttacaaacagagtgttgcagagcttccatgctctctcccagtggaatgtgggtatggcactcttccagcagtgtggaagttacccaaatcttgtttcagagtttctatctggggtttcattagtaggcgtgattgatgaaatcattggccatgagattgaattcaatttccagctgcaccctctctccccaggggttggtgggggtggtgaaagttctagctctctaatcacatgcttggtgtatctggtgtggccagcccctctcttgaaactatctaagggcccaccttgaatcacctcataaagttaggtataaccaaaaggtgcccattatgaataacaaaagacactcctatcactcaagaaattctatgggtttttgaagctcaaaaaccaaatatgtattttgtattataccacaattggcaaatggattttacttaatttcccaactccaactgattggtcatgcctgcttggagtgctaggctgtagtttctgaggctgggtccaggttcactggaaagagtgctgtaatcaattagtgatgtctgccatgggtaatacaggaggctttagcagcacgtgtgccgtttatctgccattcctaaagggaaatctctgtatctggcacctgttttccaaacagtattttcttatcttcccaaattttgcctgctaacctgtatttatgctatctagcctctcaaagaggctatactgaggtcagatcctactatcttcccgacttgattttaagtttcaggagagcaggtttcctggtgaccatgcatgaaaactccagtaaggaatatagccagcatcactctgtgtacagagttaaggctgcaagaggggaggggaaaagaagtcagtgagagtgtatagaggtcagcttccctgagaggtagagggctgatcaaggtcccgaagaatgggcaggatggggtaggtggaggggagaggagggtatatgtcaggaagtgaggtgttgaggagctgtgggagaaagagctgagggccaagtcttgtccccgacttcagagggcttgagatccaggtagagttggtagctgtgggagcccttgttgttgctggacaggagagctacatgggactattttgacatgggggaagatgcatggaagggcatttctggccaagcgtagaagaacatgagcaggaggaagtgctcctgtttggagcagcctggccactgcagggaaaagaacctctccaggtgcacgcattggcccattgtgtaggagaagccagatcatgcttaccttccattcccatgcaccaagcaatcatccccagaagtggggtcctctaaaaacttggctgcatctgccagagtctagtggtgggatcaaggagaagagaaacctatagaggagaagggaaacctagaggagcgtgtgccagatgaaatgagcagacattttctagatatccttgttgggctgacacacatggctgtgaggaacgaaactgtgcagtaggagctttgtgatccgcttggctgacctggagctgatgtttggattaaggtctttcaccaactctgatgaagcacctgccaacatggtgctggtgatgttcacttgcacagcccatgtaaacctttgaggagcaggtactgcgcccatttaacagatgagaaagtcaaggtagataggtcacgtgacttgcctatgctagtaagtggcagaattcagttttaaacttaattttcttgactctagcttcagggcagtttttcatatagccagataattcagttatcagatactgaatggatggcgatgctgaaaggagggtgaattttgcaagtgacctagaaatcttttctctgattcatcatctgggctataatagacgaccatgtcatgaacgagtacctgcccactttaactgggatatcccccttctcctaaacatcctccttcctctagaagtttctgttcttgctcccccgcttagacccctgcagattctgccatgtttttagaggaccctacttctctagcctcacttgattgtcctggacgtggatatgtgaccaaagttgagccaatttcaatgctttttcccatctggccagggatagttggttcagggctgagcattgcatccaagctgggcctatcccaggcaaatctttggcctgaaatttttcaagacggagctgaaagggagtctccagactctccccacaatgcaggctgtagggtgtcaaagccaggagcacccggcctctgtgttgcatgccatgctgaggagctggcctgcaggtgagagggaatgaagcccctgcagagaggatcagagatgagagatggagggaggaggttctgttctaattctggttcctgtttctctgaggcccagctgctttctgcctttcctcagttggatcattgagcctccttttggattctgtgagtgaatacattccccttttggcctcatctagttcgagctggatttctgtcactggcaacatgagttctgactgacacatagcccgtgtggaagcatctgccattcatatgcgcatgagatatttacagggctggtcctgcatacatggcactgtgcacagctgcaagggcactgggcaggggagcacggagaagtggagaagcgggttctgttcagagatttggggtgcagacaggatccatctgcaggggacaaatttgtacaggctgatcatagactctcaaggatataaagggacatccctgacacccagatgtcacctagcctggggttggacccatgacccccaaagcagattctaacatgttatgtcttcaccttgaaggaggaacatgaatatctccagatctcagagaggatgtctgacccttgagccagaagaaggcccatttactctgtgttcactgattaatcctgaatgccaaatgtggtgcctgatacacaggaggtacttcataatcataatgtgagctgaatgaatgaatgaatgaatgcataaattaatgcatgctcagctccgctgagctcactcctcttccaaagcagtggaggaggatgcagcctctgtcttagacatgtcctagcaattctggcttccttccagagccttccaatcctccctgtcccctgttcacctgcactgcctccctgaaaggagagttatatagaaagagggtcaaagccccaaagcccgaggtcaatcccattcctgcactaagccaagtcctgcctaccactcacaccacgtctggtggtgtcctgctcttccctgctgtctctctgtctcctgcatgaatgcacccctactccctgcacagatgtgtatgcaaaacccatcctgtcttggcattcactgtcttaaaggcactcagtaaatgtttgctgaatgaatgtggaatgaattagattaaacagatacacttgctctagcctccgtgagatggtttgctgtttaagagctcagcaactcacaggggagatgtcacctcagggatcgggatgaagaatggaccaaagtgctggaatagatggaggttcagggcactatgggtgggcacctgagggagggactcacagaggggtggcatttgcactgggctcagagggaatgagtaggagtatagctggtcaagagtatacctggtaggagtgtatctgccaggatatgttatgaattacagtgataggaaaagaaaatctcaaacagaggtagggtagacttcagggctggctgattcagcagctctcagatgctacctgggactcaggttctttctctctctactctgtcatccacggtgttgattgcattctatagtcaaacaatggctgtcagcaacattgggggcaatgtgtgtcctagtccttgtctagtgggagagaggggaatcactcttccaagcgtaaattataattggattggtcaattttggaaaagaacctgcccctggacaaataagtcacatgggagttccctgtgttgattgacttagaataatagggcccacccctgggaaggatgaaatcaactgcccttgagccactgggttgtgtggggaatagcaggtgggggataccagaacaaaacagaggccagacaggaggcagggaggatgggtagcaatgaagagagtccacattggagtaggggaagatgcacggaagggcattgctggctgagggaacaggccatgttaagggttagtgtcaggacttctgtgtttgggagataataggagccaagtggagaaggggctgagaggcagatgcccaagggcagggcttgaatgccatgctgggaaatgggatctccctaggagagtggacttccgtggacaggagaaggggaatgagaaaaatgctgagcaagcccaatccctccctccttgggttcttgtggcggtaccatcccaggattaccatctgaagtagactgggttctgcaggtttagacaaggcttgggtctacatttccccacgtccccttctctttggggttctgagttagggctggccacatgtggagctgtgggagatttggaaggtggaagcagagaagaattaatcattctcagaaggtcatggccatcagacagggtgacagatgcagaagtgcccacgggcgtccagggtcccattcatctttccaactcttggccttgcccacctcaccagtgggggggccccgagctagccaccaagtgctggactgcaggtcccccagaggcagcagcctccatagcccccgcttccttcctacctgcccccctgttcccgtgcttcaggctgttggtgccttcctctggtcctctcccagaccttgactgcccagcccacccgcatctgtgtaagcataaaaaactcaaatgctatgttaagactagttgtcttaacacctacacattcactggagtcatcctcgagtcataatagctcagcttgacccgatcagagaggctgaactatagcataacagcacagactgctggcttcagatcctggctccccacctacctgctgtgcaaacttaggtgagttttccatgtctctgtggctcagcttcctcctctgagaagtgagcctaagaatagaactagctgcagagagtggctagaggagcccatgagttgacaaggcagcacgattcgcacagtgcctggaacatagtaggtgctgtgtaagtgatagctgttgttaccacctatttgtcgtgttccaggcagcagcccaggtgttcacacaggtgttaattcatttaatctccccaacaatcctgtgagagtggtagtgctattaaccccatttacagagtcacagagaggctattaggttggaacatatgaaattgctagttttgtaggtcaaacatagttctgtatcagcaattgcatgtggctcacagctagcatgactgcaggtctcaaagccgggcaacctgcccaaggctatgcagcctgcacttttactggagcacctactgggcaccacagagacggtgtgtcctctgttacagaacttataatattacaggagggctgtttatgtaacaaaggctgtgcacatggaacagggaactacagactattttcaatacctttcctctacaccttcgctcatttgggcatatcagacatagacatcacctcttccatgaagccttccctaacttcccccaccagagaagtcaaccccggcacagagtcagaggtaggagagggccctgtttatctgggggacagtgggaagttttgtgtggctggaatgtccactacttgaagaagagcctggaaagggacccaagccagaggaaaagacttcggatgacaatggggtttggctccattgtcaccatgagaaggagccatccaggccaactcttcttactcatgaaatgccactgaatctcttgatcttcgcctgcccttaggcctccttggaaggtgctccttggtgagggtgcacccgggaacctgaaatgacctgtctggaaagaggtgggcaagtttccaagcctgggcggcatcacagggacttcctggcttttgcctgaggctgcagtccctgtaagagtgacccattgagttggcctctgccctgggagtttcaggcggccccacgtcccaccttctgctttgcatcctctggatctaacctgccttcccaaatccaggcccgtggctttgttctgggaagcaccatctcagcccaggctcagtgctgcccatcccatccccatgtctgtcctgtactcctctctcagggtcagggctattctcctcttatctggggtgagggaatctgacagaatgtaccagaagccaggtctccctgagggctttcccaggactgccagggagaactgggggtgaccagggtctcctattcccctgcatgtgttaagaactttgggtgtggtgctgggctccctggtaggaatcctggtctggccgttcctaaccagtttctcctttgcaaaatggggcttacagatagcacttacttccgaggccagtcagtgtttagcaactggtcttggagtatagttccaacctgaaaattgattggtatttttctgtacctcaatgattgaggtgaacgtgaaacaatgaagatgtaggtacagacttgacactcacttgtcaaaagcatgagtgactttgctgaattggataatagattttgaatacagaaaaaaatattttgtcgggggggctactcacaaactaacagctatagaccgacacaggcacacttttaagtttcatttggaaaattaatattttctccatcacttttttaagtctagaaaaatcaataaaaaataagtcaagcctttgtcaattttcatagtgacgtcactaaacatggaattggaagagaggcttagtaggcttagtagccaccatgatatggcatttccactgcagaaatacaacagaagcacacggccctggcagcatagagaacaataaagtgcagtgagataattcggaagtgatgagttttgaggatttcttacttttgtttttagtataatttatttttaacttatgtaatttaattttaaaataatagtcatatttatcacccagcttgtaaaattcttgaaaatttaacaattggctcttgtgagccggtacaagctggctccagcatgccaccccagggttattacagggggcaaataattgaatgttttcaaaatgttcagaaaacactggcatattgagtaagccctccataaaatgttagccaatcttcttacttactattatgattctcgattggaactttggtgaagtcaggggctgaggttaggtgtgttttcccactagactaagttccacttgaggacagggatctccttttgttctcctggcatctagcataggcctggcctgcaggaggtggtgggcaatgctctctgagttggcatttttcctgcttgacctggatggacgtccgtttcactctcgctcacctgtggccatttctgggtccttcccggcatcacaagccacagatgccatcaggtgggcctgttggtctttcccttttcctgttgccttgtcaggaaaatctcacaagaaggtgcatatgtgggaagcccacttctcaggttctgacccaggagaggaatcgaaggcagatattgtcggctccatgcctgcttcctgctctttaaagagacctgggggtgtttacaagtttaaagcctcacaacattgggattgaagtagcattgcccctttgtatccacggggtctgcatctatggacttaatgaactgtggatccaaaatactcaggaaaaaaaaaatccacaaagttccaaaagcaaaacttgaatttgctgtgctctgagtcctacgctgaatccacacgaatgaagtgatgtgcagacattgtattagctattatagtataagtaattagagatgacaaagtataaggaaggatgtgcataggttatatgcaaatactatcccattttaaaccagggacttgagcatccctggattttggtatccatgatgggtcctggaaccaatccttagtggatacccaggaatgactgtgcttgcaagaggtggctgagttcccatctccctgctgaaactaatggatgtgccaaccctatgcaggggaaacatgtacttaaggacccaaatcttactggaggagggacttgtgaggagggaggatcagagaagtttgctcagagtctgataaaagtagcgtgaatgctttttcctttatccacaaacatttattgagcatggatcatgcgccaggatagggctggcttctggggatatgaagtaaaaattccacagccttttctctcagggagattacattacagtaaaaggaagcaaagagcctattggaagggctgtcactggacacagtatggaatccccctcagcaagttgcagctgctcaggtgggggcggttggtcctagggaagcattgggaaaggctcagtagaggggtgatgcgtggtttgcttgttgcaaggtggggaggtgctcacctgatgattaagggacagaggccatggtgctgtgggcaggaagtccctcatggacgggcaaggccatgtggcagggacttatgtgacccaagcaagtgagaggaagggcacagggcagggcttagcagaggagccaggaagcagcaacagagaaggggttcacccttaaaggagcagtccataaagagatggcaatgaataggtcagaaggtgaaggaagacaatgagacaatgataggtaccccagagtagagcctagagcctgcacaaagacaggtgcaggcagcttatttgtcaggtgatcgtgaaagctggagtgagggagcagggagagagagagagagtgagaacaggggaataaagactgcataattactgtgggcaactgatcacaagcccagtaggaccctctaaggaactgtggagaagatgccttggaactctccctcccaaggatgggaagttgactcactggctcccatcttccattggttgggagttgcccctgggggtgttaactcttccatgttttggccatgcttgtgtttgagccaaggggtcaccctgaggcagaaagggagagagtcatatcagcacacttgaagtgaaatgttggcagcaggtatatagctgtctttctcagctgtgctgatgtcagcaggaccaaaaagatgtgacatggagcacacaaagtatttgctaaaggaatcaaggaaagagtgagtttcaaggagaatgggttggcaggttgcctgtcatggagaagtcttggatggaaaggtccaggatggaaagagttgggtttgcattggggctcagcagagaggcagggacagagccaagttgcactgggctgaggaatgagagggcagtgaagaagcagagacaatggcataagtgattttttttctggattgtcagctgtgaaggaaagacaaggaatctggcaatagccgatggtagatacagaataaggaactcactgaggatgaagaatgtgcaaggatcaaggataatggtgaactttagggacttcagggtttgcatttcaagttttctttccttcagattgtgtatgtgtgtgtgtgtgcgtgcgtgtgtgcgtgtgtttgtgtgggtgtgtctgtatgtctgtgtgctggactaaagagagagaaggaaaagttgctcttttcttgggactgtgggatgacatgggcattgaggttggacagatttgatttagaatctttggttctgccatagtgtgatctgggcgacatacttggaactcagtgttgttatctctaaaatggggataacaatatttctctcccagggtacttctgggcttgaataaggaaaggtttgtagaagagtctgacacagattagatagtcagagcctcagcattgtcttgagagacagtgtggtggttaagagaacagatttttgaaccagactgcctgcctgggttcaggccccagctctatgctgtccaggctgtaatgcacacagcgacagcattggcaagagtaggggtgtgatgagatgtgaggctggattggtaaacacgtccagagagctgagaccagagcccaggccaagactggacttcatctaccctgagctctagggccctggccactgtgctactcccagtgacttagtttttcctctgccaggagagggtgaactgacacacacctgtcaaatgtgcggctcagataccagcactccctatctctagcagacattatcgatggaacagacactttctggtggagtttggacattgtctcattcagagtgcttcttgacatgggctacacgtgggccctgcaattgatcagacttgccacatgagattttccatctaggtctaggtgaactctctagatgttcctgttcttagacctggacaagcccagcttctgcccaggccccatgctttacagggcctttctccaagttttcagaaaatgtatagctaatcacggtcctcattttttcacttggctgggtctctcccaaccctgcaaatcgggtaggctgtgggatttgtgtctatggggttgttcctggttcaattctagaagggcaaagtattgagtagattacctatgttacctggcatggtatttcttcccttttcttttaaataacagtactattaagatatagatcacacaccatataattcacccattttaagtgacagttcaatggtttttagtgtattcagagttgtgcgcccatcaccacaatcaatttcagaacatttttattgcctgaaaagaaatcctgtatcatttagccatcacccccttatctcccctatctctcctagccctaagcaaccactactctatattctgtctctacagagtttcatattctggacatttcatatgaatggaataatataatatgtggtcttttgtgactgaattctttcacttaacataatgttttcaaggttcacccatgaggtagcacgaatcagtacttcattcctttttatggctgaataatatgcaattgtagggacatatcacattctgtttatccatttgtccatgatagaccttcaggttgtttccaacttttggttattatgaatgatgttgctataaacatatatacaagtttttgtaaggacatagattttcatgtcttgagtatatatcagactggtgcaaaagttattgcggtttttgccattacttttgatgccaaaagcgacaattacttttgcaccaacccaataggagtggaattgctgggtcatgtgttacttctatgtttaatcatttgaagaacagtcagactcttccaaagtggcggtactattttccattcctaaaagcagtgtatttagggttctaatttttctgcatgctgtcctacccttactattatctgactttttgattctagtcatcctagttggtgtaaagtggtatctcactgtggttttgatttgtatttccctcaataatgatattgagcatcttgtcatgtgcttatgtgcttgttggcaatttataagtcttttttgaagaaatatctattcagatcctttgcccacttttaattgggttgtcattttattactgagtcataaaacttctttatatatgctatatacaagtcctttatcagacatagagttagcaaaaatttcctcctattttgtgaattgttttttcacagtcttcatggtgtcctttaaaggacaaaagtttaaaaattttatgaaatccaatttttctatgtttacttttgttgcttgttcatttggggacacatctgagaaaccattgtccaatccaagatcataacaatttgccctcatgttttcttctaagaggtcaatagttttagctcttctgtttggagttttgattcacttttagttaattttttccatatggtttgatgtagggatccaatttcatccttctgcatgttgtcccagcaccattttgttgaaaaaattattatttctccattgaattgttttgacatccttgctgaagatgaattgactttagatgtgaggattaatttctggattctcaagccagttaaattagcctacatgtttatcctatgctggtaccacactgtctttattactgtaacttggaagtaagtttaaaaatcaggaagtgtgagtcctccaactttgttctttttcaatacatatttttttctattccaggttccttgaatttctacgtgaattttaggatcagcttgtccatttctgcaaagaagccagctgagcttttgattggaattgcattgaatctgtagatcaatttggagagcatttgcatcttaacagtattaagtcttctcatccatgaacatattatatttttccatgtatttagatctttaattgccttcaacaatgttttgtagtttttagaatataaatcttgcacttcttttgttaaatgtattccaaagtatttcttttgacactattgtaagtgaaattgttttcttagtttcattttcagattgttcactatatgatatcacttttgtggcatagcatgtgattgctcatgaatggtgctgatacactgatttttaatgacttgtttagatagacaaaaacttcaaaataagatctgccttatgcacactaggagcatcctagcatctttgaattctgagacgtcattttattacaacagtttgtttattgatttatttgtcgagggccccctgtgggccagacattcttttaggagtgagaggcactgcagtgggtgcggcaaagtttctacccctgtggagcttgtgttctcatggggaagacagacaacaaactaaccgctaaccaaatacttaatataatttcaggcaatcacaagtcctttgaaagaaaatgaattagccttaggatacaaagttcaggggtacaatgtcagattcaatgggatggtggggaaggcctttctggggaggtgacatagggacagaattaagtgcagggtgagctgtgtggagagctggggaggacagtaggcaccaggccctgggtgggaacacactgcaggggatgggggaccgtaggagagccagcgtggccagggtagaagggagctgagatggggagaggagctgaagagttaggcagggaccaggccacgaagtcagatgggccatggtaagcactgtggcttttaccctgagtgtgatgccaagtcattggagaaattaccaagagctgcaggagtcagggaaggtgtcttgaaagtcaaggaggtaggtgagttctgcagggagaatctgcatgcgcaaagccttcagggtatggagagccaggcaggagcaacagcaggaaaaaaggtatgggaagaagctcagcctgattgaagcaaatggagtacattctggagcaagacaaaagagaaaaggggggagggttggcatgctctctggttgtataatggtctatccagaaggtagctttggttttagcccagagtttagcccagattcaaggcttaggaaacctagaattgagctttggctctgacgttgacttgttatatgaccttgggcaagtcatctcccttctttggggcttgatgttgtcatctgtacaatgggtgctttagaacaagaacaacctcaagtgtgttgcccctgtaatgcatatctttggagactgcttgattcaccaaaccctggacgagagcccttgctaggagagaggccttctgttagctgagctggtctatagcttctctaagctcagatgcttcctgccctgaggtttggcagggtgacagggtagagtgttactatgatatatctctccctttcatcattgccaagctaatgtgatagcctgtggctggtctgtagggcggctaagcttgcaaggagctaatgctggaaatgctggaagtaagtgtggcagagttgataagtggtagagaaaggagatggagacaggttaaacatagcaatgccaggcccaactacatcgtgtcctcccagaaaaagttgggaagccctcagacactgactggtccacctccattggtttgcagagaaagtggacaaggtccagagagggaatgacttctgctttaggtcacccagcaaattggaggcagaatagaaacatggttcctggttctggactcgtggtctttccactgcaccccactgcttctggcaagttgaaagccaatgccctttgggcaaggagaattaacaagaggtagagagaggaatgtgtctgaatgttggttagttggtaggagaaacaagaagtgagcagcctcctggtggttctacttctctctgatcaggacacactagcacagaggtgcagacccttgctctagctgcacctgccctggagccagcagcagagggtgctcaggaatcctgagaagccagcctgtgagccctcgctgtgccacacctctgtacccaccacaacctctccaccagcgtgatctggcccatgacactttctgctcagaaatctttcctttgctcacttgcagacaggactggggcaggactgtggcagcctcttccctgggctgctctattcagactctggggaacttgtagatgatgaaattgggaaaataaaagttgtcctcattctggtcaccactttgggaacacagttttgggaacacttgagagaggggctgattcgtatgcctctgacagactggcccagcacccaggagaccgcagcctcctccatgccaaccatggcacctgctggcatagtccactagtgccccagtgacatttgccacttttcagagtctttcctcactctttaccctctttaggccttagccagtctgctttgccaacttgggtgtggtggctactgtctttgctccagcccttaaccttgcgttctcctgtcctgaccatctgctcctcctagtgaccatgggggccatggaccccaagccaggccaatcagatcctttccctgggactttttgccacttgagctggcccaaaagagcttgttatcctttttcatacaaagctgtttagatataagccagagatgcctgtgactagtatttcaacctcctgaaaagctgaaactggaagaataaagtcagctgtcagagaaagagatggaggttagataaagcatcctagggtgcttgggtgcctgaatcccactgtacctggacctcccctcttttttgagagagctggtgaacttgagtttttgtagcagccaaaggaactctgactaatctgtggatctgataaccctggcttggccttttcatgggttgtgagaatctgatgacctgtccgtggtccaaaaccagccaggggtagatcttcaagaaggcttccccatcccaaactccttacaacagccattccactcatcatgtggaaaagtgggtaaccagaaaggacaggaaaggtggggacacataattgttggggcttgacataggctctctcatctccacacagttaatatggttttacgataaaacaaagaaataaaatcctattttataaatttaaaaaatcaagaccatgctgcttggttccttcaggccctggggagtctgtgtctcagctcaagtggccagctggacaagatgggtgtcaccctggccagcccctggaccagcctgcctcaatctctggcaggctgatgccgtgggttcagcctacagagtctcctccctggacatctctctggagattcagggttggccagggccttgtgtgataagaatcactgaatgtcagtgcccagaggaatctttgagatggagaatggagcaaggcatgagacaaagacacttggccaggttcacactgctgtgtggctgcaatatgctgggcacagaaacagacgcagggaaccttggcttaagagctcccaccactgctgctgtatgccacactgcttcctgcctggtccatcaatgtccccagcaggtgaccttggacagcatcccaggagccaaatgtggtcccagggtcagactgacatgacagggaagatctataggtctggtggaagctgcttggtggcatctcgcccaggagtatctaagaatataaaagggttagatttggggatatgtattttagcagattctgaaacttgcctcttgtatttttgtatacctatactctgcttcatgagctcagatataaaatctaggtctgtcttctctcctagtgcctctgttgcttgaagatacagaacttccttcaaagaaataggtgaatggcccatgcagtaaatgcccccaggactgaggtgataagctcctggcttttcagtagaccttctgcttggccatgctttgcaggcttctgatcactagtccaggtgactggttgaggatgaaaaagtcacctcttagcctcctccattactcctccatgactcctccatgctgttttcctcaagaaggaagctctgacctgctggggtactcgtggcttaccaacaccaagccctctgtttcacttttctccttgcaggggcctttctctgcagcggtccttctccttgtccgttggcctgaagcctgacctttggtaaggtcttcggccagaatggtatcatgagaaagataggcatgaggtgtagttgaatactgtactgaaactgaaaaacagaatggttgcataggtattttaagtccagtttcttttttctttttttttttgtttttgagatggagtctcgctttgtcgcccaggatggagtgcagttgtgcgatcttggctcactgctacctctgcttcctgggttcaagcgatcctcttgcctcagcctcccgagtagcttggattacaggtgcacaccaccacacgtggctaatcttttgtatttttagtagagatggggcttcaccatgttgaccaggctggtcttgaactcctgacctcaagtgatccatccaccttggcctcccaaagtgctgggattacaggtgtgaaccattgtgccaggccttcttgaagtccagtttctactgaccatgtatcactttctcaccatcataaaataaaataatcagtacgtcaaactatcgtatattggagaccatctacatcatatacgtagacatatcacatacatatacatacatatacatatatgatgcacatgtatacatcatatgcagtgatgtacttatttcttgatccaagtgttggttaaatggggatattcagtttgtaaaaaattagcaaactataaactataatcttgttataatgtgaaaaaaaaagaaaggcatgagggaggcagagcaccggccttggagtcagaacatctgggtttgaaatcctgactctactgaatatttgctgagccaagttacttcactttctcatcttccctacctgttgccctgctgtatggggctgattacacctccttcatgcccttgctcattaggagagctaaatgccaggcggcagggggacgaggtggtgtgcaaaagcttgggtcacagagcagatgatcaggaggtcaatgcctggtgcattaggccaccccagcacttcttgcaagaaagaacacaggagagcagcaagccagagagagctgagcttttgctggagtcatgtgacaggcaggacagtgactgaggatttaacgaaaggacaatttgagcacctccagttccaatgccaatgagtgcctctccctgtgtccccaggaccgggatggtgctagctgtttgtgaagtgcaacttgtccccagtaagcatctgttttgcttctctcagcaccagcccttcaggaaattcttggcaggccccctgtgtgctccaaagcgacgccttcccagctcactttggctgccagcagccttccagcaggggcttcttgctctgaatcctaacacgagcttcagcaggggctttagttgctgcactcagcaggggacaggaagggatggtggtggacggagggtgatgaggcagggggccttgttcagggtttctgggatgctgcggcagacagggtctgtctgtgcatgtctgcggaggctggctcatcagcctgcaggccggcctagtgcctcatttctcagtcaatgcccccagcacttggtgagctgggtcgacagcgggtgcagccactgagacaagcagccagatagctactggtcatgttgcttcaagaaaaggaagttaggccagccacagtggctcactcctgtaacctcaacgctttgggaggcagaggcaggaggatcgctagaggccaggaatttgagaccagcctgagcaagaccccgactctaaaaattttttttctaaaaaatcggctaggactaaacatgtatcccagctacttgggaggctgagtgggaggatcacttgagccttggcgtttgaggctgcagtgaattctagcctgggtgacagattgacatcctgtgtctaagaaaaggaaaaagaaaagactgttaagaatctcagtgatgcagaggcttataatgggcgcttgggccttgcctcttctttattcatgtgctcacatgtagtcattccctgccagcctctagttcagcccctgggcactcagtcagggacaggaagcatggcccctgcctctctgatgccctttgcaaagaccctgtcatgtctctgcctggatgacagccacagcagggcaagccacgtggtggagcaggaaaaccctgcagccagactgccttggctcagctctcagctcgaccactcctttgggttctgatttagggcaagaaacttaccttctctgtgctgcgaccagcctgatcaacatagtgaaaccccgtctctactaaaaatacaaaaaattagctgggcgtggtgtcgggtgcctgtaatcccagctactcggggcgatgaggcaggagaatcgcttgaacctgagaggcagaggttgcagtgactgagattgcgccattgcactccagcctgggcaaaaagagtgaaactacgtctcaaaaaaataaataaataaaggagggtgggggatgacagcagtccctaatttatatagttggcatgaagttcaataggttaatgagtgcaaagagtgtgaaatagggcctggaatctagtccataagtaacaaaatcataatgactcggttgtgctacctcttgagtcaccttcttctaggctatctccatcacacaaccttagcgatctttctaggtcagtctgatcatagtaaagtcattcagaggctccgttgaaagttcaaacctttccatgaccttcagacccctgctttcctcctcttgatcacctttccaaatggccatgcccacttttctcctctctaccttacagacactgcagatggcctgccatttgctaaacttgccacagcttctcatcctctgctgatcctgggggacctctcctctctcctccttacctccctggagtcctacatgggttcttcaagaggcccttcaatttgtatttgaaggtagagaatccttccttgatttctccttctctagccaaagccagcccctcctgtgacctctcccattgactgtctaccccaggtcttctgtgctaagcagtgtgttgtaaccgcccgagtaagcatatgtcttccattgaactcagtgtcctctggccatgtcggagtcctctctgggctggcatgagtagacccacaacaaacagttgttgaaggaatgaatgaacaagatgcttggtgaatgcttgccagattagaatgaagaagctgctaatctccttttgtccttactacaacccttaaagcagatggggagacactagcagcctgttgggacttagctgctactttgttggtataagtgacagctggctggccccaggcagctgcaagatatggcctggtccgactctttggacagtgcttactcttctccccagttagcacgcgttctgttgcctgggaggggtaggttgatgcacatgaaacatagaactttccagagatgctcaccacactgtcaccatgccacatttccttctgcagtgtgaacttgcccctcccccatgaagatgcagactcccatctcccccaccttgaatgtgggcttgagcctacttgatcaatacagtgggatggaagggatgttctgagacttccaaggttaagccataagaagctttgcagcttctgcccggggcctttagaattctctcttgggatgctccttctgggaagccagcctccatactatgagatggcaaagccatagaagaggccatgtgtaggtgctctggtggacagcctcggctgagttccctgcaacagcccagccacgtgagtgagccttttgggatacccagatgggccaaaccttcagatgatgccagccccagtggacatctgactgcaatcccatgtgagacctggtgcgtgagctgctcagctgaacccagtaaacccgcagaaacatgagagatggtgataaatgtttgtttgaagtcaccaagctttatggtggcaacagataaacaacaccaagttggacttggtgccaactggaggaagaagtgactgctgaccacttctctgtctccaaagggtgactccagagagcccccagcctatgatttctcaggatgtagaggaacggacttggaggtgggaaccacatgatctccattgtaaggcccactagcctctgagatgctttcttcaatttgcacactgctctggggcaaaagacagagggaaggttgggactgtttcaaggtctagtttcctcagactgtggggaataactagtttcaagtgcacaggtataatgcctttacacacaccctacatcctggtccctgtatggtctactccatgaaaatggtctagatgcttagtacatggaagacggaagcaaggaaatggtgatggagcacccattctgtgccaggtggctgacctccattatttcatttgctcttcacaacaatttgatgagagtagaagtattatccacattgcacagatgaaactcggtcagaaaggttcagtgatgtgtccacacagcaagcaagtggccaacctgaaaaaacccaggccggcatctctactgttgatgacttatgaatggtctcaaagatactgggaagattcccagggctgtgcttcatccccagctgctggtcagggcctgaaatcccctcattattgctttgctactttagcttaaatcctggatcctgccagtgccaatccctctggaaggatgatgcattacaatgttattaatcacctaccccaggcagactgaggtccatcgtctctcctgagagtctgttttcatgggagggaatgtggggtagaggcgctgctttcagggacggaagagaaacaggtggggtcataacacgttcctagttcaggcttttctccattctttccagatggaccttgatggtgggcttggaaaatcaagatgatagatccttagtatggggcatgggacaagccccaacccctgcctgagactggccttcgccaagcccagtggcagctctagaaaatatctctttctccagctaatgaagtccatccctggaatgagcatgggcacattcattgtcctcttcagcttccttcacatttggctggtttcccttcaagactcctgggagaggcgtgtttagttctgggctccaaactcaaggagtggcattaagcgactggtgcgaggccagagcagacagccaggctgagtggggagggaatgccgattcctgatagagcagtgcaagggttctccaaggggaggagacccgggggctggagagctggtttccaccctgaggataccgggtggctgagtgcattgctggactttgcccatgctcctaatccttctctttgggatggttccagttctggggaggcagaggctacttcacatgggtgatcatgatggggagtgactaccttgtcactggaggtggctgagcagaagacctaactgcccatctaggctctgcagagaggctcccacggaaggagaagggactgggtgaccttggagaccccttatcatgtttcattcccaggctctgagaaaggacaaccccatcctggtgcagcaagattttaaccccctggggtaaaagggggggaacaaattgttgtggctgtcccggcgctcaccaaccctcccggctccctttactctgctctttggaggtctaacttcccttcggcaaggagcccttgctcctttcttttctcccttcctgctttcctttcattcatttaacaaattcttgttcagcaaattctttcttgcaatgcctcctaggatattgggcaatgcgcttagtcttgggggaccctggagtgaggagaatgaataccgcccctgcccttatggaacagcagtggggagcgcctgtggaataggggagtgagatggattatagaagtcttgggggaaatccaagaaggttcaaagtgagggccgtgttcaggtaggagatggtgtggtgtgggctgggagggtggcagtgaggccggggaaactggatggagtccagagacagagaataggagaattcatcagtgcttgatggaatgttggctgtggcaggcaggtgaggaagacggggtgtcagaggactcctaggtcgctggctagagcccctgggtaagggagggggccagtcccagggatgcctcaccgcagcgatggcgtggctggcaaagctacctcatgctggggaaggcttctgtactaacgtttcatttcgggcaggtctaggaacagcgaccatgcatttgctcacatcctctctccagagcctgtccgcatcccttctgatcttcccgacagctcccagaagcaggtctttttcttaagatgcctcctaggtgcctgccctcctttctgccgcttctctgctcatcattgcagaggagcggtgattgacacacctagaggccaatgaactgcctagctccacccaccactcccaggttcgctgagtccctccccagctctctcctgttctcctcccgcaagatctctcacggtatcaaaataccagacacgatccagggcaataacaggcctgatttccacctagggagacaagggagggcccagctgggcctcttcacagcatccgtgatcgaccccacctggctggatgttgcgggggcggcagggcagtctcaggcttcccggccagagcctgcagccgggaaacattcctgccccgtttccatggctgccagtcgggcttgagccactgggggctgggggaggggctttgactgggcctgcctgttcgactttgggggatttggtagttctccctctccagattagctcattgtgaagctgctctgaagaactcccctttccagcagccagtgtgcatgaagccagttcactccctcctgggggtccctccctgtgggcgcgaagctcgtgaactcctgagtcccccttcctgtggatgtgaggttggggcacccctgggcactccttcctgtggatgtcaagacagtgcacccctgggtacctctgcctgtgggtgtgaagctggtgcacccctgggtcctccccgtgtactctgaggcactgggatcctggtttcaaggcttgctcagtcatctctggtggtgtaggtctttgtgttcagttttataagtggagaaaactgaagatgattctgtttaccttacccaccccctcacttacctcacctagctcaggggctgggtatggggtggtctcagcccaggacaaccttttaaatattaaacatggtaccatgcgatgtttgtcatacttatgacctggagaaatcaaatgcgattactcagccatctcaaatggggcaatgtgtatgctaacagctacccctcccgagggcatttcacacatgctacctcctgagcttcactgagaccatctacaggcaacaaaacggatacacagaaagatgggtggctgggctcactgtggcctgcagaggaaatatgagcttgacgtcatccccagctggttctgtatctgaacaccgagcacgaggaagtgatggtggccaggccggtctgtacctgggctcctgcgctctgccgcagcccagtcagtgtggttggtgcctggtatcattcctatgtaacagagacagaccagagagggaaataaacttgcccagggctgtgcagctgctcagtggcataaccaggactggaactcatgtcctcttcgtcactctcaggtgctcatcccactcatctcagcaaatcacataaagctctcggtggccttaacaccaggtcaggaggactagaaggggttggccacgagacaaggaggaagtcattgaggggtgaagctggagaccagccttgagtcctggcttgttactggtgtgaccttgagcaatttgccctccttctctgagcctccatttccttgggtgttgcccagggatgctgatctgtggccagcttcccacaagcagttgctctgaggacaaagacgtgggatgggagctggctctgtggacaggcaggggcagctcccccctgctcccctgccatggagctcccttgtcctgggtgagtcttggccaatgccccagagccctgcacagtcccaagctactgtgggaaggcagggagctggcttgtgcctccccagtgtcgacacatccgttctcaggggctctgagatggcctctcttggcctggacgtgccacaaacagtgccctctcccctgcctgtgtgtgttttggggctggctggcaggctcaggaaagcagcctggccttatcagaagccctgggtctccagtttctgggaactgtctccgctctgtggctttctttcccaggtgctggtgccaagcaggctcagtctgagcgtctggcggggttccaggcattctgtgtcaagcacttctcagcagcaggaagaccaacttcatggaggcctgaagggacccagcaaatgacctctgtctgcatggccctggcttaaaaacaggagcatggttgttagcgccccctaatccacacaggggaccaactcctcctagttgtgtgggctgggctgggaactcacaccaatgcctgttagccgcctctagggaggggacctgcatggaagtgtcatcctttaggaggcatgaccaggtgcaccgtctccattcatgctgcacagggatggaggctcggcgcagagaccttgctggcctgtgttctacaactcccatcacccaagagagtcactccacatccctgcgagatggggatcttgactgtcagttaagattgagacaatggaggtgctatgaggttgagaacttctcagtcaatcagccatgtgtggctgagccaggtttgaagccaggcagttggggtccagagcccagttcccaccttaacagcacaggagggggtcctaggtcttctggtcccacagcaacctccatgcccctgccccctccactccctgactccctaggagtgcaatgcatcttactgaggtggagctggctcagctcagtgtaggtgctacatgtatagatgccaggtgggtttatgttagctagggtgcccacaaatagggtccaggtaccaggggcagggtgtctcagaagagttggcagggatataagggactatgtgataaggaacgagggccctgtatactacccagcttgaggtctttgtgggggacagggtctcagccctctgttctggtcccttgtgtggatgagcagtgttatctgtagatacctggagcccagaaggtgggagaggtggcagtcctcggtgcctatccactgtcctctcctggcagactcccctcctggcagagcctctctccaatgcccgtgactactcaatcatcctctttctcttgcttgaaaatttgatgggacaactctgcatggctttcttggctctccacactgcccccctagccgaggtcctcactgctctttccatgctccaggctgatcttctccatctcagtccctgccttccctcctctgtgccttggtcccagaagcttccccagtcaggccacgttggagcccatctttaaggaggagacctctcccctaccctgggctccttcagcatcctaggccactgggtgtgaagtgaccgaagggagtaccatgggacaggcctctggggccctttgccttctccagaccatgagatcctggagggcaaattctacagcccattcattttcagtttcccaaaatgtttgtggattacatggatgaaggaaagcatgcatgagccaagaatggaggcgatgcgatgggtctgggaaccgggagacgcgagtccctttcccttcagtgtctcaggaggagagtggggaagatgccatgtgccctgagatgattttcttggattccttgatgggccaccctttggggaacatttgcattttaacattgaggggagctggcaaatggtagtggattttgggtgctgtggcacccattgcagagggctctctggccggccttgctcatgctgtgggcgggtcccttgtctgggagtttctgcgctcctgtgctggctcccacgatgtccccctttgtaacccctctatccggcctgttcagggaagcatgagctcttttctttgctccagctcattggggtggtgacattttaaaatactgttaatagctgatatttatccaatgccacatggagtctcgtagctgagcacttacatactttatctaatctcatctgcacaccagcattgtgagataggccccgatgaccatcccatcccatattaccagggaggcctcatttatctccatgcccagataccccttcagaggcatggatttgcctgggcgaggatcatgcttaattttgctccataccatcagcccccaacagcaagtgggtgcttcatattggttggccaaacaaggggaaaatgagtgaatctgcaactccgacccttcccacaggcctcactggaaccctaatttaagaacaatgctgtagtcctataatcttaaatgaaaaagcaggatgtgaaatgtggtgtgtgcatgcatgtcacatgtgtgcgtgtgtctgtggaggcagggcacgtaaactggggaggcttggaggtcatgactggagtgtgggtgctgagttctgctgtttggggcatcctggttctgtgatttgggatgagatgcctaagctctctgggcctcagtttccccttctgtaacataggggtaatcacaatacttgacagggttattgcgaggacaaagtgagttattacacacagagcacctagaacaatgtgtggcctctagtaatcactaatgaagtgtttgttaccataatcagtaaatagggatgggaggagctagatggagaggtagacgtattgataacagtgcatgggccttgtaagggagtaaccagtatatttcccttattctgcatacctcagctccttcacctctcccacaaccctgtgtgacacctgaggcagctcaattctctggccctttaaacagagtgtgtattagtggagaggtcacataaagaggaggtggtggcccatgcagaggccttgtggctatgaggaggggatgctgcagggtgacacagagtggactgaggggcctgggtcagcaaggccatagagagttctgtgatgaccacagccgagtgccagggcaggacagctgaccagacatcaactctccattgctgcccaaagccccccaccccatcctcaccggcaacttagacaagcctttcaggaaggaccagatggagggagaaaaattctcagttgactgagttgtaatctgcatttaccaaagaaaaaacttgaagtgactgaatttatccaggattgactagagtggaaatttctgctttcagggagaatgaggctcaagagaggaatgaagttcagtgatagaaaaataatgaaaattatatattttgtatacatgcctatgtggcttatgaaaatctcaccaccatatgttatccttcctgtatataatttcaaaatatgtgtacttatgtgtgttaatatatataaactgaaagaaagaaaattaaccaaaatgtattggttatctctggatgaagggattatggactatttttaattttccttaatatgctctactgtatcttttcaattttctaaagtaaacatgaactacctctatgatcagaaagagaataattatatagctgtgaactgtgggtttacatagttcttcaagtcaggcagattgggccagtaggtggtgtgaaccaggtcacaggaaggtgttaggccaggggctgtgtcctcagagagaccctccctttcctgagcccgtttgatggggatcattcatgtcacatgtgtctacgtgcagccaggaccccataaatattccttcccagaaaggaaggcagagagctttcagtcctgtcctctaatgctagcaggaacaatggcctcccctttacagattagaaactggaagctcagagaggtctagtgacttatgcagggccacacagtcagggagcagccatgctggggttggaactcggacttccagaccaggtgtgcctcacaccacgccacctctgttggtcagcaggaagtggttccaggacaaatctccatgcccatgtcctcaatacctaatggggatttacgactcagagaaaataaaagcttagagggttttttgcaccttgtccaaggtcacacagcaagagcagagttggcattagaattctcatgcttgatgccagaatacgaagatactcagaaaagagtatgatatgggacaaaagggcaaaaaaaaaaaaagcaaagaagtgcgaagacaggaaagagactacaagtgcttcctgaaacaaagaacacagtccagcatgtgtgtgcgcgtgcacatgtgtgtgttggggggtgagtgggaatggtgttgtagtgtggggggaaggtaggagctgagaatgagagtcagggaatagggcagggggaaggagaaaagagacagatgggaaacagtccgtgaaagccaaaaacctcaagtcagacaaatgtttattttatttagtgttgataacagggaaaaaaacgctgatggaaactcacaaatagcacaggctagtgccagctctttagaccctagtgggaagtgctagaatgtgcctctgcccagcagggcagcccccctgccgaacatgatgcttgcctaggaacctacctgaggagacttctccagtggaaagggccctgaaatgggagcctggggctaactgcacaggcaggctgctccgttctcagagtgccaggtccttgtctgtgaaggcaacgccgtcattcctgcaccgtccacctgatgaaaccactgggaggacttcacttttggccaaagtgggatcacaggaactgtctccagcttcctgcctgaaatagcagcaacaatgtcagcaacagcaacaaatagacaaaatctatgaacccacagttttcaagacagtgggcctcaggaagtgaactactgtgatttctcagagatgggaaacaaggaggtgagccctgggatggccccaggcacctgcctggagagagagttcctacgctgcagcacagggagggggacccaaatggagcccagtggactccctgatttgatgagatggagctgagagtgaagggacacccaggtggcgagagttcacaggatggaacacaggacagagtactggagacaagacatacacacacacacactcacacacacacctctagagagctgcagagactccaccaagtactcagcagagttctggtcagcacatacatgtaaggaaattacctgagaccaggaaagaaaacccgctaaaagggtttgagggaacagcgtggaggacccacaggggtgtgaatagtttctgttcccaccagctaggctggaaaaaaaaatctcataattcagagggaaatgagtagagtactcgaatgcatgatccttaatcaaatgttcctgttattccagaaaagatgtctaccccccaccctagttactttgaatcaagttcagactcagccctgtctccgcagttggtttttatagctctgaacagatcagcctcccctgaccctctttatttctcatgctgttgacttggtgaagaatatgggttcattgttccatggggcaccctgcatttgggatttggttggtgcccttcttgtggtggtgttgaactctttcctctatcctggtatttccttacgctaagtgttaggtccaaaggcttgggttcaggccctattcttttggcaagaatccttcgtgggtggcacttccttattaagatgaagtgtgctttgagatggtaactctaggaatgcaccctcggctcatcagcatcggctgctcattacagctgctgggaatgcagcctcctggcatggtgttttgcctctttctgtcccccactaaaaggcatattaagatgcatgtaggtcagaataaggttcatgtgtggacagccttgaatccactcttagtttttaaaatgtcttccagaagtttgagtcttttttttttttttacaaaacctggtatttataacaaataatagtgaaacatggtgagttatgaggttgtcacctatgggcctacaaagtagggtgaccagttgtccctgtgtgctgggggctgagggatttcccgggatatgggaccttcattactaaaactgggaatgtcctgggcaaaccaagatggactagttactttactacaaattgtagaattgtctggtagccaggattataaacaagcaacttagtgtgccagaactacccaggctttagatgtggtcctgtcccctctttatgccatctgagtaagtgatggttgtctgggctttccagtgatggagacactagtccttttcctaagggtgaataagtttaagtccttttcctattcactccattggtggataagttcaactgttagaaaatttggccttccagtgaattccatgaacccacttgtgagctggaattttaccccacagggccaagcatatgatgttaatcaaccaattggaccattgaagtccacaccatggaccttccaagcaaacatctgcaagtacattgctggtcatgacattaggacccttccctccactttcccacattcctcaggacacggtccaggacttggcataagaggatcactggcaccagaacagaggccagactgaaatgcaagaggaccctctgcagaggaggtttgcctgctccctcttgccttctagaatctaggtctgcaggcattcccccttaaccctcaagcctagtgcaatctgttcctctgtgcatgggagagatgtgctatcaaaagggaaaccttgtgtgtccttacacctctcaagtggatgggaggggaagggagtgcctgacttcatccattaaggatgaaccagctgttctagcctgcttgagaggatttcaaactagagccaagaatttaacttcaagaagtaattttaccttctgaaatcaaatcatctaatttacagggcagttgttgaacaggcattcccattgggtttaatgctgcagcttttccggaaacttatgtggaatggaggtcaaaattttatgggctcagatgcattttcttgctagctgagtgactgttttcaggacttctggctccctccaagatgcctctcctgtctaaccagctcagtggcatcccctctgtcttcctctcttctctccatgattccccgaagagcccttcaatatgtccctacttctgatccttcccagcctgtcctggggatgccacaagccttacctttgctaattgcctgctttatcctaactgcccacccctcccaaccttactccccaggtttgtcttccaagggcctcattctctggctccatggacctggccaaattctccctgtccttggcctccatcttccttcttcagaaactagtcaaacaggttctgtctgtccccactttggtgttggtgaatacttctttctaggctgacctcctacaggcaattttccctatgattaatatctttacgttcctcactgacttctccctcctctgacctccacctctgatcaccagtgttgcacaaaccaacacagacaagtttctcttccctggtgggcctctttcttctctttggctaatttgtaagtccctggagggctgggaccaaaagtctatgccagagagagtgagtactcattaaacctctcatgtgcattcctaggtttccagcctttcttgctggaagatggggccgtgtgactagctgtaggctgtgagcagaagtggcatgtgtcacttcctgactgaggcagttaagagctggcagaagtccttctccattcctttcttccatgccacaatgactacagatgccatgtgatccagatgctacacttataagatgatagatcctctgtcagcctggttccctgaatctgtgtggattagagcttcccactgccctacattagacatgtaatatgagcaagaaacaaactccatcatcttaagtctctgagatttggggctttttctgctgcagcagctagcattgctcaatgttaatacaacatcttgtttgttccctccatctccactgttctctgcctggcagctctgagcacagactggtcacccagcatggattcagtgagctttttcatctaaatgatgaatttcgtgggatgctaatagatatggaattcataaatggaacagcttaagagggtgttctcagcggcatgcccagtgaaaactactattgaacttgacctcctggataggccactatccatcctgacttcattggccaaaccctgggatgctgtagcatgctgacttagattcaaaatcaggactgagattcctttagctgttgactttgggataatcatgtgccctctcaaagccacaagttccacatctgcaaagtgaccaaatgatatcagagctccagaggacctggagtccccatcactgcccttctaggaaggccagtctgtttccaggagacaggggattctggggccaacactactgtggtgatgtaggtatgatgctcctggattttggaagtaaagaaggtaaaactgtagtacaatagagagaggcactttgtagagccacaaacccacagaccatggcctgccacatgatccaatcattgcctttccttggactgggacaggctggcaaaccagagctcaaactatgaggggacaggtgatccctgccctcaccatgatatgagttgaaacttgtcaggccttcaggggtgtggctgtgtctttttcacaatctattcccagggcctactcagagcctggcccatggagagtgcctaagggctactgacatccccagtggtggcaagtccttgtcggcaggatgtgttagctgagtccagtggtcactgggcagggaggccatgtgaggcgttctgaacagagagatgaccatctagatatgtctgggctgagattcctcagtggcttcccgggagaagccaaggggacacctgggaagtcagcggcacgggctgcaggaacaggaaaggccacaatgaggtaaggccccctcttgcctctatgctgaggtgggatacctgcaacacatgttcttaacatatgttaaccttggtgctttcctcctgccaagaagctgtcatggaggcatttagcagaggaaacggcgtaggaaacgtttctgttgtactttggggcactgtgcaactaatggggcatgtatgacgggggctgtgggtgggggaggtgggcccccactgaccctgccaaagcctgtttggtccagcaccagaggagcaagtgtgaatagcatttggcagctgaagccaagtcccctcggctgtcatgtgggatgaagcactggggacggaggctgagcacctacgatgcacagggtgctggctttgggcctcacgcatctgccgtctccctgcaccctcaccacagccctgccatatagacatcgtccttccagttacagattaagaagctgccttgaagtcggcctgactccaagcaaatctaactctactagaactcaaaggaactcacagcagtttccttggtgccatgaagccaatgaacccatttaggacacggagaacagcatgcaacatgatctgcaagttacttgtctgaagttcggggttataaggtagcctaaatgaggatgactttatatggcagaggtctggggacaaaacatcaactcttgaggttgggatcaggctgtggttttcatcctaggaaagatgtgtattttgtggcttctttctctctccagttgcaaacacaatgtacataggcaacgcacacaatgaacacacatatatctgcatggatacactctcttttttttttttgacagagtttcactcttgttgcccaggctggattgcaatggcacgatctcggctcacctcaacctctgcctcttgggttcaagcgattctcctgcctcagcctcccgagtagctgggattacaggcatgtgccaccatgccttgctaattttgtatttttagtaaagatggggtttctccatgttggtcaggctggtctcaaactcctgacctcaggtgatctgcccgcctcggcctccccaagtgctgggattacaggcgtgagccaccacgcctggccattgatacactcttaaaagcccacacacctatctatacacatcctcactcacgtgtatgaacagacagtcacgatgatgcttacatgtgacacacccacatacacctgctgtgtcctctcacccacatatccacaggactacttgctttatagacacagcctacatcaaattgccttcacacacacacacacacacacacacacacacacactccctctcaggtggacatgctaacacacatacacaacaggctaatccacatagcaagaaaactcacatttacacagctctttctctgagcaaagaaattctatcttttctaggagagaacaggaaagcgagctagcagttcttagctgctttctgtcatctcccacaactctcaaaggcgacgagctttttatgcagaaaaacaaaagcaaaagagggcaggttggaagtggctgggggcctagtgaggatctctccggggatgaactgctcggtgtttttacccctctagatttcagtttccgcaagtgttaagtgaggataaaactcccttccagccccttcccacggcctctgtgggtatcatatcatctgatacagggatgggaagctgttcagacgagtcctgggtgggccccctcaaggctgaattccctattaccagtcacagagcctattccaaggtcaagccatgccctgctggcttgcgtggggaaatgtggcagtgacaccctgaagggacattcataagggtcacactgtcagagctgcacacgctgtcaccatgaaagagtctcccttatttcacaggtggggaaactgaggcacaggaagattaaggacccagtgcttagaacaacgactgtcacttcccagttccccagtggacactggaggaatgactgtcggatgctgctcttctgccatcttccaagcagctcttgaggctttgagggcttggagtatgagggactcgacaaggcaatattaaattttgtacaaagactgtgggaaatttggaggctgatctgttcctctagtcctgggtgacgcaaccactcttccctgccttgtgtcaacacctcacccaggacatgagaactccccttcacccagctcattgggatttgctgtgcttatgggtgtacacccactacaggcacgcgtgggaacacgtgtgtgcacgcacgcacacacacacacacacacactcttctctctgtctctttctctctctctgtctacagactcacacaagaaaacctgtccaggttggtaatatttccagaaaaagcagatacagggagaggcagtaggagtccccaggctgcctgcccctggggtcccaaataacatgtccaggtgattggtgttgacataaactttaatgctgagtttctagccaagcaccgggtctcaccaatgtcagggtgaacacagtctagtcccttcccttgtagagcttatattccagtggaaggtcactgtgtggtcagcaacatggaggggcagagcttggaggagggctaataagacacatgtctaaacagggtcctctgggtgccctgaagaaggaatgatggactccttcctgcaggggctctagccaagactttgccaagaaggagtatggaagactgtgaaggccgcttgaatgttgccaaataaaggagtgtggtagggtgttctaggccagaggacagcatgtgcaccagccagagggtgaagcctgcagcatatttagggcagacaaggggtcctgtgcgaccagagcctgagacaagaggggccagagaggcagcatggagacaggtgaggaagagacttcagtgccttgccaagggtttgtctttattctctggatggggtagggatcatgggatgggtttaaagagagaagggacgagatcaagtgtgtggttgcaaaggttacctggtggcccgatggaggtgaggaaaccggcatctaactaaaggcaccagaggctgaagcaaggaagatgcaggggagctactgccttcctggctctcccaggtcagtcaggaggtccttgcaataactggggcgagactggtgtgttggaactgtcccaaaagaggatgtgggaagtgagaggagggatggatcagtgaggggtcaaggagagggaggcgtcaaggacggtggtggtggtgccagtgccccaggtttggcggggagcagggcggactcaccttccccatcctggaggaggggcaggcagtgaggtcacatccctcccccggctgtctcggcaggaaccagccattgtttgtcagcctgtgctgtcccaggagctgcggcttagaatattaaaatctttctcaggtttatctcctccccatctcgctcatttgaaatccctgcaactggggggagaaagttactttaatcctctggttcctatcagcctaattacagtttcaacagacaacggaccgggctctaaatgagatctgaggacactggaacacattatgttggcgctaataatggtctgtctttgttttatcatttcttgttgttgcttctcattttggctgcctgaattcttaatgcctttgagtgtctcggggagattgcttcctcttgctggcaggccgggacacagttccagacttgcatatgaaaatacccagcctgtgcctgcagctaacacgccagccgccatttaaatttcaatcagcccttctgtttgtgtgtgagttccttggatggatgaaattagcaattttgaaaaattgattaaaattgctggtttcacgaagcctcaaaacatcaaaatcaatctttttttaaaaaaaaaatacaccaaaattcttgttggacttaccacgtctgcagtatgagaagctgctgattgccagtggggtggtggggacctgagggctgggtgggctggggcttcttttggctctggacacactcctatgtgacctttttaagagtttgactcttgctgggtctcattgttctttcgtttgtggaataaaggggtttgactgaatagggcacctctagaagactcttctccagccctggaactatgtaatcatgtgctctgagtcaggtaaaaaaccaatgaaactttgcaggtagaatctgcatttagatgagggtgagaataccaagaacagatatcatattagctaacattttgaagtgctaaatcaggtgctttatgtgcattatttacacccatttaatcatcacaggaagactatgagaaatacaatgattacccccattttcagatgtggaaacggaggcctacacctttccccacatccaggtgaatataattgcaggaaaagtctgctttgatccatccagcagaggggtctcctagggcccccctgcaatggctctgggggagtcacacatgtgattgacgcatgtcaggctccctggtctgatggggcagtggacgttggcagcagacattcgaggcctccctgggtctgctctcttctctgagctttgagtcaatgtcttgaaagctctattcatcacctttgcagcagagacgggtcaaagaagtgaaatggtaatcaaagacacgcatgtgatatttccccaaatagtgtgacctgctcaacgacacagaccaacagtcctggccactgtctaggcacagagaaaccctcggtcatcactggttgttttgaggaaaaagaaaacactctgggctggccgcgatggctcacgcctgtaatcccagcactttgggaggccgaggcaggcggatcacaaggtcgggagatcgagaccatcctggctaacattgtgaaatcccgtctctattaaaaatacaaaaaattagctgggcatggtggctggcgcctgtagtcccagctactcagattgccccactgctctccagcctgggcaacagagcgagactccgtctaaaaaaaaaagaaaaaaaagaaaagaaaacactttgctgctctgggcagcagtaactttccttcgcctcttctggtcccacccttcatgaacctccacttgcctcgaaggggagaaaataggctaccctcttccagaaactaggcgggtctgctccttccactgcagtctgagtaagacaagtgtcacggccattttctgccttttgtgggtccccgtggcacggctgccgacaacacttaatcacaagaatcaccttcgattcttgtttaaaaagccaggctgctcagagcctgctctaccctttctgaaaagagccctcgcctgtctgggaagccctgcttctctcaacatgctgtaagtgtatacggggaccatattctcgccttccaatttactggccaagtggctagtgtgcagacagttcaaattctcttccctatctcatgaatatttattgaacacctactaacgttaatgggaaaagatagaggtgctatgggaaggatattttttctagatttagaatagaatctatcaccagcgtttcctgactttgtgaagtcacttaagtctttgggacttggtttccctgattgtcaggtaagaacaatatccctctctctggactgtcttgaggagacatggaatgcatgtggaatgtcaatctggtaaaatgcctgacgcctaagtagatactctttctaccagagaaaacccacccaccaagagccctgtcccaaggctgctgtgaatccgcaagtggctggcatagtctgtaactcctccttcaagagaggaggatgctggggggttggttaagctcattcaccagagaagtgacctgcccctgtttaccagcctcatatagcatttttttttcttttttttttttgagatggagtcttgctctgtcgcccaggctagagtgcagtggtgccatctcagttcactgcaacctccgcctctcgggttcacgtgattctcgtgcctcagcctcccaagtagcagggattacaggcgcccaccaccacaccaggctaatttttgtacttttagtagagacggggtttcaccgtcttggccagactggtctcaaactcctgaccttgtgatccacccgcctctgcctcccaaagtgctgggattgagaggtgaagccagctggacttcctgggttgagtggggacttggagaacttttctgtctagctagaggactgtaaatgcatcaatcagcactctgtgtctagctaaaggattgtaaatgcaccaatcagcactctgtaaaaatgcaccaatcagcgctctgtaaaatggaccaatcagtgctctgtaaaatggaccaatcagcactctgtaaaatggaccaatcagcaggaggtgggcagggacaaataagggaataaaagctggccaccaccccccactccaagccagcaggcaacctgctccagtcaccttccatgctgtggaagctttgttctttcgctgttcacaaaaaatcttattgctgctcactctttgggtctgtgccacctttaagagctgtaacactcaccacagaggtctgcagcttcattcttgaagtcagtgagaccaagaatccatcagaaggaaccaactctggacacattaggacatgggcctggagctgctggggccatttctgccaccttgtagggacagccagctcgaggatgaagtcaacagagaagaacggaagctgagaaacagaactaatcattccacctagcacctgggttcagccaggactaacactggtcatgtgagttgataacatttatttttggtttaatccaggctgagctgggtttctttcatgcttagacaaaagtaagtgctgaccaaatcaaagctttttcccttggctgggaaaccctgattccccaatgcaatggctctgctcatgtggtgctgagggcttacaccaaggtggtagagaagtccccttgaatagaactaggctttggactgctgggctgcagtataattgaggtcctggagagggagccagttcagggaagaaagcaccaataccttgagcctcagtgcgaagaagagcagcctggaagcaaatgtgtatatttgcttgaattgatatatatatattaattcaacatcatttatggtaaaaacttgcagtgcaagaatacagtcttgcactgcaagtttttaccataaatgatattgaattgtgtcaatttttttcaagattctattgagataatcatataaattcacttatatttgaatattaaactgacctttaattcctaggataaaccccactgggtcatagtgtattatcatttttgtattaacatactgttgaatacaatttgctcatattttagcagcatttgtgctccatgaagggtattggtctgtagttttctattttaatatatgctttctggtttaggtatcagaataagtttgctcataaaacaaatggggaagagttttctttgttttctaaaataatttgataggtctgatttttttaaacctagtttttaaaaatagaatctgccagtgaaactattggaacctagtgctttccttgtgggaaggtttataactacaaattccatttcgttagcacatacagggttatttatgctttctatttcttcttgagtgagctttggtaatttgcacatttcaaggaatttttacattttctctaagttgttgaatttgtgacataaaattgttcatgctatttccatattagccatttaattaaagtagggtctgtaatatgtcgtttttttcctgggattggtaaggtgtgtcttctttgtttcttggtcaatctggctagaggcctagcaattgtcaatggtactagttttttgaccttgtagaactaccagcgtttgtactcatttccctctgtgtttgtcattttctacttcagtgttttatgctcttatttttactattttcttccttctactttctttgggtttattttgtccttctttttcttcattcatcaaatagggccttaaatgattgactttaggactttctcctttctgatatcaatacaaagttgtcattgcatcttagagctgctttatctgtatttcacaaacttcataagctttgtttttattttcatttagttcaaaatatttaaaaatctcccttgtaattcattctttgagctatgggttatttaaaagtgcattgtttaatttctaaatattttgggcttgtgcatatatcttattattatgattttaaaatttaatcccactgtggccagagaacatacacagtactatgtcaatactttaaaacttactggtatttgttttatgtaaattaccttttgtcatgcacaccagactatgtggtaatgtacaggtaagtcaggtcttgtggaaaaaaaaggtctgattggtagtatttgccaattttcatggtataaatacttgcaccgtggccaaattcaacataatgttactaaatgtactattggaaagaaatgtgcacaattttgtgagctgctacaagccagctccagcacaacactgggaatatggtctacttggtaagtattccacgtgcactggaagttatacgtattttgttgttgttgggtagagtgttccataaaggtctatttggttaagtctcctatatccttatagattttctgtctccttgttctgtcaattactggtaccactttatgtgtgatataagaatcttatagcaatataattcctttcttccctcctgtcctttgtgctgttattgtcacatattttacttatacatacattataaaccccactccacattatttttacattgtcatcaaccgccttttaaggaaaataagaaattagaaaacacaaatttttttttttaacctacctgcatatttagcatttctgggactcttcattcatttgtataaacttgatttctgtctgatattttccttcagctagaagaactttgtttaataattcttataatgcaggtatgctagggataatgaaaatttgtctgaaaattctttattttgtctttacttttgaaggatattttcactggctatagaattctagatcaacagtctcttttcctttcctttctacacactagagatgttccatcgtcttctggcttgcgtagtttcatgtgagtctttattactttttagttattttactctgtacatgagtatttttcctctggtgacttttaagatttctcattttcataaacttggttatgaaatgccctgatatgattttctttgtatttatcctgactggtgctttcttgagttttttgactatgtcaacttatattttcaaaaacatttagaaaactcagctaatacttcttcaaataattttaatgctctcttccttttctttgaagactctatattatgtaatatagttgtgctattgtgatataataaaaaatacatattctggcttttgtcacagcttctggttcccagctcctacaaccctcataatttcccaagtgactagagccataggtgtatttttttgctaaaaaaatttagacttttttcctcagttcctgaaacagctgcatggcaatacaagtgaaaaacatgtgttttattattcacagcaggtctcttacaaccacacctgagtttatattaatgaagtgattatttttggaaagcccttagataatcacaggattggggctggttgccagtgggactgaccatgtgattggagggttgaaacttttggccccactccctcaccttctgagagggaagatgggctaaaagttgagttgattaccaaatcactgtgatataatcaatcatgcttacataatgaagcttccataaaaacccaaaaggacagagttcgaggagcttctaggttggtaaataagaacacattcatgcactggaaaggtggtgtgcctcaaatccacagagacagagctcttatgcttgggacccttctgaatcatttgtgtgtctttatctgactgttcgattgtgttgtttacaatagtctttgtattaaatgggtaagtgtaagtataacaaaatgtttccctgagttctgtgagctctctagcaaattaattaaacctgaggagaaggtcatgggaccgcctagtttagatctggttagtcacaaggtataaaacccagacttacaattagcatctgaagttgatggggacagtcttgtggaactgagtccttcacctatgggatctgaccctgtctccaggcagatagtatcaaactgaattgaattataggacacccagctggtatctgctgaagaactggttgtttgtggaaagaaatcttcacacattttggacacagaagttttctgtgttgtgtgcaagggtagacagaaaacaatgtgtttttttcttcagaatggtagatcactgaatattgtcctttatgtcactgaggctctgtttaatttattagctttttaaaaatatctctttgcttctatttggatagttcttgccttctattcaatcttatttacaacttctttttgcgatgtttaatctgctattaagcctgtctggtgaatattccattttagatattatatattttttggctctaggtgttctggattaaaaaaaccttttatctcttcagtgtgctatgtttttcttaagccttgaatatatttataatagctgttttaaagttcttttctgcgaattctattacctctataatttctggtcttgattctataggtttgtcctattgaaatttattgggttactttttaatttttttttttttgcatgtttcgttatttttaattagatgctggacattgtgtgtttgaagttattgaatgtctagattttgttgtgtgtgtgtgtttttttcccccataaagcacattgagttgtgttctgatagccagtagttcactttcaggttatcttgcacttttgagcttggttttaagtttcatgggatctaaagtagtctttactcaaaggacagctaagttataccaccaaggtgtgccttttatgagacttttcctaaatgctccaagtgtttgataaggtttctttatttggtcagaactcaaatgtctctcaaccataccaagctttagtatttattcagcttacagttccctggtagttactccctgtctggtgattgttctttgcctggcttaatggagtctttacacatttatagcatagtcttcagtcaaagactcaggggatcttcatgacaatatctggacctcctcctctgcatagcctcttcctctttagttttctgccccacaagttccagcagcctcagccttcccaaacttacatctctgtcttttcagctcacagagactgcacgatgtgcttgggttcttgtgaacaatcgccatgtctgctaaatgcttctaggcagaaatctgcagaattgtagggcacatctcctttgttttctttttcttagtcactacactactatgatgcctgttgttcagtgtctgaaaacattcgttttacgtatttgtccatacttttcccccattttagatgatgtggtaggcagaatatggtcccttaaagatgttcactctggaactagtgaatatgttatgatatgtagcgaaggcaagttaagattgcagataaaattaagactgctagtaaattgactttaaaagagagaggttattttggattataattgaaaaggctcctaaaagtggaggaggaagacagaagagagagaagcagaaggatggcagtgtgagaaggatttggcccaaccttgctggctttgaagttagaagaaagaaaacatgagccaagggaagcagaagctggaacaggcaaagaaatggattctcctgcagcttccagaaggaacacagcctgctgacaccttgatttcagcccactgagactcattttgacttctcacctccagatcagataataaatgtatattatgtgcagcaggaataggaaactaatacaagtgggagagctgttctggtactatcactctatcatgactgagaggagacatttactatttttatttttgtttgtttgtctttaagaaaaagatacttgagacccactacagatatttcgatttggtcagaacaggggcattaagattttttaaaattttcttattgttctaatgtgcactcaaggttgaaaaccactgacccagtccaaccctgtcaatttacagctgaggccactgaagtgaagaagagttagaggcaaatgcgagtgaaatttcagtctgttgcaaaagactctgcctagaggaaggagggtaggatatatgttctcctaggaggctgtcttttggcatccaggcatttacaattgtggcaggaggtccgcaatgaacttggatgaggggtgtatgtcctcaaaaatacaggagcaaagaccaacctattagctatgcaaaactgtggatttctgcagccctaaaatcagttctatcagccttattaccacagaagtgcccacctatagacctggtgtgagtcattggttggttttgatcaagttgatgagaattctgctacttaacagacttcagcactctggagaaccacagggtgcattctgccaatgctcatatcaattccttcttcaggtttacatggcaagggtggctctcagatctcaatcattccatgcatttaaaaaaacagtattttcaccgagccagcaggtgccaaacattgcctagattttggtgttcagtagtgttctgcgatttattgattcatgttcaaaatttaagagattctaagattcattccttcatgagctcatttggtaaaagtgtttctcctttcttcttcccaccacttttccatcccttccctttctttcccttctgttttctccctttgtaaagttaaccttagattggtcacatctgggcaggtaggtgcctccgccagtggagcacattcaagttaataaggagttggatcattccaggacaccttgactggaatattttgctaatcccacaatgtctctatatggttcttagctgctacccagcttaggattttaggctgataacatcttacacctttctgtagatggtcagatattgcctctctgcttctctttccacagtgtgttctgagcttttcttggacctcaacttgctgtttagtttaggaaatcttagccagcaagctggcactttgtaggtggctggggaaagatgcagaaggcgaagacaaaagagatggttaacacttatggagtgtgtaaaactgacctgagtgcttgaccctcagagccaggctatagacgggtattaaatattacctttattttatatgagaggagacccaggcacagagagattaagtaacttttgtaggaacacataataaataagtagaagatctgggatttgtgcccaagcagtctagagtcttacgtttactctactgttaaaggatcagccctgcatttggattaaggtatgtagcatctcaaagccatgctccaaaggaccaaaaggcattgcctttgctgctggccatatgcatgagacctcctccataagctaccacaattgagtaaaaacatcagttgtcatagtctctgcattcagacagagtctgaatttagagcctctatgttctagtgtgtgcccctggctatcagttttctcatctataaaatggggctaataatacctctttcagagagccattatgaggattcaaatgaaattgtgtatgtaaagtgcctggcccggagggcccaccacttattcaagggtggacctaggggaagaaacgctgcaaactattgattggcatcagtgaagagccctagaaaatggaatgaaacagttttattttttactttttatttgaaattaaaaagttacaaatatagcacagagggtttctgtacaccttcacctagctttccctaatgttagcatcttgtataatttatcaaaatcattacattaacaacattgggcaatactgttactaaaatacagacttgattcagagttcaccagtttttctcttaatatccttccactattccaggatccaatccaggctctcacgtttcatttagctgtcattctccttaatcccctccaatctgtgatggttcctcagagcatccttgccgtccatgaccttgacatttgaaagggtactgatgggtgattttgtagaatgcccctcagtctgattgtccccccatgatgaaattgatgttatgcattttttggcaagaatactatatacatgaaatgtcttctctgtgcatcctatcggggcgtgtggtgatgttgctacgtcttattactggtgatgttaacttggtcacttgattaaggtggcacctactgggtttctccactgcagattactgtattttctttcccctttataattagtaaatctcttgggggagatactttgagacaattcgaacatgctgcttctcctcaaactttcacccattaattttagcatacatcagtgcgtcttgtctgcaataattattactgtggtgttctaatggtgtttttttatttcccttgttcatgtcacatttattaattggaactcttctgtaaggaagagctgccttcatttatttatttattcaggtacttatttataaccatgtggactcctggatttttattttattctaggagttataatttgatactctcatgatgtattttgttgctcaaattgttccagccttgggccttggggactctcttagttgtttcctctgtccttttggcgtgtgggggcagcatttaccagatcagccaaggcccagagcccagggcacacagtggaggtctgggcagctggagtttgctttaaggctgtgagagctgggaagtgagagtggaatcagaaaagatggtggtgctccacaccccttctccatgtagaatctgcctctgtaagacccactcaactgtgacatttcaccggaccaatcttatttccctgactcattctacagctgaggaaattaaggccccaggaagagaagggccttgctggaggccacagagcaagttgggtggaaggagagattggggagcagcatgggctggggctttgtccttgccatcccaggctgacaccccttcccccacacagtgcctgactgcagagtagcctgttccagaatctgggccgccaagggccgaggaaagtttgttccatcagcagaagcccaggaaatgggaggctcctggtgcaaagtttcttcaggaagccctggggctgttggctctgctccttctcctttttgcccagctgaaagggagggggtattctgttccaaatctccagctccagctcagtgggggcctctaatccccttctggctcagggacacggtcagccaggtctggtggaggtgctcccagagagcagatttctgcaggcctgggaacagggtgccatgaggccccaggcctatccatacaagggctgggaatgttagcagcagagtgcagaaaacaagcacagggttagagctgacaataagttctgtgagagtcaggggctatgttaacagagatccagtgtgcagaacgaggaaggtgacaagccgatacaatatacaggaccagcctgcagtaaattctccaacatctgagctcttccagtcctgactatctgcacaaatactaggctccaggctgtatggagacatatcacacccatggaaaatagaaaaatctccctgaaatcctggaagcacatacggaaagcattggttgtgaggtctgctcaacactttcttacctacagggagctttcctttctaacacacatttaatcctcactgtctccataaggcaggcaggacaggggttaggatcaccattttacagatgccgcagctaaagcctgaaagaggaaggggtgtggccttctccagggagtgcagtgattccagaaagaaccagaccttgcagtcttatgttctgggctttcccacaacagtagcctgtctttggggctggttctccgatatctgacataaccaacagccacgggtgagcagtccctgggttccgtaggggctttggaaagtcctctgagcattactagtgcttctgcaggggggactgtgagcatgggtggatcgggacagagcagaggccccccacaagagccatcagcgctgaccagctgaaggactgagcagagtgtgtgtgtgcaggtgtgtgtgtgcacatgaccgagggggtggcatgtgcttggcagggtctgcagagaggctgttggccaggtcttcactctcatctggctttggcttcatacttccttccctggcaggactggggaggccaaagcgcacagatggccatctggctggcactttaggacacggtccagtgcacacttgcagacttctcctcccccactccttctctgcttcggtggctctatcagctctgcaaaggagagacagggccaggtcagagatgcaccgtggagtggtctgcagggggctcagggcacagcacttctggcttcagaattttaaaagttcagtgctggggaggatgaggacagttcctcccaagcatcactgcagcaactctgtgtcttccagagttttgggggtggaggatacaagaaggggagggaggtaagaggttctggggcaagaggtgagagctggggatgggaactagctctggtcccagctcacatgcctacatactccgtaccccggccagatagccagattttgcaacaatgagtggacatcccagttaaattttcatttcagataaaccatgaaaattgtttaagatacgcatgtctcattgcaatattaggacatgctaaaaaattattggctctttaactgcaatgcagacttacctgggcaccctgtattttatctagcaatcttgtgccctgggtgtgtgggatggtggaccctctgtgggcctttgttgcctgccagcatcacgaagatgatgggtagggccagggacagtggaggacccaccttgtccgtggggatggattcttcctgtttcataccaggcccattgtccagtgatgggcagggcaggcacctcgagagtccatggagacgtgtcggggaatcagtgagtcagacctgctctcacagaacccccagtttcctctccccctcacggaatgggtcagcctgagtgaactgctggcactgttgcacgagaggaccagctcaggggctgtcctgggtcacgagggtgccctttcaaagggtcctgcactgtctgcctatttcaggacttctcctgcttgtcatctaaccctgttcttgacaactgcagaaggaggccagagaggggaataggattgctaaggccacacaacacgtagtgatgaagccagaagcagccctccacccacccaactccctgccctgtgtcctttgggaaaatacctgcctggccctgcacagtgttccctgagcagaggagggttatccttgggaccatgggggttctgcccaatgaagcctaatagagcttagagggggttgcccaaaatgtgttacatttcttgcagccaatctggccttgctaaccgcttaagcacaaacaattccatatgtccaacgggctgattagccacagagagatgggaaggggccggtcacaaataaggatctatattaacgaaagatccagtgatagaggtccagctgaagaaaattaaaaagattgtgttttcaaacactgccccccaacagaggaatttttctagctacaagtgagtgccttacaaatttcagacactaatgtattgacaaaaacaaacaaacaaaagttgaaatgcaggaaacctcctgggcccgatagaaatctcaatgaggtcctatctgcttgggtttgttaaaaaaatgcaactaacaataatatctgacacaaaattcttccatggtctggacgcctctcatccattgttctctggaaaaatgtctctttaagcatctgcacgttggcggtcgttagggggaaagagctcagcagagttttgtttatttatttatgtccttttgctgtattctgataaagcacaggcaggcaggcggcacagcatctggcttcttggaaaaatggctgcatggaggattgggggccctggctccagacacaggggcatgagtgggggtctcagagcacacagtgattccatcctctccagcaactggtgctgcagtgaaatctcccaggggtcccagcttcccctgcggacattccccagtccttctcggggcaccccctgctctctccttagttctgaggacgaggcagcctggctagtggaaagccatgagttttggagtctggcagactagggcttaagtgctgctttcactcctgattagctgggggaggcagagtgaggagccacatacctcctggcctccctgggaaacgagttgatccttcctgcctcgcatagccatcaaagggttcactagcacaggggacaggcactgacgactgtcacctcatttgcccagtgggatgaagccttcctcccctgacccagcatggattcagcctaaagatggtctctaggttgcaccagggaagctcctgcaggcacggacagtgcctctctccctccagacagaccctgtattaggaacccgagtgagaacataaaatttacttgctgagtgtcttccaatggcccaggaaaggctctaaagatcggggtgtttcattccagggaactgcctgggacataaatgtgaattactgcagttctgcagcgtccaacaatagcaccggtgtccacaatagaaacttcagccatggcggctttgcacactgtggctactttgctaaagacctcatgtaaatcagcatgccccccagctgccacagaaaaccccaagttcacttcccccaactccacactgctcagatgccggaaagttcttccttctgtggaacagatcatctgtctcctttagcttctgcacatttaccttgcttttgccccacagagactcccaggccaatctggcctcctgcttggggacaagtcacccaggggattaaagacagatctcaggccccacggaccagtcctgccctcagtctgcatccctgctccctctgtggtcttcgttggagggtctctgcctgcctcctgccctccccttgcctatctctggtctctctcctccaggactcagctccatgacaacaggcctctttccttggcaggaaacccgtgctgaagcctggccatgtccaagagtgccaatccaagagcaaaaacacaatccatttcatttctgtaaccccagcttcctgattcccagactatggtggagctgatgtattcttaagtaggaagacacatttatttcctctttaatcaaaccaggaaattacctggaagattcagagagtttgaatcacttgtgtaaggtcacacagcaactcagtagtccggccatcttgggaaaccaagactctgacctcctggactgggttccttcctcgagaacctctgtggtaaccagtttggctcttcaggctggggaggacctgtagctgacagcaatcgacgagattcagtgctatgtctattgtaagtgtctgtgttgagaaaacggaaaccacagaaaaaccatcagaccttcccagggctacagacacactgggcttctgtccacctgctcagagtccaacatggatctggaaatcagctcacctgaaggccctgcagcccagtgcaatgtgtctaagagcaggagaaggagaggaaaagcatgcacagctctcctggctcccccacccccagaggaagtccaaatcattcagaaaagcagataccagaatattctgaatttccagtaaggtttcccttcccaggaaacgtgtggtctggggaaggacagagacacctatgggtggggccgcgagcccctccggcttcacaggaggaacatttcctgagcaccatggcccctttcatttgtagcctgccacccccagtggaagtgcattaaaaacacacacacacacacacacacacacacacaatgcttcagaggtctgcctttgccaggaactctagaaataactcgctgagaaacatctccatctcatactcaccacctacagagaaaacggtccaatacgctggcagcttggcatggggagaggctcagagaggggaatgcaggagtgaggctgtgtggggggttggtgggggccccacggctcacaggccatagctgtcagggccctctgcacatctgggctcaaacaccggccctgccacctgctggcagtgtgactttaggagaggtgagcaccctctgggctttggggacctcatctgtaaatggggctgatcacgtatgaccttgtccacagaaaagttacagcatgccgggtaggaacaaagtgcagctggttctggagtccaggcaggataagggaaggtccctggatgagaaaggacaatgcaggatcagaggggccagtggtggcaggttcctctcatttcctcctactgtgaatgcattgtattctctgggacttttggtctgttatcaggagagaaggacaaatgatgtgttaagtctagctagcacccctattgtgaagatagggaaactgaggcccacagaatgtgggtgtcttcctgaagtcacagaaagggaagctgctgagctaggctcttgccacccatgctggactgctgccacccatgctggactctgcatgtcctagcaaaccccttggggagctgtgcacctctgagggcatgaagcctgggcacgtctgcaggaatccagaatgtgttgccacccgggcctgtcttctgcatttccctacaaaagtgaccagcactgaagtcaaatggacagctagagaggggaaagggacccagctctgtccctttccaggttgtggcatggtgcatggggcttgactctgtgggcatcatctgcctatctgtgaaatgaggacatgactcttacctcctaggaccactggtgagcattagtcattcatcaaacaactactgatgggtattgattgcctaagttccagccactattcctggaactggacaacatcagagagctaggcaggggctctgtgcacacgcttctccctctctagcgaggcaggcagccatgtgacaagcaaaagagaaacacgcaggatcatttcacattgagataataataaacagtgcagtgtgagggcaagtgaatggtgtgcgttgggctgggagctgtttgaggatgagagggaggcagggggcgacagcacctgccaggttgtagaaaccacaagtgccaagatcttgagtgtggtgggagtggggaggggatgccacggggaagtagcagggcctgctgtgaggctgagccgggcacaccagtgctggatgctccatcacgttcgggctggatgccatgcaggagtctgggggcagccttcacagatgccccacactttgtgggcccaggcaggaatctgggcagcacaggctgatgtgtgggctctctcggggcacaggtgcctgacccaggcctggtgggaaggtggacgtcgatgtcacagagtgtctggaaggtttccatctgcctctggtgggctgacagcagacagggtgaagccaaaggacagggaatgtaaattgctgaaatcacctacccctggagccttcccagataacataggcattctgaggagaggttgtggtagagacacagaacaggaagagagaaacctacagagcagactgcttgtttggatccacagttccaggtgtgctctgcagatcaccagttccctagtctattagtccgttctcgaattgttatgaagaaatgcccaagactgggtaatttataaaggaaagaggttcttattttattttatttttgagatggagtcttgctctgtcgcccaggctggagtgcaatgaagtgattttggctcactgcaaccttcacctcctaggttcaagcgattgtcctgcctcagcctcctgaatagctgggattacaggtgcaaccatgcccagctaatttttgtatttttttttcttttttttttttttttagcagagacgggtttttgccatgttggccaggctggctcgaactcctgacctcaggtgacccacctgcctcggcctcccaatgtactgggattacaggcgtgagccaccgtgcctggccagaaaataggtttaattggctcttggttctgcaggctgtacagggagcagactggcttctttttccggggaggcctcaggaaacttccaattacggtagaagacaaagggggtgctggcacttcacctggctagagcaggaggaagagagggggaggtgccacacacttttaaacagcgagatcttgtgagaactcacgatcacaacacagtaccaaggggaaaatctgcccccgtgatccatccacctctccctaggccccaccttcagcagtggggattacaattcaacatgagatatgcatggggacacagatccaaaccatatcactgagtttagtggcattcctaatgcattcccctcctttctttataagagtttattcaggtatacactcttcatgggcttcaggtgaggcaggccccagtcccagttcctgccccaagactgatcaaggaggaaccatgatcagtttcagctagaagttctccaatttcctatgtttatggggcccttagtctcagcaatttttctcactgtgcccctaagctaaaagaaatatctaacccttctgctgggttaggcccagacagcttagtaagtatttaggccctaacaacttagccaatcgcaactagctaattgtaaagacactatacgtgaactgaaagaaaaaaggtatacttttaattaatatattctttttttaattttagaaacttgttaaaaaacttttttgtaggcaagtggaacttaatttggtaaaaaaatatatgtttttatggtatataacatgatattttgatatatgtgtacattgtggagttgctgagtcaagttaaataacacattcattattcatatacttattttcttgtggtgagaacacttaaatatactcttagaaactttcgagtatataatacgttgttatgaactacgtcaccatgttgtacaacagatctagtttattctactataatcacttactagtggaatggatgcacctgttgggcactgcacaacttctcacactgtgtgtttggattggacaccagcacccccatttcacattccacactgattttcattccatacttgttttatttcagcaatcactaaaacttctcaaagatacgatatcatcaaatgtctgtagcatgattaatgttgaaaccatgaataaactgagctaaaaagtagttcaagtgggctgggtgcagtggctcatgcctgtaatcccagcactttggaaggccaaggtgagcagatcacgaggtcaggaggttgagaccatcctggccaatatggtgaaacccccgtctctactaaaatacaaaaaaataagctgggcatggtggtacgtacctgtagtcccagctacttgggaggctgagggaagggaattgcttgaatccgggaggtggagattgcagtgagccgagatcataccactgcactccagcctggcgacagagcgagactgtctcaaaaaacatacatatataaaaagaaagtagttcaagtggtgtccaacagatgtccagcattactgagttttccttgaaagcttaaaatatcccctggcacccctgaatttggtgtggcaatctggggtgcctcatcccttagtttgggatagagtggacttgaagccgtaaatcatctgtttaggtaagagactgtgatgcaattccggctgatgaaatgtggagagaagtcttttgagagattcctagaaaagggtctcctcaccctatcaaagctgtctgggaggatgccttctgctgggggctgttgcagagtctgcgtaggaacctggacccgcagctgccctcttggacccagaggaccactgtccccaggagaagacactggatggtgaaggggatggaggggctgtggctttggtggcattgtttggctgctgaagcctggaaatacccatctctggacttgctattttgtaagctaatgctgtcctggaaaatgtagcctatttagagctggatttcctgctcactagcagcaaaaaggacccttcctgatacactgcaaagaatgtttgggaacaccacactttctattctccattagggtcacctattaaagtctctgagaaatcccacaatcctctgtttactttggttcagtacagtttgccaaatttacttaactgagaaaaccttttttttctgtagaacctaattatacctcacagaacatttgtgtgccaaaaaccacatttttttttttttttttttgagatagagtctcactctgtcacccaggctggagtacactggtgcgatctcagctcactgcaacctccacttcctgggttcaagtgattctcttgcctcagcctcctgagtagctgggactacaggcacgtgccaccacacccagctaagttttgagtttttagtagagactgggtttcaccatcttggccaggctggtcttgaactcctgacctcgtgatctgccctcctcggcctccccaaagtgctgggattacaagtgtgagcaactgcacctggccgaaaaacacagttttgaaaggacgccttagatccctcctcacggcccctcatcccctacccaccccagaagcccgtacacacagacgcccacctcagcagagtgccagggcccacatatgtttctattcaatggggaagactaaccaaagccagatgtacctgggcagcccacaggcagaggaagcaatgatgtcatgttccagccacgcagggattagctgccagaaagcccccatggaggagtggggcctggctgctaatggattcagcaggagcccccctgtaggctttacacgaccaaagtgcatgactgctgtgtgtgcatgatggccgtgcctgtgaccactgtgtccctgactgctgtgtgtgtgatcactgtgtctatgaccaccgtgtccctgaccactatgtccctgactgctgtgttggtgactgctgtgcccatgaccactgtgtccatgactgctatgtctgtgactactgtgtccatgaccactgtgtgtctgattgctgtgtccatgaccactctgtgaccactatgcccgtgactgctgtgtccttgaccactgtgtctgtgaccgccgtgtctgtgaccgctgtgcccatgactgctgtgtctgtggcctctgtgtttgtggtctctgtgtccctgaccactgcgtctatgacactgtgcctgtgactgtgtgtccagtgccaccgtgtgtgtgggattgctgtgttcaagagcactgtgtacttttgggctcagtccctctgtagctcctaggacggggccctactgttgctgttgtcagtcctgccacccaacaaggcagtactctgtgtatctttccttggctcctggtcatgcctcctctcatcccccattcttggcctccctgacccaggaggaggacagagctctgttgaccactttctgcatgatttaggccatccttctctactttggagcccagagagtatccgccctgtgattttccaaaagtgtcccctggcgaccattggtttctgaagaggaactgtaggttatgtgtcggggtgaggagggtcctagctgctgcccttgattcaaccaggacagctttctgctcatcctttttatccactgggttcccacagagtatttcattggaagaacagtttttgtggcaggaaaaaatatttccaaagtaatgatattgaccagtattgcgtttttgcaggaaggactggggcctcctctctatgctgtggaatccctggagatttgtgggagagccagatggggtcagggcagaggaacggaggagaccgcctgcgaaggcaggagtttgttctccctgttgactttgcctgccatgacccaggagaaaaagccctttgaaaccatcagagagcagtcaggcagacccacaaggcatgcttctcaaactctgggtcactggtgaggaagcaggaggcaggcagagaagtacagccttggaggcggaatgcattttattttctcagccaagatttagaggctgatgctgacaccccgaccaggccaggcacctttgcacgagagctcagctcagctctggaccctcagaactgccgggctcagtggtgtgcatttggcaatgggagcccggcaaggcatgtgcagggataactgcaccatcaggcacagtgggcacggtgcccactgcccagaatacttgcaggtactctaaaaaatgtttttatttcttttaaaatcagaagaaaaaaaagctttcaggttgaagaaaatctttcaatatatcatatttatgtattcgtctttacaacaatgcagttttaaaataagaattacatatttatgggggaaggggtccattaagggaaaaatgcccgccgaagtgctgatggagttataatgtgtccctaagtaaatgacagtgaatttcagaccttgtgttagcttgggctgctgtaataataccacagactgggtggcttaaatgacagaaatttattttcttgcagttctggaggctggaagtccaagatcaaggagttggcagggctgactttttccaaggcctctctccttggctcccaggtggctgtgttccccctgcatctttccatcatcttctctctttttagatggagtttcactctttttgcccaggctggagtgcgatggtgcgatcttggctcactgcatcctcaatctcctgggttcaagtgattctcctgcctcattctcctgagtagctgggattatagacgtgcaccaccacacccagctaattttatatttttgtagagatggggtttcaccatgttggccaggctggtctcaaactcttgacctcaggtgatccacctgcctcggcctcccaaagtggtgggattacaggtgtgagacaccatgcgcagcccctggtctccactttttatactgatgccaatcatactgaattagggctcaccctaatggcatcatcttgacttcatgaattctttaaagtctctatgtccaaatatagtactgagcattagggctttaacatatgaatttacggggacacagttcagcccataacaaatcttcttgcataaattcatgctctttctttgcaactgcctttcccttctcatctctttttttcccagagaaagagaaagaccctatctaaaatgctttctgcttcagagagcatcagaagggaagcttgcccaggctccctggttctttcttttgggctgtgggtcaaatgctgtccagtgctgacctggacaagttgaggataccagaaggaatccaaggcgccactagtgctgtgggtggaccctggtcatccccctgcctctggatattagaactcagtttagctacattcgagatgtaattcaaggggtcactggggaatggttatatgtgatgcccaagtgtgtggcttcatggtcccccaaagaccaggtgccagggcaacccttccccacctgctccagcactatccaccccatcccagtactgtcaattatatggggtcaatggtgtggcaggaggatggttcttggtattaaaacggatccatttccttagggttgaaaacgtagaggatccaagcagatcctagcctcctgaatgccaggaattcttgatgttttattaggattttgtcaagaaagggggagtgagagctcctcactgttcctgattcaatgaaactggagagcctgttctgctgcccttgaaaattcaatgttactttcaagtgtggaatgtcctgtaatttttgtgaaattggcttttattttaaatgagtcctactgagggtaatccaaacatgaagacgagaaggaggagaaggagaagggaggaggaggagggtgaagaggaagagttccagtggcatgagaaagcagggctgagtctgggagttggattccctcttgtcctgccctgtgatgtggtggcattaccttctctggagtctccaatcctaagacactagcctgaacatgtctcagcaatttttcccccatggatttgcccatataccttgatggatcttacgatatttgccataaaattcagggtcaatggtcatcaccattctagagcgagtacccatccaacctggagcaggatgggcagagccagggcatggggctgaggcctggtactcaacctggggagcagaggatgcagaaggaaaggagccgatgggctccaggcaatctcctctctccacctggtctcccaccagagggacagagtgtggcctgggaggctggaggtctgggtttggcccctccgaagagacccatttcatatgtggctttgggctagcctctctgttcttaggctccccatctcctaaatgagggagttggaccagatgagttcatcaaagccactgggtaccagccaccaggtgccagcctcaggtgctgaagatgcacaaagacacaaagacaagcccatagccctcccggagccaggtagcctgctacaagccaggcttgttcacttgctcatttttcctgcctgaaatacatttatttttttctcatgatgaaagctactcatgcttattatttaaaatatatatacagaaaacatggccaaggaaaacaaagacagaaaaatgatccccataaatctcacccactcagagacaaccatgtttagtgcttggattttcttccagaccatttcctatgactagggacactcatacttaaatataggaacaaaacaggatcatagtgcttattttttctgagtcctcacgatcattctatgagtcagttagtagtagtatttttactttatatatgcagaaacagagactcaaagaggctgagtaactttctcaaggtgacaggactgtgactcaatgccaaattcagctgacgtcaagtcgaaagctctttctcaacacccttgtccatgagggagccaggtaggtaaatgacggattgttccagcattaaccaaacctcacagaagctggagacccatgcacttgttttaggatagctgagtaaaggtcacaagcaagtcagcctttgaacggtgttcttggaaacaaggggggctttgtcaggtggagaagcagcaaggaaggtgcttcaggcagatggaagaaacaaacaagtcaaaagagtgaaggtcaatcaagttcatggctccctcagtacaagaaagcagccagggaaattggatatgcatagacaggagtgtgtgtgtgtgtgtgtgtgtgtgtgtgtgtgtgtcaggggaggcaaggggatgtggcaggaggtgagcttgctggagttaggctgaggaaggccataaaatatgctgagcagttcaagctctcttcttaaggtgatgagagctattaagggttcttgatgggatatgaatggatcttttagggggacactctggaggccctgtggagggcggattggggtaaggggagtcaatcatctgattctttgatcctctttccaacctcaattagcatccccaggaaagggaggcagaaagagtggggagtgaggtcccatgagtcttgggaagatggctggatgcccaaatactccatcttataaaaggctcacctcatgggctgatgaggagggaaatgaagccagaggtgtgtggtggaactgtgaatgagcccaccccttagagggaggaagaggggaatgagggactgatttaatggtattgattcctgctgtgtcttatttctgaaactctgctcggctgtctgtgccaacatctgtttgttccatctccagcatgaggcagggcccctttctttccaggactgggttggcattgcttaagtttgcacttgggtggtttttttctgggaggattgatgtcctgcactccaatcagctgggtcaggcatgcactccaccttctacatagtcccatagacatcagaaaaggttcggggtggagcagacataggggctcacatgggtcaggaacctgggctgccaagggagcctctgcacaaagggccagagctgtgcaggtgacgggtgtgtgcaggtgcgggactggagtcatgaataggtgacaggtggggacaaacagctgctggtgagtataggttgagtagctggatgaaaaaatgaatgggggagtgaggctaggttatactgtggcaaaaccaaatggcaaagggttagtttgttcttgtgctgactgtcctttgggacttgggtgccaggttaggtcgtctgagaaacaggctcccacatgggagtagctatggctttattaggggagatgcctgtgaaggataaagggtgggggagcaggagaggcagggggaagctttagccacagtgcaggtctgacacctgggaaaggagagagaaggaaagacggggaaggaagagcctgggattgcagcatggttctgcggagtcctgggccaggctgatggcaagtccctaaaccaaagttgctcattagcagaatcccacatcaagcaggactgagagttctaatattcaagtcatggataccagccatttgcatggaacagccaagggaagccagtgtggcctgggaggaggacagagggagatccacagggaatagctggtggccgtgggtcagctctgcctagagggaggctctttggaaggagcctctgagagggacgcctctatggctgctgtggttggctgggaactcggccgcaggcactcctcattcgggaatccaggctttttttagagaacccactgtctagaattttgctggtcactatgacagaggaaaaagataacctggaggatctcacactgttaattaaaggctctagtccagaagagatgtgtgtcaactttactggtgaccattggccagatctgatcatgtgaccccaggatccaggaagtgagagtccaggaaggggtccaggaagtaaaatcagccaccgcatagtaggaggagagctgaaaatacttgaacagtgctaatgcctaccacagtatatgaaaaggaaaatgaatgaatgacgggaaaaagagatggatcaatggaatgactgaaagaatggagaagataatgaaggaagagagaatcaaggggtgaaggagtaaattaaggggtaagtaagcaagtgaataaatgaatgaataaagaagtaatgaaggatgagtgtggcctgatggatgaagcagaatgcataggatgtggatggatgaatagtgagagatgagaaaggatgagctaaggagagaggccattgagcctcctttgctttggaagggtaacaagcaaagcactccccttctccccactgccacctccagccagatgcagctacaatccaataattgcaccaaccagcagtccctgaatggttactgcaaaggtgtctctctagaggccactggggctgcaacacagggccaagaagggacagcctttccttccctctgacagcacggccctgtattgaacagctttgtgaacatattctgggactactaacgtctgtgcctgcctcttgcagagagggcttgagggctgccagcacattgtgatcctcttggaagcagcagagaacctccccccaacttaaagcccacctcgcttttccagtgtgcccaaatccacctgatgagaaccctctttcgctttaagctttggctgttaagaagtcttcttttaaaagaaggaatcctctaaataaacccactcgcaattattgaagagctattgtactggtcacagtggaggccgctgggatgacagttacaaaaggaccatgggcaagctccttccctctttagcctcagtttcctcatttattaaagtggaaggggttctgatagatcctgttttatacaagactgagcacaagatactgggtgatgaatgcagttccttggtttgacggttacagaggagctgagttgcactccctttgtcctcatagatgggaagtggtcctgcccttgaggtctcaaggctgacctgttggtgagtggaaccagatgatcaggtctagtctagattaaaggactagtgacaataacttggtttgtggttgctcccaattcaatttgctattgaacagcaaacaagcagggctgcaagccagtgaatatgggtctctgtacatcttgactttcaaagtgtatctgaagttcaggactcaaccactcctgcacaaagtgggagatccgccaggccagaaagagctgggtgctgcagactcaacgctgttttctgtaaactttcagttgaagtgtaatatacatacagaagaggtcatgaatagtaagtgtacagtttgatggaatttcccaaagggaatacagttgtgtgaccagtactgtaatcaagaaacagaacatgtccagcattccacagacctcgggatgcctttgcatctggcttctctcagtattaagttgtgagacgtcgccacactgttgagtgtagctgtgctctttctcctcattgttgtgtagtattccattgcgcatcactgcctcttatgccttagactgcatcagcattcaaggttctacctatcacctgtgcagcaatttcttgctgccctgtagtgacgagcttctgcattcaaatttctgttgcattatcaagctcacagttggcctgagcaggatctgtcactgtcgcaaaaactatcagcggaaggaggcagcagccagatccccggccttgatctgaaaccaagtcagcaacacccagtggagatagggagtgaagcagagggttagggggaggatgtgctgccctcacgcctggaacaagcccatgtgggctctaccaccaccacaaaggcgggtgattagggctcattagagtaactgtgatgatgcaggagagatatcacctgggtgtcagatttctggccacctggcaaagaaaggtgtgtgcaggagagaataagcagggccaggggcagacaggctcttacctgcaggcaatagatactatggccttgagtgtgcagatggcagcaaggacactgaggcagtcagatggttaggacttgtgcatggataggatgggaaggtgaagagaaggagcaggaaggggaatggctgaggtgcagccatccacaaaaccaggggctcctggatgggggtcagagcagactgtgggcttctgaggacagggccctctctccttcttccctgtagccccctgtgcctggcacagggcaagcccacaagtggcactaattaaagtgtgagccatccctcttggtcaggatatcccatgtcgggatctgcaggtgagacagggaccatatccctcctgcctccccacctgatcaggcttcatcaggtctccagggctctaccagctgtcaggcagctgcagggatttggctgctgctctgcagggcccagggaaggaggcagagttgagtccattagctcggtgctgttctccagggagcacgcagagggattatctggctgctttgccgcctcctgacttcccaggaccacccctttgggactcgatccaaggaagtgagcgatcccctcattaggcataaggagtcagtaatcctgccactcctcctccgtgagcctcctgtgcaccgagtccagcctcaggaggaagcaatgggctaggcgggccaggcctggcttctagcctgggctctgcttttcactcagagtgaggcctggggcactccccatcccttctgggctgtctttccccatccgcaaaacgagtacccttttgtctgaaagcccttctagctctggtgtcctccaatgtgtgaccagaggcagacccagctccatctctgagtgggcctgggggactcactccccccatctgtttactgtttcctcttcttccctgatgcccagcatggtggatggggagtataatgaccctgacttgttctcagtggaaaatgatggccaggagaaatgtgaagtgttagttaccacctgccaaggacaaactgaaatgactagtggtggcccgttttgggagggtagggggaagggtaggagccagaggcattccaaggagaagggagagacagaaaggggtataataaaaacaagagccccacatattgagggcttgcttaatctataccagcacgttactaagagctttatgttatatggcatctcacttaattcttaatatcaaggacaaagccccaaagccccaagcctcagggactcagagggtgaagttagtttccagtgcaaaatgaggtagaagatgatggagagaatactccatggtcccagagggtctccagcagatttgttctggatgagagtattttagacagtcatgttaacatgtcctgaaactgcactaggttcagtggctgagaatgttgatcgaaagctcaggtgtgcaagaaaaatggaattttctcacttttcctatacaattcaatttctgtttctggtccccattccaccaaggtgctagacccaggaccctgtacatgaatgacctctccttgctcagatatgtgagttctgggagctatacaagtgtaggggtgggtggggtgctgggtccttgtgtgtcctggtttccacaggcatgtccttcaggcacctggccctcaggtgtgatcctgtaggtgatgcagggcactcctcacacttctgtaagtcccctgatacctaggagcattctctgcccctccacaccaggcttggccacccacacagtccttctgctgccttagctacccactggggcatgaaatgctgcgaagccgcctgagctgccccttctgcctagaaatatcctgcatctccttttccagaactttgtctcctctctagctctttccgggctgtaggggtatgggcctttcccttattgatttcaccaatctatttgggagtcatggggccttcctggagagggtgtgcagggctcgtctctcggggacacactgacaactccatttatatcccttcttccaattcccttgcactgatcatcctcagggaaacccagacatgggagctgggacacttgctgttactcactgtgtatcctccacatcctttatcagagaccagcagtcccagtagggatggctttctggaaagacatgtctagtttctctgcttcctgcagctccatcccttcccccaggtagttagacagacctccgggctctttaggaatatgggccttggtgagaaagggaggacctacctataggaatatgggccttggtgagaaagggaggacctagctaaaattctgtgtgtacaaagacagaggcagaggcttcaggggaagagccatgccaggcccagagatcaaggaacagagccaaggtgtcctccaggtctccatcccagggttgtgggacacccccagcagggcagcctgccaggccagccctcctagtgaaggctcagacatcctcccaccacagctctgatctatccattccagcaggctccacaaacagaaggagctccctagaaagccaccaagacccctgccatggagccctccaatcagccttgctcctgccaaatctgttactaatttaagcaagactctagggggaatatggaagacccaaatgtatgcgctgtgggtcaccaaaaggaattctgccatgagacaggattcggaaccacagtgttttggcttcctcttgtgccaggcttaggggagaagtagtttgtccatatcacccactgaaataagaaagtaggacctcctctgtctgcccccaaagcccacaagattcccaatatacctcattgtctgggaggctttgtgtggctactaaagtctgtcttccccctggagaagttcactgcatccctcccattttggagaagggaagagacacgcagtgggttaatggggagtgtgtttaaatcacagagggtgagctcgtgtcttctttgtatgtcagcacacaatctgccatctccccaagtctgttctgcatgagtgagtgagagtgaccccagtcactgctgtcatcagcaacatacaggtcatggtgccaaggaaaaggccaatcagaccagatgtaagacctggatccacccctacctgcaccccaaggaccggccaggggagggtggatgtgctgcacaccagagcctcatggagcttttcaaaagtgggtccctgagacaccacccaccacgcctggggacgattaatagatgttatgggaacaaaggattctgtggtcagagagcctgggaaatgctgagtcaaaggaggtcgagcatgtttcattattgtaggaatctttagctgtaaatatgctgtatcttgtttactctcccagaaggctgtagaatccaggatcctctaacttaatttggtcgtaactggccctttctctgaagtatggcgagcatcacttggcttcctcaacacccttctgggaagcaaggctctgatgctcattagaaaataatccctgggaaggatgaacagacaaataatgctgggtctgtgggggtccagggaggcagcttatggcaagggcgtgtgtgtcctgggctttaagaaaggatgaggctttggaggtagggacctggggggagaaggatcttgcagaaaagccagtgccggcattggaggcatttgagggtagtgggtgtgaacagcacatggtgtgcaatttggctgtgtacttaagagggagaacaggtgcatcaggttggaaaacgaggctagatttgttcttataggttagggtgttatcacagcagaatgcatggtctctgcaaagggtcccctatttacagacacctcatcactgacttcccgtggcccactgacttcagaaatgaggatggaagcctggcagagaaagaacctctttgcaaaacatcaggctctgggcctcttctttgtagtgggcagtttccttctgacctctcctttctgacaggagagtggcacctttctattctcttcaccatcgtaagagcccagagagcctctgctttgttcaaaagccagaagagaagaaaaggaatggtatatcttccagatcctggaaaacctagatgcgtgtagccaggaaagcaaaactgttcattaaaaccaacctgggatcttgccaagtgggagaaagagacttggggccaggagcctcggcaatgggaaggagcggagtggtagtgggttatttatactccacttctggcactgtctgcctgtgttctttcagctagaggaaatgctcccatccctcagacagacatctgatcattataatttcgtgtttgaagacagttttagcctcctgcagacacacataaaatctgcatccgccgcccaggatgggggacataaaagttctttaagagggtggtagaccttcgcgggatagaatccaggctgtctccagctgggcactggggcaggcttctgcagctctgctcacacaccacctgtccactctcaccttctccctctgcccactcggcagaatctacccatccttggaggcccacccagacgcctctcttgcaggggccctcgctgagtcttctctccctgactgtcttggtactttctctccccccagagttgatttagttcacttgatgttatgctacgctgcctcagtccctagctgcctcttgtatacataaccatatattgaatgggctgaactcgacggggcacgaacaggaaatggctttatttctctcccttggatgctttcaaacatgcctggctagatcttccccaccctcctgatggcattgcaggcatgtaccagagcctccctgtcacatgcagggatagaaagtattttcctctcagatattaaacaggtcctatccggcccacgcacagcctccacggacatccagttcaaagtttctctctcccggcagcttggtgggcagaggcctgcggtggcccagggatgggttgtggtcagttctttcttactcttcctttatgtcctccccaaaaacagatgctaaagtcctaacccccagggactcagagtatgaccttatttggaaatagtctttacagaagtgatccaattaaaatgaggctctaatccaatatgatgtttccttataaaaagggaaaatttgggcagggcgaggtggctcacacctataatcccagcactttgggaggctgagacaggtggatcacgaggtcaggagttcaagaccagcctggccaacatggtgaaaccccatctctactaacagtacaaaaattagccaggtgtggtggaacgtgcctataaccccagctactcaggaggctgaggcaggagaatcgcttgaacctgggaggagcaggttgcagtgagtgaagatcatgccactgcactccagcctgggctacagagtgagacttcatctcaaaaacaaaaaacaaaaaaacaacaaaaaaatgggggggtggatggtggggaatttggacagggagaccgacaagcagagagggagacaacttggagatgagtggggagcagccagctgtgggactggagcacgcatctctgagccgggagattgaatgggccagaaagatcatcccctgggcccgttaggggaagcgcggccctgcccacaccctgacttaggacttctggtctctagaactgtgagccaacaaattcaattgtcttaagcctctgagtctgtagggtttgttcggcagctctaggaaatgaatgcatccaccttcgtcctgctttccccggggccaggcaaagtgaggagctggagaaaagcagaccctctctttttggatggccactgctgccacctcagttcaaggagaggctttcaaagtctctgtcaaggcaggtaccccagtgctgggtgttctgtggaccctcctctgtgacccccggggtgggtccccatcacagtgccagaaactgctcgccttctatggcctcttttcagccctggagaagctcacattctctttccagggcaaaggcgggcctgcaggctgctgcagctgcccttggcctcaccccactccggccagcctcctgtcctgagttctaaggtgggacaggttcagttcctactctaagtccccacccccttcccccacaacccaggggacatgtgataaactcttctggaaatttctgtgcctcatggtgggcttggagtttctgcagtgcaatgggcctccaactggggaaggaagcatgagtcttctctctgtacaggcaccccaatctctgcaagaggttctctggagcccctgctagtagcttacaggagtgcacggagcagccgagtcacagtattttacgtaaagtttcctccacattcacatcaattctctttcttctgcttaagcagggtggatgtggactgaggaggtgaggagcaggcagtgtagaagcctcttaacaaatccaggaggaaggaacctggtagctataccccttggatggtaggggcatttgacacccattgtcctgggctttggggtttcagtggaaggagtcccactcctatccagtcccttaggagaacaagtcctagatgtaagagattggaaactccctgagcacaaggggcatgggctctgttttcctctcccttcacgtacagctactaggccagagagagcccaggctctggagtcctgtggacccaagttcaagttcctgctcagttacttacccagctgtgcatctcagggaagtgacccagccttttccagtctctttcctctgccggcttttacgtgggagtggaaggcaaggaaaaaagtgcctgctgcagagtcaggtccagggacacaccagcccttgcccccacagcattttggggctggccccatcctctgaggatgctggaagcatgcgggtgacactctggtgaaggctgtgggtttctcctccagcgaagtttgttataggattcaggttaagaatctctgtctgaactctcagtggcttatcaccgaattacacgaaattgtttggtaaaggaacagcagaaagagagccaaaagatattggtagctgattggggtccctgagtcatctgagatggtgactaagtaacccagcactttgaaaagcctggacctaaattcccaggggaattttttccccacatgcccttcccacaacatactgggctggatccaatcccacctagtactgttcaaatgcaatccctcttgtgcattgagcagtgtgctgtggcgcagtctcagtgattcctaaagttgactaaaacatgccttctaaagggaaagctatcattgcagacccccagtgttgataagaattattttgatcatattgttacttaaatatatacaaacataaaagtaagtataaatctcttatgcttttagctcttacacagctgtaaaaccaaaacacaattacaaattaaatgcaaataaagctacaaaaccattaaaattcaaattaatggcattaatttaatgtgacagatgatgttttgctgaaagtaaaacaaccaacgttgggtttaataatagaaggatacattcccatttaagttccgcttgttatcaactagatcattttgatgtttggacatgctagaccatcattagagttattatcaatattattatatttttcatgtattacaatgaacacacttctaaacacagacctagaattttgatgaagcgatcaacttaatagagcacttcaaaatataataatttaaaatatatagaaatatgtaccatttagtaagactatataccatttaccatttccagctgctagtgttgtcttgcaagttgttgcaaaccaaggtggcattcactcaggcacctgcttgcaaaacagtgactacaattctaccagcttcaatgcagagcagcttatttgtggcatgtctgtgtcccctgttctgtttgatgactcaatcctccctccacttatctctgtttgaacaattgctaaacctttgtttgtacagcagtccatgaagtcatttggccttcattttgcaaaaacatgatagtaaacccaaatgcaaatgtgaactctgcattcctgaagcattagttggtgataatatgatcatccacacacaaccccaatagggtctcactgatatttttcaatttttaaaatgaaaatatcagaataaaaaaagactctcatatcactcaagggcccctgacagtacatctgtggatcccactttgaaatccctggtgcagtgaaaggaggtctggcctgggaacccaagactcgagttttcgttctaagtccctcattgacccactgtgttctgtggaccaatttccccctttctagacttcatctgctcatgatcagtaattgtcttgcattttggtcatcatcacatttatctcacctgatccctccctgaggtcggtatgactgtcctcaatgacagatgggggaaattgagacccaggtacacatctggtgagtgaggggatggggttaggaggcagagctggctgactccaaaggcaccacatggcggtgattcacaaaactgaggcgcccccagagccctgccagatctctcaggctgccctggagagcttcagtctctgatgacccatgtcttgggacccatgcctcctctcagccacacatacacatatggtcccaggcacagccctggagaaagtgggagaacagccttgattcatcctcatcatcctccgatgaccccaccagcccagtgttcagctctgagacaacatccaccaccccagtgacaggggaaatttccccagctaaatatcagacacaggtcctgacaactgaagttttctgatgggtaaattcatgtttgtttatttattttgatgaaaagacaggtctaagtctataattcaaatcccattttatacacatgcatatgtatgtatgtatgcatgcacacatatataaacatatatacatacatgtgtgtatatacatgtgtatgtgtatagactttccttggtgaaagagaatgaaatttgcttgaattggagctgtgctggacacaagatttgtggttgcctttttgagctgaggtatagctccactagggaagagtcttcagagagcagctgcctccctgggtcctcaatcactaacctctctaatctttggtgccagtgagactgtagcttgggttcctccccttggaaaccagaaagactcctcatcttatctcagaaggccctgcaggcaccatcactcttggaatcctccctctttcagaattgatgtgtgtgtgtctgcagccttgacatgtagagtgatgtccagggctttctggaattctggttccagtgggaaattcaacttggttctaggaaatgatgccattggattcattctattcacaggcaaggaagcaatctttagggaggacctgctttaacaacccatctttcctccttatggatcttaagtttttaaaagattatttcttctagagggagttaagtgataatgaactcattctttcatttttatgaaacaaagacatttatacttgaccatcagagattctaattggcatgtggctcatgcttatgagacctgcagagttgatagaatcgcagctaaaacaaagacatttgacattttagttattcatgcagccttgctcagggcacatgtacaatgatcattaagctgtttgaaatagtgatattccagcacttgtgaaaagaatatactagtgcccaccaatccaacattgtgtcccaggagaactcaggaacaggtgggtgaatgcaattccagctacacttgttcgactgcaggaaaaccctacaggttgctgggctgcagtgggggaggtaggtctttgctcttgaggggttcctgatctgtgagccaagccattttttaaactgactgctctttgtagcgggtggataagaggcaaggactaaacagggctaccttaagataacactctaaggatgtcatcatgattcttagggactgtgcatcgcaccttattcagtactcaaagcccaggtatttgccctgcccaggactgctcatggatcataccagttgttcctggggcagagtgatgaggatcttatatcactgggcatagggtcttctgggctgggccttgaaggacagaagcctgctttactctccgctttttgacctagcctccacttcctcactctttgtctgttctgcaagtttgtactcacttctcatctggagcttgccatggctcctgggatcccagcttcctgctctgctgaggaccatggtcggtgttcccccagcagcttccttttaagcagtccctggcccaagctacatgctcagtgaatatccctgcattgactcactgaggccactccggcccagctgcctattgctcctacgctatggccctttagtctcaatggaaattgaaatctggagtgttgggctggccagttatcctctgtccagtgagggccctgtctaactttcttgtctttatttcttttctcagcacaggtttgggctatcacctgagaacattcaggagacagtacaggttcccagatgcaacgactcactcagatttgtcttaacagacccttctactggcaatctcaggtggagcaaaaaggagcgatcattagaaacaaattcattgtggtctcttgattctggccagctactctgcaaagtctggcctcctgcacctcttgggatgaggtggggcctcttgtcaagacaaaagggagcaagggcccctgtagggggaagaagggctgcccaggcctggtgtcagttgttcctggggcagagtgacagggacctcttatcactggccacccagtgtctatggaccttggataccatggcccccaaggtttaaaaaataatggaaaaagccaagatggcaggatttaagcatctcaacatggtcattgccactggagcctctgggctgcatgggcctctggcaggaggagggggtcagggccaggaatcaattataggcaaaggctggctcccttggggctggtgccagggagaaagccagctgcctcatcgcagtgtccaggagaatttatgagttggatcttgggggtgagtggtgaaggttgagctctccaggaagcagactctcagaaggagtttatgaagcaggacgcttaagaggaatgccttgagacaaacacctgtgggaaacggggagggaggcaggatggggcaggggagaggtggagctgtgatgtggcttggctgacaccacagagttgttggaactcagctagctcctcagcgtcatctcatgtggggctctggcagccaggcctctgcatcttacctcctcagtcagaggctactggaacctgaccatcctttaaggactctagaatcaccctgactcctctggttctctcaaagcccacacccaattcttcaccaatccctgtggcctgcatcttacaaacagatccagcctccaagcgtaggtgtcttccttcctccacggcattgtccacgcttccaccacctctcccagagccactgcaacagcctcctgcctcacctccctgcttccactcttggccctctggttgtttctttaccctgaaccacagcatcattttagaatagacatcagaacttgccattcctccacccttactcccatgacttccctgactcacacaggccaagagtcaacgcctcgccactctctcccagctcagccccctccctcctgttcttgggacatgccaggcttgctcccggctcaagatgggtgtacttgcccttttacctgcccactgggctttccccaagacagctacagagcgcatttcctccctgccttcagatccctgttcaaataccatttcctcccagggtccttccctggtcatgctatatgaagttgcaaacccggcccaccccatgatattccctttgaagtttgatgtgtctttggggcaccaaatgtatacaagaatctggagttcaaaagagagctccagactggtgaaaaagatttctgtgtcctggtaatacagatgacattcacacagtgaggatggagaggatcccctagggctgtcttgtccaatctagaagccaccagccacacttggctactgagcactggaaatatggctggtctgcaggggtcatgttgcatgaaagggtaacatgcacagcagattttgaagatttagaaaaaaaaagtaaaatatcccattgataatttttatattgcttacatgttgcaatgataatattttgattatattgggttagattaaatctattattaaaattaattttacctgttcattggtactttttaaatgtagctattggacaattcaaagttacatcagtggctcgtgttgtatctccactgaatagcactggcccagggagtggagagttcatagcattgagcccttgtggcatccaacatgtagaggtcgggaagtcagggatatctagtagaagagactgagaatgagaagccagggagaaggaggagaaagagaaggtgaaggagaagcatcatgagggagcagtgtcatcgaccaagtgaagaccatgtatgaagaggagactgattctctgtgtcaagtacctgctacgggtttggtacagaatggactcaaaactgagtatggcactgtgcaccatgaaggccactgtgatcttgatgagaagtactttggagcagtgttgagggtgagaaagcctgatgggagggggctcaagggagaagcaggggagaacaattgtaaacagggcatgtagacatccctttgtaggaagtttgctacaaatgggcagcaggaaaatcgggatgatagctggagagggaggtggggtaaagagttttattttcagcataatattgataggaagcattttgtacactttctatggatagacattgttctaagtaccttgtatatattaactcgtttaatccaccaagcactctatgagttagttactattttgcttaccaatttacagatgaagaaattaaggcacagagaggttaagtaacttgcctaaggtcacactgcagttaaggagcagagctaggatttgaaccccagtcacatggctctgaggttctgctttagccaccatgctatctgcatctttatacctgacaaaaattccaggagagaagaaaattgatgatgcaggctaactgcaagaggattcctggagatttttgtctttggggaagtcaagataagatggggtggagtgggcaagcagaggacttgtccccagccagaaggaggggcagtgtatggtgcacagtgctacgggctgatatgcaagttctcaagatcagcaaggtcctccactaaatgaagtgcggcaaggaggtgctggtggtctgcaagggagatgatctgtgagccaagaaggcactggggcattgccaggagcataggaccccttgaagctcaagggcatgagacagggcatagaccactttactccagcctctccttaatgtttaaaatgggaggtctccaggcctatcctgtgccccagggctagtcccagactcccccatgggccagccctgggagacactccggggtcacctgggctcagaggatgccagacaggcgggatggtgcagaggcagggctgtgcagggcgatgggagttcatcaggtagggaccagcctgcaaccagctaaggatggacggaagagcctggcagctcagtctcctgacagattgagggctgagggggctgggcctgctgaagagggagagggcgggagtggacatcaagaagaagggcctccagggctttgaaggggcccatggtgggcctttgaatccctccatccggggtcagtgcacccgagcgactgggcccccgtgctcgccaataaagtgtgtgggacggccttcaattatggaagcgtagccaaccaaatcagctttcagataaattatttatgctgaggcctgcaagggagggagtccggctgcatgaacaacgtgttcattttcataaaaccctgcaaagttgcagtgggctggggagagggtggggggaagaagaaagatgattagattagaagaggcctgctgtaaataacacacaagcagggcgttttgtttctttttgggctgtcttttgtatcatgttttatacaacagaaaagagcagaatacaacatctaggaaatgttaatgagggttatttgctatttacctaggctgggggtttgaagaaagggctgggctggaggtgagggggttgtgtagaagattggattccatgcaaatgcagacatcagggagtctggaaggctttggaacagagctggactggaggcttgtcaggtccctgtggagagggaaagaaagcaacaaatcccatgggctggagggtgttttccctcctgctcggggggccagccaatgggcctggatgggagggaggggtcccagtgggaaggcaggtcagccccagagagcaggcaggttgggtgactgcgagagtccctccaccctgaaatctgggggatgatgacaagccaggggtgtcatttctgccttccacagtttatccacaccccctacccatgggaaaaacaggtagggatgagaagaatggagcctgcttccctggggagttaggtgctgtctggatgaccactacagccgcttcttcccaaattgatagtgctcaagctttggtggtgcaggtgacagacaggccttctctcttattctaggtgatgagatgagaggacagctgttctcccctcactcaaggtagcactctgaggtgtccaggaggcgatccacaaatcatcccactgagtgtgcttacagccggtttctcccacctcagccctgctgcgaggaaggactaagaaaaacagcctgcatgggccgggcttggatttcaagttctcaggtcatttcttcacccatgatgcgcctttacttctctcttttcctcctgagtcaccactttgtggccacggagacaatcaggcaaggcttcttggaggaggtggtgatcgtgttgggctttgaaggataggaaggatttccgccgggcgcgatggctcatgcctgtaatcccagcactttgggaggctgaggcgggcagatcacgaggtcaggagatcaaggccatcctggctaacatggtgaaaccccacctctactaaaaatacaaaaaattagccgggcatgatggtgggtgcctgtagtcccagcaactcgggaggctgaggcaggagaatggcatgaacccgggaggcggagcttgcagtgagctgagattgtgccactgcactccagcctgggtgacagagcaagactccgtctcaaaaaaaaaaaaaaaaaaaaaaaaaggatttcaacagggatggtaatattatcattcctattttacagataaagaagcaacagctaagaaaacttaactggcttatccaacatcacacttggttagtaaataatacagtgaagatgccaatccaggtgtcctaataccgcaccttatgtttttcctactgtaaagagtctcttcatttccttaccactccagagaatggcagggtttagaggctgtagtgagacatggaccctttctgtgtggtgggctgatttatatattcgtatattcccatggcccaagggtgctgcactgtgtaacccaagggggccactacatgaaggccaatcccctggagttgggtagtgcactacatgaaggccaatcccctggagttgggtagtgcacaacttgaacatctgtacctggaagccttaccggtataggttacatgtacacaatacatgtccaatatgtattattttgaatgaatgaataatgtgcatgaagaacaatttgttgaagaacaacaacaaaaaacctgtatgggactatgttttataactgttgttaggcagttgattctgtcagttgccagtgacagaatcctaattcaaattggtttcggacacaagagaatttattattttgagtaactaaaatgtctaggtcccggaggtacagccaacttcaggcatggctgggagcaagggcccataggatgttgacagaaatctgtttcagtctctagactctgcttgcctttgtgatggtttcattttcccgaaagatctccccacgaggttgcaaagatggcctctagcagctccaagcttgcaggaactctggcaataaatgagctttttttccagtaatcccagcagaagttctggctcaaggctcattggaccactgtgattgatatgcccacctgtgaaccagtcacagaggtggaggttagatgatgttagaggtacaataaattgattggcagacctggggcttggtggaggagggggggcatggagtgccctaaaccacatggacggaaggcggaagaggtgtgttccctaaagaaaactgagattctattaccagaagcagggagaatggatgttggacaggaaaaacaacagatgtccccttctgtggcagaatgcttttgtcaaataaaatctttcttggaagccagacatgcaaaccaaatacaaacagggctgtcctggggatgccagtgtggggaagagacattcggagggatcattgcttcccgaacatagcctgtgcatttttttttcactttttatttatttatttatttatttatttatttatttatgtatttattttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcacgctgccttcaagcatctgtttaacaaagcacatcttgcaccgcccttaatccatttaaccctgagtggacacagcacatgtttcagagagcgcagggttgggggtaaggtcacagatcaacaggataagaatttttcttagtacagaacaaaatgaaaagtctcccacgtctacctctttctacacagacacggcaaccatccgatttctcaatcttttccccacctttcccccctttctattccacaaaaccgccatagtaatcatggcccgttctcaatgagctgttgggtacacctcccagatggggtggtggccgggcagaggggctcctcacttcccagtaggggcggccgggcagaggcgcccctcacctcccgggcagggcggctggccgggcgggggcctgaccccccccacctccctcccggacggggcggctggccaggcggggcggctgacccccccacctccctcccggacggggcggctggccgggcagaggggctcctcccttcccagtaggggcggccgggcagaggcgcccctcacctcccggacggggcggctggccgggcggggggctgacccccccacctccctcccggacggggcggctggcctggcgggggctgacccctacctccctcccggacggggtggcagctgggtggagacgctcctcacttcccagatggggtggctgccgggcggaggggctcctcacttctcagacggggcggctgccgggcagaggggctcctcacttctcagactgggcggttgccaggtggagggtctcctcacttctcagacagggcggccgggcagagacactcctcacctcccagacggggtcgcggccgggtagaggcactcctcacatcccagatggggcggtggggcagaggcgctccccacatctcagacgatgggcggccgggcagagacgctcctcacttcctagatgggatggcggccgggaagaggcgctcctcacttcctagttgggatggcggccgggcagagatgctcctcactttccagactgggcagccaggcagaggggctcctcacttcccagacgatgggcggccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccattgagcactgagtgaaccagactccatctgcaatcccggcacctcaggaggccaaggctggcagatcactcgcggttaggagctggagaccagcccggccaacacggtgaaaccccgtctccaccaaaaaaatacgaaaaccagtcaggcgtggcggcacgcgcctgcagtcgcaggcactcggtaggctgaggcaggagaatcaggcagggaggttgcagtgagccgagatggcagcagtacagtccagcttcggctcggcatcagagggagactgtggaaagagagggagagggagaccgtggggagagggagagggagagggcagggagagggagagggagagggcagggagagggagagggagagggaagcctgtgcatttttaatgccacatttctgaaaaagctgtcccctcatttggcaatatatgtcctcctctaatttacttgcctctttaccgtaaattaaatatatactgtagctcttcctactttcctcttccccagcacagggttttctaaagggtataacacaggcattgttcttctgaaatgctctgaaacactttgcatgatcaagtatgtttcgaaaacattccacttctcttggtgaactagaaagcttgttagcattttaaaggctctgaaaagtcctgcagtcatctgctgagcttcattcaactcagggttttcctaaagcaattatccacaaaatctgcttttcccttcaccaagcactgaaggatttggaattttctgggagacattgccagggaacattgcacctggcatgtttttctgtgctcactggttttatgggtatagaaagagtatttcctccttccagaccaaagtctcctctgggcatccagaccctcactgggccttggtgaacaaggttttgcttgaacaaatgatgggcaaatgtgggagttaatactgtgcccttggaaatgatgggagagctcttgacttggctcccattcttttcagcccccagcctggctgccactcgtgccttgtcctggctggccagtgagtacttttctcataccccacccatttcacagatgaggaaagtgaggccccacagacaggtgctagatgaggagactcagtgcctctcttgcagaatgtagggatttttgtaaagcagggagagtatgggtttgcattccagcaggcctggcttggcatcctggtttatccacttaccagctgtgtaacttaaggctgcttacctctcctctctgaacttcattttttctcatgtttacaacagagagactaatgatggttgaaggagagccagtgagtaacacagctaatggatgcctggctgcacgccaggcttggataggtagggtgatttggatggcatgcccatgcactgttgtttaccccctcagcctgtcagccttgagtaagctcagctcagtgcaccacaggaaggcgtaattggccattggttcgatccaggtcaagtcctttgatagcacactccaatacaaagccacccatggacagagagctgtctgagtggggccacagctgacgaactctcagccacatcctctacaaaaccacccagctgcagccagagagaggcactcccttagtcccctgcaggtagcaaagggatgagttttataagactacaggaggatgggcagggagtcgggcctggctcggccagaactaactgcttctgtgggcttggacatgggtcttgccctatctgggcctctgtttcctcttctgttaacctggggcactggacttacattctgtttcttcccctttcagtcctagaatctgatcttgcttctgtgatttcgagaggtcaggaagcgacagtttgatggacattctgaaggccttgggttctcatcccagctctgtgaccttgggcatttatgcatgaatttactgtcatgccaggtgctggagatactaaaaaggacaagacaggatcatcactgcagcatcagtgagccccctgggggaggagatgtgcaaatggccaccctgtggggtggagggcggcactaggcaccagaggagtcatgtggtgggcctggaaggccgggccggactggtcagggaaggctttgcggacacctcggggagccgacacctagaggaggtggtggaggtgtgggggccagaggaagtcgctccaggctgaaggcacagcttgtgcagaggatggtggcatggaagggcccagtgtgtgtcgttatcccctctgctcctgggaccccaggagctccttcctgggcttatgttctgtggcatgtgaattgtgggggcttggatgtggaatgaggtgctccccagccctgagctgacagggagtgtggtgtggttgcgcagatggggttctgggacgaaagttcctgagcacaaatcccagccctgtgaatttctagctgccaggctctgagtgcatcacctcccaggcggtgccctcaatttctcctctgcctggtggggatgtcggtggtgtctggtttatagcatcgagcaagttaagcttacagagcacttagagccatttctggaaggcagtaaatgctcaataaacattaactgcccctccctattttaaaaatgaagaaaaatgaaggtctgagggagtcagcaagctgtctagagagacatagcccagatgcttgcaggtccagccttgccctccctcccctccacttccctcactgtctctcacttttccctcccttcctctctcctttctttcctccctccctctaactcttgcacttcatcccctcaactcccccagccaacttctgaaaggcctccaaatgcctgggacctgctgcaaagctctttgatctgaccagaccgccggcgcctctggctgcttggcaccctgagtgaaccctctgccccccactttggggcctgtgctgaggcctagggcagagtctgggcctggtatctattctaccacccctccaaccactccctgcctgtcctctgcccccatgctccagaccgcttccggagggaaagcagcacctgggatctgtcttcagagacaagcagcttccaggcctccccacagggtagactgatattggctccctcccactgaaaatgaatggctgtcacacagccgggtcaccccagaaccccagcgactgtgggcttcctgcccacccatgggaggctctttggggccagtttctgagcctggtaaacacaagcctcctctccctcctccacggagagctgagaacaattgcccactctgaacctgaaagccggtggaggcccgctctaatgagtgtgcagctttcgctgccctcagaaatcaggcgctggctctgggcactcggcagccagatgattgaaagcccagtagggctcccagccctcccccacccccactctcttttttgtgtgttgtctgcatcactgcccagaccaatctctcttcatgctgaattttttaaagccaaattggaaaaaaattggaagtagcctgcatgctattccccctgggctccaaatgggctctccagttaggggaacaaaatacaccattttaatttataataataataattattattatcattatccataacaataacaataccaataatcccatgcatgggtaggccaatgtacagcgcataaagtgcttttccagctgtgatttcatttgggcctcgcccccctgtgaacctgctcccgccccaccccccccaccccctttgtctgtaatccgagcaggccaattgcctggtgactctcagctggggtgggaaggccagcctcaggctcccaggccctgcttttcccatgtcctctcgaagggatcacattagcaacacattttttagcagacatggcagagcacctgctccgggaagggggccggacctgtcaggagaagacaggactttgcagtcactggcctccagtgagatgatagagaaaggccagataatctcaactccacactataagggctatgcatggcctttgggagactctgggctcaaaagttgaagtcagcttgaggaacgcctcaaaagccatttcatcaaatgtggatcacattacagacatcacagtttcaacttgtcattgaatcgtaacatacgtacagaaaaatacaaaaagcatgagggtacaactcaattacttttctcaaacagaacacactcatataagcagcccaagactaagaaatggaagccccccttattctcccttctaatcactcctcccaaccagggtgaccaccatcccaacatgaaacaacatagattaatgctgctgctttttgtatttgtatgactggaatcatccacactatgcaatcttttgtgtctggtttcttttgttcgatgttatgatgtgatattcactatcattggatactgttgcagatttttcatttcactgctctgtgatatttcactgtatgaagatagtgaaatttaggtatccatttatcgtggtgaacatttggatggtttcaagttttcagttattatgaataaagctgtttatgaacattcttgtacatgctggttttttttgtacttgtgtacacatttctgatgagcaaaaactgaggtgtggaaacatggaatcattgcatatgagtaagtacatgcagctttaggagctattgacaaacagtttcccaaagtggttgcaccagtttatattactggtttttagggtctatgtggcagtacctccaattccatgaatctatagatccttggatgatctgatggaagctgcagaatttcgccccagaaatacaattctgcatgtgatttctgtaaatttatgagccctgtgaactcaaccaggtccaaggattcctatgaggtctctttttctgatctccaaattctgaggtatgttgtccacattttgattctgggttttaaattctttgactggatggaagacttagaacttaacagggctgggtgcggtggctcgtgcctgtaataccaacactttgggaggccaaggtgggcaggtcaccctgaggtcaggagtttaagaccagcctggccaacatggcaaaaccccgtctctactaaaaatacaaaaaattagccgtgtgtggtggcacgcgcctatagtcccagctactcaggaggctgaggtaggacaatcgcttgaatctgggaggcagaggttgcagtgaactgagatcgtacctttgcaccccagcctggtgacagagtgagaaaagaaaaaaaaaaaaaaaaagaacttaacagagcaccagcaaagcaggggcaccaaaaacaaaacaattttaaagaaaaatatttttgaaagaattttataatttcacagaaagcatggacatattcgtcaaaggaaaacttatgatgttgttggatgtccttacacatacctaacagattagagttaattcactttacgttatatatgggaggcacataatcttttcaaggcaaagtgcttttaaatgccttcacctggccctggtgatcccatcagtgatgcataaattgcatctggtcagtgattaccccatgctgcactggggcatctgtgcagtgaggggtccctggctgctaagggctccctgtcccattggatcctcactacaaccctgccaggtggctgggctgtgtgtcaccaagcacatgggcaacacagcttactgtaagggaaatgagggccaaatgggtcagtcatcgagaagcctctgcaggtgagtggtggctgtaggaactgggcttctggtttaagaacagggacgtggaaggtgtgggagtggaaaggtgcctccatctttctgcaaagcagcacagatgaagagggagctcactgaaggatagtgctgggatggatggtagaaactctatgaagataggtttctgtttgatgtgagaaaacatccaagtgttcaactgtgtaatgatggaagccgagtgtttgaggggtagtgagatccttgtccctagaagcatgtaagctgatgctggatggtcacttgacggggacgttgatgaactaaacgatctaggtttccttcaaccctaagcttggccatcctcagaatctaggtctcctgaccctaccacatgctctttcctcctcgccgctgacctgatggagtgcagtttgcacagtgcactggcccagcctgggcagcaggcaggagcctgcatgaaataacgtatgctgcagtcagagtgacagagtgtctgtagaaagcattcaagatctcccaggagctgtgactcgtatgagcaggtctctgtggattcaggcaaatattttccatttcataaaatgtggtacaatgttacctctgtgttctttgaaaaactggcatgggggaggaagtgttaactcaatggccttgttccctgagcgctggtggccgcctgccttggcagtttccttggggcctcccaccccactgggccccatcatgggagagctggatgagcccactgctgctggtccatggtcaggggtgggtgcagacgatccctgaccacctgaaggagaaatagaatgcagagcatgactggaaccctaggaaggaagaactctgttctgttaccatttctgctatggccccctcagccatgcccctcccttcatcatcattccctctgccctctgccgggactagtgcagtagtctcttcccggagctcacctcctccagtctctccttattctgagccaagaatgccacatgcttggcatgggtaacatgatgcccactcccttgcccctacagactttaccatcagtctcaggactcctcgcagagagcctctaataaatgattaattcacctgagtgggcagtgacggggaaactgatttgccaaatgtatctcctccatgcttttgacagagcaccctttcaaagaacagagcagagctcagatgacatcattcctccctgcctccccgcctcctacttctcatcagaagcacgcacgaaaatagctttccatgtttctcatggtgcttcatagcgaaggccaaactcaactgtgtggcactggaagcttgtgtcaatttgatctggttgtggaatcttttcttccacacagcttgcgatgcttgctcagttttcttttggaagatatgaagaacggtcacactatcccatctgaccccatccaaatgccctgtgcttcaaaggccaaagacatgctgtgttgtcccatctctcagtgatcgcccaggttgtgccctggcctggagtgtctgtcccacattccccagcatacagagatgtctgggcttagggggatgcccttttcagctttcagtgttgtttgctgcatggaccttgctgatcttgaaataggctctgagcctcagagttttccacaaatgtccagttcctgcccctgcccctgccccagatcaagggtaattgtggagggctctgtggtccaggagcccaagaaggcccttacagcacagcctcttcctgccaatccagccttgctgcaaggtccagataagccccttatgtgggagcttgagcagagatcccagtttgtgtttaatagagcagctacagtcaagcttgtgatctgcaggtgttagaacactcattggagtctcactagcacagtggacggctctcattagggtgtcattagctagctgcctcatttgcacgttcagatcaggctcaggcttcatgacagcaagggctataaaaggaccagcagggctgtgaagaccgctgcacatactttagtcttgaggggggccacacaggggtcggtgataagggcagaattagagccctacgatgatcacacagcacacgccaacacagtctcccggttgctcactccggacaccctgggagatccccgtggtctgctttctcttctccttcatatcaaacccaaccatcctctgtcagttccttttccccagtgcatccgcgtttggttttcttcccttcgtgctggtgtcaccgcatagccagctggcggcacagattcccacttgcctccatgggcctgggtctccactccagcaggctgtatgagctctcaacgcatggactggattgtgtcatcccctgctaaactcttcaatgacttcctgttgaacttggaaggatgtccagattgcttcccatggggcttgcatccatgttctagcgtgtcccacctccactggcccccaacgctccagccactctgttctgggacactcagcatgcccctacctgggctctgtgcttgttcttccctctgcctgggtcacacgcctcccaaatcttgcgtggatgtttccttgtcattcaagataagggctggtgggtcttgatgcctgctgtttgcatgcatgcgtgtgcccctgtgtgcaagcctgtgggattggggtgggcaagagaagagcaaggaatggtggtgctggaggagagagcccaggctgcggataagaacacacagcaaatacctggtgaaaaggaagccatgctgaaaggcgggctgtgtggttggatggacttggcttccagccctcatttcagccctaaatggctgtgggacctcagccaaattactttctcctccaagcctcagtttctccatctggaataatgagatcctcatcacagctattcttcagggccattgtgaaggcagcaataacttagatgaaggattgcaggcagtgcctggcatagcatcaggacttaataaatagtaatgttttaattttaagtagaaatcaatgtaacagagagacatgagctgggacacagaagactagcattcgtgcttctgactgctgtgtgaccttatgtagccagctgcccctctctgacttctgccaccaccaacagccacaatttggagggaatgggtatgttttctctcaccgaatctttctggaaagtggggccagaacagctctcagtatcacaagaggaccacagaagattcatactagggttccagacttaggctgggagactggacagcctttgtggtgaagacacacatgataagaagtattatttgggggacatcgactatgaattgtgcatggtgccaggagttttatacaagatataaaatccttatgtctgtcctgctaattaggtgtgctcttccttattttaccaatgagcaaaatgccaagactggtgatttgccaaaagccattaagatagcaattggaagcattgctaaccgactttaagatttaaagtctattttctttccagaaaccacaatatagaagtgtcccctaaagctttcttttttttctttcaattcttttgggaatatatgaagcttgcttgctgatatggtagcccctagccaggtgtggctggtcacattatagtaactaaaatgaaataagagaacaaattcagttcctctgtcttaccagctgcatctcaagtgctcaatagccacatgtagctagtagctgccatattggaaggtgaggatatgcaacaattccatcgtcacagcaagtcttattggacaatgctgccccaaagataagagagcagcatgctctatctatgaaaggccgggaccttgactggggactttaatgaatggcacaggtggttgcacaccactggatgtagattatggtgctcaggggcaagcaaagctcaccatggggcagggagatgagtttgcctttagaggtgcaggaatgactcctttcccaagctacctactgctctggtcttacgtgttctctggagttctggagtagcactgtgttaaactgcttgcttctcggagcgtggctcaccaacaaataatatcaacaaacctggaagttcattggaaatgcagaatctcagatcccaccccagatctgctgaatcacagtctgcattttgaagaaattccccacgtgactcgtgtgcccattgcgtttgagaagcagggggctacaccacactctacaatgtttactatggcatttagtgtcaactcttccaggagatgtcttctaagttctatgaaatctgtgtatctagaaccatccggtcggccacaaggctctggtggggaagcattttctttagagtgtaacacaggtcattttttaatttcttttagattgtacatatctaagatcaaagctagaaccttagagataatctagccccaaatattcatctcagagatggagaaacaacctcaaagaagaaaagcagcttatccaagatcatacagcagtgctggagcctacaccacgtgacaaggtacagcgtttcagtgacacatcatactggacaagagaaaagcacagtggtatagtgggaggacctggaactgatgtcctttaatgccaaatgtggggagcgtctattattgtcccaaccctgtccaaggaagtgctactggtcaccatggttgccatttactgggcactcactgtgtaccaggcactttcctgggtgtttgcgcttgttatttcattgcgtcctcatgacagttctctgatgtaggcattgttactttctcctctttaaagatgaagatgaggaaactgtggtatagcaaggttaaggagctcacccaacatcacacagatagcagacagtggagccagaattcaaacccaggacatcaggctccagagcccatgctcctccctcccctgtacactgtagagaattcagaggtgaagcagttccctggacacctgaggctgcacaaggcaagggaaaggctactgtggacactcagtcatctaccccagatgttctacttggaagtaaagacagaatccccaaaacgctcattttagaacacatgctgttaggaaataacatgtagaatcattggctttagaacttggattttagaacgtgagataaattgtggtgagatgagaggaacagttatcatcttaacaccagaggcaaaagtttatcttagggagagaaccatgtttgtttaagaaaaaaggtggtaaattgcttgattgagggaggtaaaaccttaagaacatgagtgggaaagagaggaagacacaaaaataagctaaactagtgcacgggaaaaggatgatcagatatttgagtgttgggcagagaagagaggagagaagaaacaaaggtgagaggaggcaaagcaatatatttcctgaaaagatcaaggcactcttttaaaagcagtatctaatatatgattgctttattttttattttttgcattagtttgatatcctgacatcctacacacttttttcctcttaatttcagtcatgtctgctttgtaccaaagggggcttgtgtgtgtgtgtgtgggtgtgtatacactcatacgtgcccatgtgcatgtgcacactgatgtgtatcaagtatcaagggagggtgtttaatttctctctaggtggggctgtggcaatatccataccgagtctaattaaagggaagcaaaatcttccatgcggatatgactaacaaaaatgtcggccaccagtggtgagcatttgttgtttttgcctgcccattcattgattaattcttccaagaaatatttactgagcaactattatgtggtaggtaatagatgaggtcagggcaggacaaaaggtggggggcaggtggtatagggctttgtgtagtttcaccaagacttgttcctgggtgaattgaagaactgctgctgcattttgagcagaggagggagctgattctgtagttgtcaaggatcttcctgaatcctaggatgataatagattgtgagggaggtgagagaggtggcaaacggaccaattaggaggctactgctatagtcctagcaacccttgaagctgagttggatgggagtagcagtagagacagtgaggatttctgttacgaaatgtgaaggaggaagttggcatagaggtctggaattaagggagaaaagttcagatggaaatatgaatttgggaatcatcaacctataggtggaatttaaagccctaagataaggccctttctcaaccccatctctgagattttcaaggtaatgagagtagattgagaataaaagagactaaggacagagctctggaggatttcattcagccttttgttcacaccactcaactgaaaccactttgttaaggtcaccaatgatcttgctaaatctaaaggccctttgtcagtactcatagtatttggcccacgtttgaataaagtttgtttcgtatgcaaaccagagagtcatgattaatacacccttccttcagaattcctagagatattaggataaatgcatgggaccctgtatgtgtgaaaaaatttctgtcaaatttatttggatctcaaaggacagcaggccacctcatctgatttcagggacacaaacaaatcatataacttaacatatacaatgggggagaattaggctataacattttgaagtcttgagcctggatgatgcaaaggaatgcttgagatcactgtgttttattaatttcaaatttcaatattcattgctggtatataagacagcaattgagttttgcatattgactttgtgtcctgcgactttactgtactcacttatttgttctgggagttttttgtagctcatttggggtattctacatagacaatcatgtcatctgtgaataaaggaagtttaatttcttctgtcgcatttctttttcttgtcttattaaaccagatagaccagtacaataaataaataataaacaagattattatcttattaaaccagataggatcagtacaataaataaataaaccagtacaatattgagtaggactgctgacaaagaacattcttatcttgttccaaatcttaggaagaacgtgtacattattaaatatgatgtttgttattaagttttttttagatgttctttatgaagtttagaaatttttgccaatatttctagtttgctagttatagtttctagtttgctaggaatttttttcaaatcatgaatgggtgttaaattttgtaaaatgctttttgtatcaattaatatgctgtaaatgttcttctttagcctgttgatatggttaataaattacatggagtgatcttttaaatactgaagcagccttgcatacttgaattacttggttgtggcatgtacttctttttatacattgttggctctgatttgctaatattatgtggatttccacacataatatttgtgaaacatattggtctgtagttttctttacttataatgtatttatctggttttggtactggagtaatgctagcctgtagaatgagttaggaagtgttccatctgcttttattttcaggaagagattgtagacgattggtattacttcttcattaagtgtttggtagaattaaccagtaaaaccctctgggcttggagcttacttatttggaaagatttaatttctttaataaatagagggctcttcaggttatctgtttctctttatgtgcattttggtaatttatgtctttaaacaatttgccgatttcatctaagttattaaatttgtgggcatagaggtgtttttgaaattgttcctactatccttttaatgtccatgggatcagtagtgatagaccttctttcatttctcatgttggtaattcatgtcttctgtcttttattctcagttagcctggctataggtttattaatattactgattttttcaaagaaaaagcttttggttttgttgattttctttattgcttttctgtcttcaattttattgattcttgctctaatatttattatgtcatttcttctgcttactttaggttaaatttgctctttttctagttttacaaggcggaagcttagattattcattttagatcttttttcttttctaatatatgcatttaatgccgtttatttccctctaagcactgatttcactgcattccacaaattttggtaagttgtattttcatttttatttagttgaaaatgtgctttaaatttctcttgagaattcttcattgactcatggattatttacaactgaattgtttaatttctaaatacttggggatgagtctactgatttttgggatgcactgtgcacatttctaaagttctccagagctgccttagggttgcctaaggaggagatgctgaagcctagaggaacaggtctggctgtggcacttctgccttcaccttgctgcacgcagaaattcacaatgtcgacatgttttgttaattggctaggttatactgtggtgtgctggtaagaacctgctggttagcacagcagaggcttattcctgactcctgccactggtcaatagagggttgtagggaggctctgctccatgtaatcactttggaactcaggctaacagcaatgttgccatcctgaagctgcagcatctggagcatgtggccttttccatgaccatggcaggggaggaaacagctggagggggctcgcacactggctattctagcacttagtccagaacagctgtcacacccactggtatcagagtcctttggccagaagtagtcatgtggtactacctaactgcaagggagctgtcaaacgtagaggattagatggagtttttggtaaactctactgtctcaaccacgattggtgttctccctaagacttctttgaaatgcagttttgctgcccactccccttgttgagcagacaagagtgctatttcaacattcatttccaaggaatagatgaaccatgagcacttcacaaccctttgaccttgcctcaggtcacattctctccatgtatataactcagcacatattagctggaattctggactcctcagtatgagactttaacaggtaagaagggtgaataagcctcaagtgcatgtgtgttagaagctttataaacccctttttctgtcacatgcagacaattagagaaagaaaatatgcaaaaaatgctttggtgattgccaagactcaaaggatttgagagtaattccaattcacatatatttattgctccattgttttgccaggtataggaatatttgtaaaaatgaagaaggtaacaggaggaattgctcaagttagactaagatgcaggattcctgaattcgagcaaatgacaacacagtagacagtggctgctggccattactatgtattattattattttttgagacggagtctcgttctgttgcccaggctggagtgcagaggtgcgatctcagctcatggcaagctctgcctcctgggttcacgccattctcctgcctcaacctcccaagtagctgggactacaggtgcccgccaccacacctggctaatttttttgtatttttagtagagacggggtttcaccgtgttagccaggatggtctcgatctcctgacctcatgatccacccgcttggcctcccaaagtgctgggattacaggcgtgagccaccgcccccggcctctatgcattattaagtgtagctgttgaggcgttttccatcatgggggaaacatgcgtggcatatgcaggctttcatctttgcccgttctgatcttttctctctctttccctccctcttttgctctctttctatatatagtttatctgtgtgtctctgtgtgtgtgtgtggggggggtgccaaccccctgtgcagtaaaaaatgtgcatataatttttactcccacactacttaactcctaatagtctactgtcaaccagaagtcttaccaataacataaacagttgattagcacatattttgcattttatttgtattatagactgtattcttacaataaagtaaactttaaaaaagaaaatgttattaagaaaaccatggacaggtgcggtggcttacatctgtaatcccagcaccttgggagactgaggcaggtggatcacccgagatcaggagttcgagaccagcctgtcccatatggtgaaaccccatctctactgaaaaaaaaaaaatacaaaaaaattagccaggcctggtggcgtacttctgtagtcccagcaaattgggacgctgagacaggagaatggcttgaatctgggaggcggagattgcagtgagccgagatcacaccactgcactccagcctgggagacagagcaggactccatctcaaaaaaaaagaaaagaaaaagaaaatcataagcaagggaaaatatattagcctattcaacatgaagacgatgacgataaagaccttcatgatgatccacttccacttaatgagtagtaaagaggaggggttggtcttcctgtctcaggggtagtagagatgagagaaaatccatgtataagtgaacctgcacagttcaaccccgtgttgtccaagggtcaactgtatttatactaatatgttcataatatctattttagtttttattgaaagagtaattcaaatagtcctaaaaagtatgtgatcaaaagtaggtttctgctttacacctggtccccaagtcctcctccctagaggcaacaattctcataaacttcttggatgtactttcagaaataatctatgaatgtgcttaccaaaataaatagcacaacttactaaaacaaataacattcttcttcaacaccagcaacaaacaatgagataaaatgatagaagatatcataattttcacaatagccatgaaaactataaaatgtctaaaatttggcctaaaaatattgcaggatgactttatggagaaaaagtttaaaaccctagtggagtgtacaagtgaacatacacaattctgtatgtgagccatattcgtggattgaacagctttatagctatgtcaatgctcctcaaataaatctatgcattcagtgcaattccaaataaaaaatactcatcacaaatttttgagaaagttggtaatattactctaaaatttatgtgaaagagtgtcattatacaaagaactaagttttgagcaattctgaacactaaaaacaaagaggtagaatttatcctcctgtgtaataggtacattacaatgctacggtaataggaagcaaaaatgtagtgacatattgtagaacagaggagtgaacagaacagagggctcagagatagacccatgtatatgaaattatacatggtaaaggtgtttacaaatcagagggcagatttttgtttactggaagactgtgggaaaaattattatgtcaataaaaacaaaattggatctgtctcacagcatgaacaaaggtgagatcaaaatgaattaaaaacttaaatgcaaaagataaaatataaatatatgtggatgaagagacaggcaaatatctttgtgtcttttgaggaagaggaagatgttctgaacaagactgaaaaagcacaagccccaagggaaaaataatccatggatctgatcagatcaaaatcaaggatttctattcaataaaggtcaccatagacaaaattaacaaaacctgagaagtaatgaatagcaagactgtacaagaaaatttttgcctatgagtgagaaaaagataggaaatacaagaggaaaaaatggccaaagactgtgagtaggcagtgcacaaagggagagacccaggggacaaaaaattgtagatcactctgcaatagagcaatacacgtttgaccaaggtgtgacttcattcacattagctggccaaaaaatcaaaagttggtgaacatcagatttgacccaaaatgtagaaaactggaaattcttatccactgttccgggaactgtagatggtctgtttgtacatatgaaaattcgatgatcagatactccatgatccagaatctactctcaccttcctgtcaatcctagaagccattcactgaatcatgtttgtgggagtagagggatagaggctatttaggggtctatgctggggccttgagtaaacttattagaaaatgctatgcagcagttagaagcaagaaaaaaaaatgcacatggagaaacatgatcccatacaaaatcatgttgagtgaataaaaattatagaatgagatatgtaatatgctaacttttatgcaaatttaaagcacatacaatcacaaaatttactacataaagaagagtgatacatcagacacattagacgtgttcctaccatgggagggggaaagggagtgagaaacacgcatggggaagaataaacaaaacaagagaaggcagaatgggagagtctcccagaaatggtcaagtatgatcaactccagcctctgccctaaagaataagaaatcaataaatagatcaagaattcattttattccttaaattttaccacaaagttgagttgtactttatttgttgacacattacatttcatagacaattgaatcttctttaattttagagtttacgttttctttttatatttaggaaactttttgccaggtgccaaatattttcttgtgccttttgaagacatgctaggattgaggcacggacctataccattataaaacataattgtgtacatagtgtcagatttcatggtcatattacaatatattacaatgtattcactagtcagattttgctggatatttggattgtttacagtgttctttttacttataaacaatgttgcaatgaacattcttgatattcgtctttgcactggtgatgtatatcagcaggttacattgctaaaagtagcattgccaaggtgatagatatttatatatttacttgaaaagaaactgacaaattacccttgtaccaacttatactgtcacccttgccaacattaggtattatcaaactttttaatttttgctgttaattaatgaaatattttattcattatttcgatttttatttacttaattagaaatggctttgcataattttttcatattgtcaaaagccattcatattaccgtagttggtctttttcttattaattttccagtataccttatttattaagaatgttaattctttttcatatgttccataaatttaaagctagctagatatatgtttatctctatctttgtgtgctgtatctaattgtgatttttgcaataacttgatggcaaaaccagcaattagttttgcaccagccaaatatatctagataatttatttttatcgtataactttcatggctttattttttagtttcatttaatctacctggaatttactttaagaagtaacatagggacttaagagcttaattttttcccctgtacttagtcaattgtcccaacattatttattgaatcacccatattttcccattaatttaggatatcacatttgtcatacactaaatatactaaattatttggaagccgtttaaaaagttagaacttttttcccattgatttgcatcttgttaatatgccaatatgtaatagtcattctagatttatgggataattggattcactccttcttagcactcctattttcataatttttgtgttgcaaagtttcttgtaagtttattttccatatatatattgtagaatcatattgtctagcttaaaaaaagtgaggagggcgtctgtgcaaggggatggcctgccatggggaagcagagcacaggccaggagaggagcatgtccatgcagggagaagcttgtggccagaacgagagattggttacgtatagatcagataagtaaatctcatgtttctggctgtgggagaagagaattgcaactatagaaaaggagaaaaccgaatggattctgtggtactggataggaacagaaggttttgttgtgaactcatggttaagtataaatgtataaatgtaaatgtgtatatgtgcatgtatgtgaagtgagtatattctagctctgatcactgaaagagcctgggggtggtgacaccccagtggcaaagagcacacctagcagcagtttttggcttctacatagcatctgtattatgcaccaacctaattgtttcctgttgttgctgtaacaaatcaccacacactaagtgaattgaaacaactaatttattatctcacagttatggaggttaaaaatccaaaatgggccccacagggttaaaaatcaagatattggcagagtagggaacatcagttcaacctggaggttccagccgtgaatccattttctttccttatttcagcttctagaggccaccacattccttggcttgtggtcccttccatcttcactgcccacagaggcctcactgtgatgtctgctttcttcctcacatctctgattgattttccaggctccttctttcactgataagggctcttctggttacactgagcccacctgggtaatccagaataaactgcacatttcaagataaattcctcttaataacatctgcaaagcccctttgccatgtaagataacatattcacaggttctgatgactaggatgtggacatctttggaggctattattctgcccaccatccccttctccattaaaggggcctgggagcaatggctgattccagggctgaagcatcttgttgtgccagaaaataagaaaggattcaaagaatgaaggaggcctttctaaaggacacagaagccaaaggccaggtcaagaacaagatacataatgacagttacaaattgcaagttagaacaacatagatatccaggagttcatatggatataaataaattaatgaatacattctgagcttcaggatgggcgctggtcaccagaaagtccaaggcatgatttgagagttgaaactttcagaccttccaggagaaggaaggagggacagatagggcccaattaccaatggtcaatgatgtcatcaatcatgcctctgtaatggaatctttacagaaacccctgaattgacagggctggagagcttctgaattggtgaacacatggaggtgctgggaaggttgcttacttggagaaggcctggaagctccgtgtcactgtctatcttcatactttgccctatgtatgtcttctcatttggctgtttctgagttacaccatttataataaactggaatacataagtaaagggttttcctgaatactgtaagtcattctagtgaattattgcactgggaccagggatgttgtgggaatctctgaatatataactggtcagtcagaagtacaggagacccaggacttgcaactggtgtttgcagtgggggcagtcttgtgggactgagtccttaacccctggggtcttcactaaccctgagtagtttgtgtcagaaatgaattgaattgttggacatccagctggtgtcagcgaatcagacagttgatggttgggaaagacaccccatatttgctgtcaagagagttggtgggggagaagcactctcacctggagaactattcccaagaaataagggtaaattagaggcagaccaaaccacaagagagctgaaatcctgccttcaccctggattggagtaaaaaaatcagtcactactttattgatcattggaagaagggtgagttctctcaggcaaaactaatctattgtgtgagaaatcaaaagaggggtcactcttgaggagaggactgtagtggttaaaaggggcacaagatgaactcatggggctgccagtcatgatgggtttggaaccaggtgctaggtatacagatgtgttcagtgtgtgaaaaatcatcaagcagacattgacaatctgtacctttttttccatgagtatattacactttcaaaaagaagcatacatttaaaatattccaagtttcggttctgctaagatggagtagccccattcctcccaggttgtccttcttacagctaaagaacaactgccatgaacacaacaaacaagcacaggaagacctggacaggtgggaagaggaagggtccttagcacctgaggagcagcctggcagagttcctcaggtttccttgtagcctcccatgtatcccagccagggtgctgcagaagcctccaatccagaacccccaacaggcacagataaaaagctccaagaaaacctattaccctgggaaaaggaccaggacaggagtgaccaaacaacagaaaactttgttggcaatacctgccttactccagctgaatgcgagtggaaacatcatgcccacccaaaccctgggttttagcaggactgagccagaaattgagcctgcaccctccttcttatgtcctcctccacttcactgaagcagacagtgctttgattaatccttcagggagatgccaagtggagaggtaaccttccatttcccccagtggaactaggcagtgctcccgcttcctgccaggctagtgctagctgggctgagtaggaagccaatcatcaattatctggccagtggaagcagtcagtgctctagctcttgaccaggatagcatcagtaggttccagtggggagccgaccctccacccacaacaagggggtatgaggtggtacaaggggaaatagtcaacaccccgcttttctgctatcccggcgtagtacgtcctggagaggtgctgagcctccagccccacttagcatcatgagagggaatgacttcgggtgggcagggctagatggcacttcagctgcttcctttcccttccctgctatcatggtgtcagcaggaccctacgggtagctgagcttcctcccacagcctgcagcaataaaagagtgtgagtcagccctatgctttggccctccttgtggcatcaaagtcccacaggaaactgaatgtaacacccacacagccctctgttacaccttaaagggagttttattatttcctccttaattcctgaagaatgatgaaaaaaattaaatgagataaagagttttataacataatgtccaaaatgtccagcatacagtaaaaaattattcatataccaagaaccaggaaaaccataccatgcataagaatagacagtcaacactgagatgaatcagatgttagaattatctgccaaggactttaaagcagccatcataaagatgcttcaatgagcaattttgaattcccttaaagcaaataaaaaaaaattgaaactctcggcagagaaatagaacttataaaagaagaactaaatgaaaattatagaaaggaaaaatacaataacacataaaaataccagctggatggatgcaacagtagagcagaaatgacataagatagaattagagaacttgaagaaacatcaatagaatttacccaacccaacctggtcaacagagagaaagtagactgaacaaattaacagagtctcaggatctgggcaacaataacagaagaactaacatgtgtataattggagctccagaaagaggaggcagagactggtccccaacaacactgaaaaagtaaaaactaaaaacttcctaaatttggcaaaagatataaacctagagattcaagaagcagagtgaatcccaaataggataaagccaaagaaattcatgacagacacatcataattaaacttgtgaaaactaaagataaaaaaaaatcttgaaggtatccagaagcaacacattatctctaggaaaacaccaatttaaacaacagagaatgtctcatcagaaatcacggaggcaaggaggaagtattgcaacatttttcgagtactgtaagaaaataattgtcaactgcaaattatataggcaaagaaaatattcttcaggaattaagggggaaataataaaattctcaaatgagggaaaagtaagagaacttttgtcagcacacttaccttaagaatggtttaagaaattgctctaaataggaagtgataacagaacaagtattggaacttcagaaaagaaaaacaaacaatgtaatgagtaaagataacagaggatcctccttctcatgagtttcttaaataatatttgatggtagaagcaaaaattataccaccatctaatgtggtgctccatgtatgtagagaaaatgcttacaaaaatagtaggaatggtaaatagacccaaatgtaagtaagatttctaaacttaactcgtgtagtaaaatgtcaatattagtagacagtgataaaccatgcatgtatattgaaatacctagagcaaccattaaaacaattatacaaagccatatgctaaaaatcactaaaacaaatcaagatggaattctaaaaaatatttaactaacccacaagaaggtgagaaagtaaaagcgagaaacgagaagcataggaaatggacagaaaacaaattaataaaatagcagacttaagttctaatgtatctacggttaccctaaatgtaaatggtctaaatagaccagataaaagaaagagattgaaattggcagagtagatttagaaaatgagcaaagagttcttgcctacaagaaatttgttgcaaatacaaaaacataggtacgatgcaagtaaaagggttgaaaatttataccataaaaaattcactgaaaggcaggactggctctactaatatcagaaaattaacttgaaagcaaggaaatgtattacagacagagggacaattaaataatgacaaaatgaccaatctatcaggaagacataacagttgtaaaagtgtatgcaccaaacaagagagcttcaaaatacagagacaaaaaccgatagagcttaaacgagaaatagataaatccacaattatagttggggacttcaacatcccaatctcagcaattgatagaactactacacagaaaatcagcaatgatataaaaacactcagcacaagcaacaggattttattgacatatataaaatactctacccaacaacagaaaaataaacatttatttcaaatgcccatggcatattcactgatagaccatatcctaggacataaaacaaacctcaacaaatttaaaataattagaattatacaatatgatctctgattataatggactctaatgagaaatcagtaagagaaggataatttttaaagtctttaaacagttggaagttaaaccacatacttctaaataacccatgagtcaaagaggaagtctcaaaagaagtttaaaaaatacatggaatggaatgaaaatgaaaacaaagaatatcaaagcctatgggatgcagctaaagcagggctgagagggaaattttatatgacaaaatgcttaaattatacaaaagaaaggatctcaagtaaataatctaagttcctacttcaagaaatgagaataaggtagaaatataaactaactgaaagcaagcagaagaaaggaaataataacaatcagaacagaaattaatgaaattgaaaatataaaaacaatagaaagaaatcaataaaaaaataataaaattgataaacctttagccatactgataaagaagccataaatcgccaatatagaaaaaaacgggctatcaccacaaatactgcagacattaaaatgataaggacatataaattcacactgataaatttgtccacttagaatgaatgaactgattcctctgaaactacaaattgacacactgaaccaagaagaaagaaataatacaaatagtcctacaaccatttgaaaaattaaatatggctggtgtggtggctcacacctgtaatcccagcactttgggaggccgaggcaggcagatcacttgaggtcaggagtttgagagtttgagaccagcctggccaacataatgaaaccctgtctctactaaaaatacaaaaattagccaaccctggtggcgggggcctgtaatgcaaactactcaggaggctgaggcaggagaagcacttgagtccaggaggcggagattgcagtgagctgagattgtgccactgcactccagcctgggcaacagagcgagactctatctcaaaataaaataaaataaaataaaataaaataaaataaaataaaataaaataaaaaacaataaaataaaaaattaaatatataacctaaaatctcctaaaatatatatccaggtccagatgccttcactggtgaattctaccaaatagttaaatagaagaggagagaacactttccattgtgtcagactaatatattacccagacaaagagagcacattaaaaagtacagaccactatctctcatgaacttagaccccaaaatttgtgacaaaatgtaaacaaatcaggctggtgcagtgactcatgcctgtaatcccagcactttgggaagcagaggctggcagatcacttgagaccaggagttcaagaccagactggccaacatgatgaaaccctgtctctactaaaaatacaaaaattaaccaggcatggtggtgcgtgcctgtaatcccagcttcttgggaggctgtggcacaagaattgcttgaacccaggaggctgaggttatagtgagccaagatcatgccacttgcacttcagcgtgggcaacagaacgagactccatctcaaaaaaaaaaaaaaaagttagcaaatgaaatcttaaaaagtatatatagaagtgaataccataaccaagtggggtttattttaggtgtgtaaggctggttcaatacttatagatcactcagtgtaagccatcataaaaacaagctgaataataaaatcagatgatcatatcaatttacacgaagtagtttataaaaatctaacattcattcatgacaaattaaaaactcgggggtggagaagtaaagcagaaagaaaggacaattttctcaacttgataaagagcatctacaaaaaacctatagctaaaatcatacttaacagtgaaggcttaaatgatttccctctaatattaagagaaagggagaagtaattaatatatgctctcaccactcttattcaacatattactggaagtcctactcattgcaataaagcaggaaaaagaaataaaagacagaaagaaaactctccctaagtgcagatatatgataatttacatagaaaatcctgagaaatgtaaaaaaggaaaaacaaaacagaaataaaagacaaaacaccaaaacctactagagataacaagtgagttcaaaagatcccaggctacaaaatgaacaaacaaaatcagtcacttttttgcctactagcaatggacatctgaaaaccaaaatttaaaacacaatactatttataattacttccaaaaaatgaaatacttaggtgtaaacttaataaaacatgtacaggatgtgtatgctcaaaattacaatgtgctactaaaagtagttaagttaaagaaggcttaattaaatgaagagacatattgttttctctctacttaattgatgaacatttattgaaagacatgaacatacatttcattgaaaagtatgtgtaaattgcaaataagcccatggaaagagtttcaatgtcattagccattagggaaatgcatgttaaaaccaaaatgagctatcactacacacctatcagaaggctaaaataaaaatagtgaaacaccaaatactgacgaggctgcagagaaactagatcactcctacattgctggtgggagtgaaaaatggaaaacagcttgacaatttctcaaaaaattaaatgtccaactatcataatacctagaaattgctctcttgggcatttattccagagaaatgaaaacatttttacacaaaaacctgtacataaatgttcttagcagctttattcataatagccaaaaactagacacaactcatatattccttaatgggttaaatgaagtttgatacacacttggtaatataataaagccatggattattgatacatgcaacaacatggatgaatctccagggaactgcactgagtgagaaaagacaatcccaaatggttacatactgcatgattccatttatgtaacactattaagataacggaattatagaaatggggaacaaattagtggtttcaggggttaatgtgggaataggggcaaaggagagtaggtttttctgtaaaatggcagcatgaaggatctctatagtgatgaaaatgctctatgtcattttgattgtatcttgattgtagcactgttaatatcctgattgtgatattatactagattttgcaagatgttactatggtgggaaactgggtaaagcatataaggaatctttctgtattatatttttacaactgcaggcaagcccactattatctcaaaaagtttaatttaaaaataagtaataatacaggaacaaaatgattaatgttacaaagttaaaatatttcctatgaagcttctggatttggtactctggagagtggagtaatagctctttgacattttcccaatttattctctgataattagtctcattatattttctaactctataaattatacttacacagcaaagtattcatttcacacaggttttcaggtttattttcagtgttgacttcatcttttatggtttgtttttctttgtgattgtgtctgcattttcatttctacttttgtgtatctgtgatttcaccaattttttttctttattactctgcctagttttatttttttcaaaaaaaccacaaagatttagggtttttcaattttttgtttttttaagaaaataagattttgggtttttttcccccaaaggatctgcttttgaatgtactaattcctctgtctcttattttataattaatttacttctgcttttatccttactaattctttccttctgcttttctcatgtttaatatattgttctttgtgtaattttcaattgaattattttcatttgttcctacttaatgagataaaccaaggctgtgaagtttcttctgtgcgctgccttagctgtacccatgagttatctcaggcagtgttcttgttgctgtttcctggatattcactgttaatttttttgtttggaccataggtgctcagatgtggggtagccataccacatgattgatccatacatggagcttttctattctgtatgtatttgttggttgcttgcttttaatactaaacaaaaagctgtgaacctaccacacaatgagtcactagcactccagtagaaacttgagtctatctttgggattctgtcttactccagccccctgttgcttttcacctcatttgagctcattagaaatcttgtgctgatgctttacttcccaaaccctgttttaaaaacaacttgagataaaattgagataaaattcatataccctacagttcaccaatttaaagtgtacaagtcaatgattttcttacattcacaaccagttgtgcaaccatcactaacatctaattttagaccaatttggagaatattgtcatattaactgtattatgtctgccaatccatgaacatgagacgtctccccatttacatttttttccacaatgtcttgaagtttcagttggtaagtcttgtatgtcttttgtttaatttattgttagatattttctttctgatggaattgtaaatgtaattattttcctaatttcatttttagattgtttattgctagtttatagagatatgattgatttttgtattgatcttgtatcctacaatttttctagagtcatttattaattctaatagattgttactggcttctttaggatttttctgtacaagatcatgtcatctgcctatagagatagttttacttcttcctttccaatctagatgctttttttttcttgcctaattgttctggcttgcacctccagtacaacgttgaaatttattttattttatttaactttattttatttattttttttagacagtctcactctgttccccaggctggagtgcagtggcacaatcttggttcactgcaacctccacctcccaggttcaagcgattctcttgcctcagcctcccaagtagctggattacaggagcacaccaccacatcctgctaatttttgtatttttttgtagagatggggtttcaccatgtttcaggctggtcttgaactcttggcctcaagcgatctgcctgcctcagcctcgcaaagtgctgtgattacaggtgtgagccagtgcacctggcttccaatgttgaagtgttgaaagtagacatccttgtcttgtttctaatattgagttttaagtctttcatcattaagtataatttgagctgtcccacctctgttttgaatgtagttttgttgcatctgtcattattcttctaaaacttatttttttagcacttgcttttaataattttaataaaatttattttattttgtttctatcagtatatcatctagtacttactttctccactaaatgtgacattttgtagatgtggccatattgttacatgtggccacggtttattcattttgactgttatataatatttcattgtataaatatgccacaacttatttagcctttattttgtttatggatatcttgattgtttttatgttttgctattataaagaatgcttccatgaatatactcaccaattctccctcagtacatttgcaagaatttctcttggaattacattgaagcataaacttgctatgagaattgtattagtccattctcatgctgctatcaaagacataaccaagactgtgtaatttataaaggaaagatgtttaactgactcacagttcagcatggctggggaggcctcaggaaacttacaatcatggcagaaggggaaataaacacatctttcttcacatggcagcagcaaggagaagtgcaaaacaaaagcgaggaaagtgccttgtaaaaccatcggatttcttgagaactcactctctgtcatgagaacagcagcataagagtaactgcactcatgattcaattacctcccactgggtcccacccatgactcgtgggaattatgggacccacagctcaagatgagaaccatatccgaaccatatcccagccgaatcatatcccagcagtttgggaggctgaggtgggcggatcacgaggtcaggagttcaagaccagcatggccaacatggcaaaaccctgtctctattaaaaatacaaaaattagccaggcgtggtgctgggtgcctgtaatcctagctactcagaaggctgaggcagaagaattgcttgaacctgggaggcagaggttgcagtgagccaagattgcaccactgcactccagcctggaatgttcaattttgtaagataatgccaagtggttatcatggccctacaaatttgtatttccactagtaacatataaaaggttttgttgatccatagtatctccattcttttacatagactgtctctgatttttgctcctacaatgagtatacgtcagtatcaaaacttggggcttggtttgcatttccctaatgacacaatggggctgaacatctcgtcatagatgggtttcattcaacattggttgtttcctctgggggggtgttaatttccctgcacttctaagctgcacacatgtgtggaccctgagagctcccacttgtaccagtgaagcccaggagcggagggaaaaaatgcacatgattgttgcatgcaggtgccgttgccttgaagtcagtccaagccctagggaactatctataccagcatggtagaaatcagaggtaaggctgagaagacttaattgagaaataagaggcatattctacaagcctatatttgttgtttccctctttgatccaaaaataataatattttggaattgaacaataagaacacatggacacaggagggggaacatcacacaccgggggaagcgggagggatagcattgggagatatacctaatgctaaatgacgagttaatgggtgcagcacaccaacatgacatatgtatagatatgtaacaaacctgcacgttgtgcacatgtaccctaaaacttaaagtataataataataaaaaaaattagcattatgtgttaaaattgaaagggaataagataaaatttacatacacatacacataaaaacttgatattttatgttagtggctagtgtatattatgtatatatataaaatgtcaatgaataaagttaattcaagtttagtaaaaaaaaatattagtttatcctattatatttaatgataaaaccaacatagattttgtttcagttctatcacactttacattatacattttgattttaatgcttcctttaaaaatcctttattcatggtccatattttcatagtttgctttatgtattggttttccctctaataagaaggtttatggggtatttttagttctttagtggttgccttgtaactatatacaatattcttttatgtcttatttattgagttatgactaagagaccctcaccaagaacaaagggaagtcagtttacttcctctacctcactttctccaatgtcttatttgggtatattatattttattcttttatattttaaatactattcttctccattgattgcttgatttctcagcttcttatatgttgattccctccttcacatgtgagtatttgttgatacttatctttcttggaactcaagctacagtgttgatataagagctaatatatttcttcaattctggaggatcatcagctgataactcttcaaatattccttctctccaccttctctgtttctccctctagaacttctgttagacatagttggaaacccttgttctgggttccacttgcctctaatgcttggttgttttttactccaagttcatattcagaaggtaccgtttcccacctgggaggtacaggtttcacattcacctctgccatagctggaagggtttccctcaatccaggcgggttttattgtaattcttttccttggggcctcatacctgggtccctgtgagtagcacagctttagagacctctgatgttttgattatttttatggctttgctcttatgaagagtgcttccatgaatgtactcaccaattctccctgtgtacatttgtggtgcagatttagagtccagatttctctctgatgtctcctctctcactcatggcctggggaggtaggcccacttttgtgagtggtgggtggtggttttctgctttcattttactgaagggacagcttttccaggctcctgcctctaagcagaaagatgactcatatcctcttttgtgctcagggcctgttgtataggcccccggtccctcatggatactaaaacaggagcattttgtccagctcttatacctctgtgggcctttggcgttagctcctgctcactgctctggctttaagagttttgtttgtttgtttgtttctggcatgggagaatgcttcctttctgcttttgagttcaccaatgtggtcataaatctgcttgggttatatgttagccggcaattcaccgtgtttgtagtgggcatgatggtattggtggaggtggggagggtgcttccccagcagcttggtgctgcagggacagcagaatggatggtgatgctggctggagaggctgcccttgggcctgagcagctggtaagactgctgaattgcaggagtcctggaggagcctgcgaagagaggcctgggataatagcaaggaacagaggggagcagcatggtagcactgggggacttcagaggcatgtggccccgagaacttctgtggggcatgactaatactcaaacctgagtgacccagcagactgggctgtccttgccatggcattcaggaacagccctggtacgttcagctgccttctttgagtagtattttggggaaataaatgaaaggggtctatcttccacattagagaccatccaaaatgcaaagacaaaagtagggatattgacaatttttcagaaacaagaaattgaaacaggaggtgaccttgaatgccaactctcaagaattttcagaaatcttggagaggacactgaacctcctatagggtggaaagtaggtttgagctaagtttactactcaaggggtaggggacccagatgacctctaggttacaaataaccatcacattcctttccttgtttagtatacatggcagtgctgtgaacaaattaaattatccccatcttctgcagcagtgattctcaaccggggatgattttgttccttatgggctatttggcaatatatggaggcatttttgattgtcacaactagggagaggggagaatgttactggcacctggtgggtagaggccagggatgttgctaaacatcttacaagtcacagaacagcctctcacagcaaggaattatctggccctaagtgttaatagtgcccacattgagaaacctttatctaggctcaggtaactatggctcagtcttcaaataacctgtgttaagtcccaaagctagaacatttgcaagaataattatagcttactttagttaactgctctttctgtgcagggaattgttgtaagtacgttctgtgtactgctactatcaccctgttgtatagatgtggaaaccaagaagcagaaagggtcagtgtcaccaggtaccacacaggtgcatgggtcaaactgggacacacacccagcagaagtctccagaggctgtgctctcacccactgggctgtacttctcagaagggcttgaatgtgagtctaggttttctgctctgtcctaagctctattctgtacctcacctccttttataagtttatagctcaagacataggctcagaacacataaagctctgcgtcaacttaaccacgggcaaaaagtttttttgaatgtagcaaaaggggaactttgtgtctttgtgtctttcctaggggaaccctggagccccacggcagatgtcacagattggcttgctcacctctgtcttagtctcctggaggcagtgaggccctgcagctagcacctgggataacagcatccatctaatctccaggtcatagcagaaataatgcagttcttggaaacagcagttgggtcccccagctttctgattatggtggagggagcagcttctctggcaagaaactttggcagtgacattctgggactctttcctcgaagctgagcctgcagcctcctcccccagcccttccatggggtcataatcccctaattccctgcattaaatccctttctggtgaagccagccagagtggtgtctatgatctgctgctgcacgtggactgatatgtggcccaatgagggaaaagaaggaggaccattggaggacattcctctccaggggcaggtcgctaggcaggaacctgggatcctgggaaaagcatgggatcctatcagttttttcctcttgagatccacaaaggtatataggaaaggatgtggagatagccatgggtgatcggggtttctaatcgcaactcttctcatcacttgatgcatgcacattggccatcctgtgccccttccttagactcaggcatccccaacagtcccactctcatctctgacattctgtggcatcgagtctccagttaccaagggagctttttggtagtggagaagcaggctgagatttagagtagacccctctttaaatgtcaccgtgcagtgctttcctgtttaaagggagattgacagccacaagcaacctaatgagattgctgctctgccccttctcttagcagatagagaatctcgcaggctggaaagcaagaggtgccttggggaaaggaggcaggagcaagtggcgccatttaccaactagtcccaggtctgcacccgacaggaggcaattattcacgccaatgcttctgaagaaagtggcacttgagctggggggccctagtgaagcttgctgctggctccccaggaccacctccccttatctctggcccaccgtggctctgagagaaagaccagtggaaagagtggctgctggaagggtagaaagatctcaggactggggcagggacctggttctagtctttgctctgccgctggcttgttgtgtgatctggggcagcccattcatctctatgggcctgtgttacctttacaaagtaaggaaaatgggtaaagggcagggcctatctgctttgtttaaccctttattcccagcatctggaagagtgcctggcacacagcaagtcttcaatcagtgttattagtggaaagaatgaaatggaatctgcagcaatggaaagacagggggatgattttaagcacaaaggaaggccaagttctgtcagttgctttagataaaccactgtggctaccatgtggaggacaagattgagacgactagaaccaggacaactagtaaggaagctcctgcaggaagatctgtttaaaacaagacagtgagctgagtgctataggatttgcaggctagggtttacaccttgcaaatacttttgcatactttggcacatacacacacattacctgatgccatctttacaaaggcctggagaaggagacagggcagggattggtactcggcttttccagacacggaaattaagatccagagtcgtagagtgccttgtgcaagcatgaagctgaaaagtggcagactcaagactcagattgggacgtgagaagacactgaacatcactagtcaccagggaaatgcaagtcaaaaccacaatgaaacactccccatagaatgactcaaattaaaaatactgactatgtcacatattggcaagaatgtgtaggaaatggagctctcatacactgcttgtggggatgtagaatggtacaaccactttggaaaacagactggcagtttcttataggtttaaacatccatgtaccatgtgatccagaaattccactctgtatatttactcaagaaaaattaaaatgtgtgttcacacaaagccttgtttgtaaatgttcatatagccactttatttttaaaaatccaaaaagctataaacaaccagattgtctatcaacaggtgaattaataaacaaattgtagtatggctgcacaatataatattactcagcaatgaaaaagagtgcataactgatacagtccacaaggaggaatctcagaaacagaattctgagcctaagaaaccaggccccaaagactagaagcaatatcatataattccatgtacacgaaactagaaaagtccaatctaatccatagtgacagaaagcagaatgtggttgtctgggccagaggtggagagagagattgaatgcaagggggaaggagggagcttcggggagaggggtgcaggaaatgttctgaattctaattttagtgggagatgcataggtgtttacatttatccgagcttgtcaaagtatgctttccgtggttcattatattaaaattataaaagttgacttaagaaagcagctgactcctcctccagggcctttgtggcttatcctggttccctcagaaccaggaagatgcacaaggcccatggccactcacctaaccagggccagagagcctgacccagagcacctgcagggctctccctgagggtgagaactgctgagccagggggcatcaaggctacttccttagcctgttcctctttacacttccacatccacatgtcaaccttggtgaggaggccttgcagaatggaacagctgtgccatctcctcagagacagcactctggctccaggctcagagatggccacctatccccgaaataacctggtggtattaggggtggctggcctttgctccaggaaggccccatcaacacagaaacaggcaacatagaccaccgcctccattaaccttggctcctaaaggcttgaggccagaggtccaaagtcaggcctggggtctgttgtccttgtaaaactcagaaagtgtaccctgaggcaccagcctttgggaattctgggcatccttccctctctcctgcctcaggtaaatgcccttgcgaggaaagttgcagttaccaacattcacacttagaagtgcttggtatctgaaagaaaatgctccatactcaatgggaaggaaagttccaggaagaaaggagagagcatcagagcacccactggtgcggagtgaggtcactgaggtagaaaaaggctcaggtatgggctggcactgaggtttgaggtgaggccagggccttttggtaggctgcctggattttgcagctcctctgcgtaaaacttctctgcatcctttgacctgtgcctggaggacagaagtgtctcccctcctccagggtctaaggcttgtcaggatctagctgcagctgccctctgccactcttgttcacattgcctttgctctttcctgcctctgtgcctcagcccatgctgttccttccaactgggatacccttccctcatttctccatgtggcagttctaatttacattccagtctccactccagagacttctgagaagccttccctgatcctcccggcagaattaattgttccctcctctgtgctcagagaacacttggcttgctctgccatttatttctgggtttgttttcatgacaacctcctttcacgagggcagaccctgtgtctttttaagttcttatcctgagcacttgtacagactggacaccgaggcaatgcctgtagaggcaatgagtgccctccgtcttatgtggacatctctgtggacaccagcgtgctaggcagacaggccctgcctgcatgtgggcaactgaaccctagccctggggcaggaccctggggcttagttctataagccagactgcacagccaaaaaagggcagtcttggaagcaggaatccgctctgctaagcctctgatatttaccagactgacagtttcccagccaaagcagcccagagacagggaatagctggagaaagtgggtcatcttgactcttattcaaggcaccaggggagccctggggtttagccgtggcagcgatggagactgatcctgtcatttgcttgcatccaaatgaaagggattagtggctgcaccaatatactaattttctatgcaacacagggcaagggcagccagtggagatttaaaaactctgtgtgtgtacatgcatgtatgtgcatacatgtatgtatattataaatacatatatactatctatgcccacatcacatgtacaatgttcaagtgaaaatatctacatgtatctgacaggatggagaaaaggctttaagagctttagagctggaagtctccagtttgagtcccagcattgactcaggacccctaccctccatgagcctcagtttcttcatctggaacgcagacatggtgactgtcctcactggaaggctgtacagaccaaagtgtcagtgagtgtgacagtgaagggacctgctataggcatccacggtgatcttcagaagcagtttctgcttccaagttggatttcctggcatagatcacattcaggtctcagctcatgctcaaggtccacttgcaaatcacacaactccaaccccaaaagggagccaggagtgacattacccctgaaggtgacagatgcacctgtgcatcacagagctagctctagcatattctgtgaccttgggcaacaatcttcccccatcttgtcctcagtttccccacttgtacaatgatagctttggctacctcttcattcttcatatcttagagcccttttggagcagggagggaggtaaagctctgggtgcatgcctgggcaaggatagacatagcagggcaggctcagtggacaggggaatggccccaaagctgggacaaagtcagattgccaaaggcaccacttttatttcatccttcgctaatattctgttctttggcctcacagccaccacctcctcctcccagtcacagaagaagcaactttaaaattaggttttcctcttaacttagaaactaagccccattgtgtggtccatgacaacctcctttatgaatgaaaccagctcataatgaggccctttcccagcatcaagagccaagcccacgccctcccttttctgcttggccaacggcaatggcagcagagcctctttattcatttctcctgctccatggaagggagggggagagggaaatgatcattttcccatttcacagatggacaagggcctccccgccacagccctatggctcccagcatttgagggctacccattacctctgccttacaaagtccttactgcatgatgggacttcagtcccctttcccgtgtcatcctctgccatacccccttgctcctctgcacctagatgggagaaaatgtccatgcttcccaggcagattcttctttatggcctataaaactcctctaactaattctaggctcagcttcaacattgcctctccagtgtgcgtaagtggctccacctctgtcctggccctaccccttggataccatttacagggcacatctaactatgtagttgctcatttaactctctcctgccctgcatgtgggagctctgtcagagcagggcccctgcctcatccctcctcatcccccagccccagcacacactctggacttagaaaagccccaaagaatgtttgttgatgagagagtccttatggtatcagtgagaactgaatactgtggggcttcccgtgtcccaggagcaagtgcaggggcctggcttcattctttgaggatgtctttaaagagtccatagatctatgttgcccccaactccaaagttgaacctatttccagacaccctcctgaatctctcttgattgggacaggatgggatctgtcctagtctgttcaggttactataacaaagtactatagactgggtggcttatagacaacagaaagttattactcacagttctggaggctggaagttcaagatcaaggtggtggcaggtgtgatgtctgatgacagcccactttcttgttcatacattcatagatagcgccttgtagctatgacctcacatggcagaaggtgcaaacagttccttcaggcctctcttatggttgcattcatgagggctccactctcatgacctagtcactttccaaaggccccacctcctaatactattgcactggagattagggatcgacatataaattttggggaaacacagacattgaaatcgtagtaggagctcagctcagtttcatctgggattcctcttgggccccacctcctatccttttcctacaacttttaacccagagacagagagatgaagagaggccaagaaactgagagagggagggaaaaaatacaaagaagagagacataggataagacaaagacagaaatgaagacacaaagagatgagggagaaaaggaatagaaggaaagggagagtgaggagacagagaaagaaaaggaaagaatgccattcagcaggaggagagggaagagcagacccctgggcctgggtggccttgcagccgtggaggggagcccgccagcctggcagccagcgtctgcctcctgcacagggcccagaaagaggcagtagcagctgggccgagcatttggctgtctgctgagcccaagcctctgtgcctgaccttagcccagctgctcaaatcctcctgccctcctgcctgcagctgcccctgcactcccaagacccagaggctggggagtggagagtggagcccgccctcttggtcagctctgtcagagaggcaggagccccatcacatgccaccagcggggcccagccagaaacccattttatttggcttggagatgagacatgtgttttttgtgacagtggatctcctttctagttagaaacttactacgagtaagttttgaaatcagcctcatttcttgaactcagcatacaggaagaacagtgcctcgcgttggtgtggtgcttttcaggtttcaagacacctccgctggtgctatttcttagatgcactttccataacatctccacctagtgggtatcaccccagcaacgagtgggatcctgggagggtaagagacttatccaggcacagtcagcctctaagtggcagagccaggacctacatccagacttggaagtgctgagtttcacctacactgccaccctgactctgtggtccagccctggctggttagttgggggcaagctgtaggtgggctgcaggaataagggtggaaggtgtccggctggggtataaggtcagcgtccttttgctcctattttatggagaccacagtcataaatttagggatgcagggtgagtcagcccacataatgtttaaagcaatgaagatcttttcaaattttttcccctgaaggcctagccattcttcgtgctttactgctcttaattgggatcagagcccagaagcttgctgggtggctggggaaagatagagcccagggacctaaaacatggtcagaaataatcgacatgtaatgagatcagggaaacatttcctcaagttcctctcaggacaaaagctgagctctccatgggtctgagtggaggtggaatgacccaacaggaggaacagggaggggatttgcaggatgggaccaggaaggagaagaaggaggggatggaagaaccagagcttggggtgtttgttggactgtgaggttagtgacgtgaccctgtccttcccacagtggcctcagcacagttacatttatgacatgtgagcttctgggggcatcagattggtctggggatgtttgcatgattcttctgggaaaaagtcaaggccggggatctctggaggattacatgtcttggagttgggggttacagccaagtgtgcctgaatactcagggcccaaaagccctggctgacatctggcttattgatacatgaaaaatatgggcaggatgcagagctggaggcaactgggaatgtactggaggtgaatgaatcaggatccaagagagcctgccaggctgaagtagggctaagtttgttatgttgaaatttacttggtgcaggtcaagatagctcatgaggctgacacaagatcatccctccctttccaggcgcctctaaatacctgatgaagaaaaagcaagggaaggaggagaggaagagggagagagggttgaagccacacaggcaatgaggcaccagagcagtatgtgtcttaggagctgggtgggagtgggagttgggaaggtctctggccctgcaactgggctccccagagagagctggcagccaaggaaggacttaaggtcatccacgtttggaagccagagcctctctgcctgtgggagatggaatgattggctccaattatttagccctctctgcatcgacatgcctgccatggcctcatcgtgggtggaatatttttccatgccccttcactttgggctcagctgtgtaactggctttggacaacatgccagatgcctgaagaaagatccagaaagatggtcagagcctggagccaggctaaatctgtaaggaagaagtctaattgggactggagacttctggccaacatggtggacaaagctaacctgtggtgggcggtggcagtgagcccattcgaggctgggtctctcttgggcccacttgctctctcgagtctctgccaacatcttgaaaggcacatgcctggctagcctgctggtccaaggaggatgagacacagggagcagagctacccaggccgaccatggatgggtattcaaccatcccggttttcccaggaccaaggcatatcctgggacttgggactttcagcactcaaactaagaaagtcctgggctaactgggaaaagcgggtcaccctacccacacacctgcagttagtagcatggctaacccagctccataatctaggagggccaccaagccaccatggcctaggttggccagcacagtgtttattattgtattcactcagattttgtggttgtttgttacacagcaatgttgtggcagtagccaataggtaccttgcccatgagcccagagtcacagtcagaagtgagctgactacaccgatggatcccagagcgtggttgaaaaataaataaataaaattcacttcttaatagatgtagtaaaccagtggctctccatcctaatggcatattagaattgcctgggaagcataaaaaaaagacctgacacccacaaaatagactccccagagagtcttttcaagtcttctggaaaggggtcttggaatcagagattgtatcaaaagtacactgggtgatactaatgtgcaggcagatttgaaagctgatgggttaaatagtaggtgagacacagctgaaagaacagtgatgtttaatttggcaaatgtaagtgtcaacacctgactcaacacataccaactgcccccaacccaggctgggagatgcagtgtgggaacagttcccgtgaagacaactctgagatctgggtggacccaggatcctttgtgtggtcagggttctgcagctctaaagaatgcttaggagagagaggtgagagtcctgccctgcattcctgagagagagctgcattctggaacctctactctaagagctacgtggacagtgggaggtgtctaggccagtgcttcccacacttcatgtggccaggaaacatttggggatcttgtttttgttgttgttgttgttgttgtttttgtttgtttgtttgttttagagatagggtctcactctgtagcccaggctggagtacagtggcacaatcatggctcacattgcaaccttaacctcctcagcctcttgagtagctgggactacaggtacatgccatcatactctgctaattttaaaatttttttgtggtgactacatcttgctgtgttgcccaggctagtcttgaattcttggccttttaagcaatcctcctgcctcagcctcccaaagccctgggattacaggcatgagcaccacactgggcctggggatcttaagatgtagataatgattcaggaggtctggggcaggcctgatacgctgcatttctacatgatcgcaggtgatatccatgctgccagagcattctttgagcagcaagggggctggaggtgaggagatgggacactgagttccgtgaagaaagctgatagccttggactgttcatgcccagatggagaagattcacagggggcctcccattctagaagggctgtcaaggtgtagaggggtttaacatggtccaaagggcagatctggagcagagaggggacatcacacttagatgttgagacaaagcccatgatggaataaccaccgtgggaggtagtgagctgcccatcacagcagggctttagccagaggctcgatgactgcttggtgagagggccatggagaggccccaagtggcagccatctatgcagtcttcaagggctcttcttgcctcagagtcattaatttttgggcgtttttacttctggaagaaatgattcagaataagtggagaacactggggttggtgatgcagaggacccaccacaaggcctccctcctgagcacacagaaagctcatgccctgctggacagccaggcaggctcagccatgcaggttgggttcgctctctgggttcgctgtctggctaggacgagctgtggtcttttcagaatggacatcacattcctggtcagcagaagctatctctttggctaaaccacttagctctggacaaagcaagttccagattctagaaaaataaaattaattgacatttgtgctcagtgcttatgctggtagcaagattctggtctcatgacaatcattgctactgggcaagtcccatccttcttcagtcctcagttttctactctgtaccatggaattggtgtggacagtccctctagctcactttctacagccctatggaaaatatcttcagccgtaaaaggcactgtttagcgttcagacctcaacagaggagtgaaaatttggctgattcagaggaaacaagaggtcagtgtgacctttctctgcttctctatgggaaggagtttacaaccacggtgccaggggcaggaggctgcagatgcagccagcctgtgctgggcacttctgctgccctgggctttgagtcaagcagagcactttagcccccgagggcaggtccatctggagctccagacagcgctcttcctggcttctcctgccaccctttcctctggtccaggcccaagcctgctcagacctcagcaatgagggccagcagggaggggaggcaatgtgggtagggagtggctgagagctacagctcactgtcagggaggagggggagagggagggcccagggcctccaagccctatgtccaacatgcagaatgaagagcaaaggcttggtgctgacttggtggctagggaatcggatgctgtatttgcaggatgcaccgagtctgctcaagtaaccagactccatagcttaatacaataaaggtttatttctggcttacatgccagtccctgcaggagctggtaaagggctctgctccacgtactgtctcagagatccagcctggtgagacccctcatcatctagtgatgctgccattgcaaaaggtggcttaccaaggaagggggagagactgtgttaaaagcatgcctgtccttacacgccctatactcgggtgacacagatcaccaccaaatggccaatagtcactgactaccaggggcaggaatgtcttccgcatgcctctaaaggagaggacaactggattttgtgccacaaaggaacacccataatccctgccatgtagagagactttccactgccaggcagcgtgtagagcatcctctgtgaatgatcacatttacttctcagctggagattcatatcattacacctgttttcctgatagacagattaaggccctgaaatgtgatttcctgacatcatacagccaggatgtgccagagatgagatttgaactccattctaccttattctgttcaagcctaggttctccaacattaaattcccactcaagggaagtgtcaggttcctgacagtttgggagagtccctgggcatgcaagagacatagccactcactcagtttggtttccaggtaggacctcaatcctctccaccccagaaaacagaatttgagggtttctgtagtcaaggagatcctgtatggaggaagccctacattttgagcagggctggcccagcatgggtgagctggacttggaagtcccagactcatttctgccagtctgtcaggtttgatgttgagggtccctcacagccccaccccttgggcagagctgtggatatacctcctgccctgtgtgcagctggcgcaggcatggggacctggtgggaattttggctgggaagggctggtgatggcacagcaggagcagacagctctataaagaaggaagctttggtcagagaattttgggtccagtgggagcggctcccatagcccctcccctggcacacagggcactgcagccaccatgagaattcccgaagctccctgtgccttgagcccaactgcgtctagagctccacagctgcgcctgatggaaaagcaaggtgaagcctctttctgcattttggagcatttctgtcaaaacaaaaggagctggaaaaaagcgaatcctattgaagcccaggcagagatggagtaaacagtgccttttacggctgaagatattaaaaggccacttggtaacatgacaacaggcctcctccagccttccccctgctgttggccgggcatcctcgcctgcctcacttcaccttggtgtttgttgcagttttaaggtgcttctgacgactttatgctcacagtttggcaagcaccactctgcatggatctcaaagcacgtcaggggtcatctccaaggagcagtcgtatttcatgcgtgtgtggactttgctgtattggaaactgctggctgtagaggacctattaaaaacaaatgccctgtgttttcagtctctctcacctgccaagaagttttcttgatggcgctgtcccagaaaaccatggcagatgaggattagattagaataaattgatttagaagtgacatgatgctccttgggagaggcttaaatatttcatacatgtgtatgacacagatttcagctgggtcttgcaggaagagagagggaaatggaaatctcatacccagattcagtgcagccttggactcaggctggtctcctagtctgctgcataactctttgcctcagctgccttagctatacctggggacagtggatgtttagcactaacctcctactatgtttttgaagtccctcaaattggtgagcctgaactagagcctccttcaagggtttcctggagttctgggcagtgcctaaggttggagggatgggtttttgggggggcccaggagggtactgaagctacctgggattcatataccaaatcctctgagatccaaaatctccaaatccccaagacaaagtgttggccctctctcctgccccaccttattcacacgctcacagatggggccgacccttagcactcttctctcggctgctctgatccttctccaagtactgatattcctgcgacacaaaggggatttttccagggcctgcaacccccagtccagtcactgccccaaccatctcccagggaagttacttaatgtggggagaccacagtggcttgcatattgagcttggaaaccacaggtcacttgggatgataccttggcctgtgtttgcactgatgggcccaaaagaagaggatataaagaggaattagggatcgtctctagtccctggaataactgggtaaaatgtcttctgagaggaggttggggggcttctccctgaacccctataaatgtcttcctggggcccagagagagaagagcagagagggtctcctgcaagctgatgaaccaggaagtcttcttagcaaaaagggaatgtcagggcaagagctctggtcttagtggaacctacacatccagttcctggaaggaggagacagccagagaaaagaaggacatggttatttattgccttggagaaaattcatctccaggaacaagtctcacagagtgtgtgaggtctctttgggaagttttgctcctttagggcaaataattttaatatggtttttgaatgtctggcaaatgaattaatgagaaaggatagggggtgatccttgggataatgtgtggggccgcaggcgtctctggacctttccagagatcccaatcctgctgacgggggtcctgagtgggtcctcatcaccactgtcatctgcttccctcaccagcctttagtctcatctcccatgaggcacagattgtggaaactctcctaccacagacaggttaggcgagccccttgctgagaggtcggaggggctagcagaagggagatttgctcatggtttgaaaatgcaaacacatgcttggggaattactgcccatggttagggggatgctggagatgagggggcctttcattgatatcagcaaatactgagaacttgcaatgtgccaggtggtcctgggcactgagaatgtagcatctggcaggatagagctctcgttttggggatgggaaaaagagagagaaaagaaaacaaacaagtaaacaaacacatgaagattatttcaagcattgtaagcactacaagggtagtataatagggtgacatctgagagagaggatgaatgggggtccggctttttttgggtggccaaaggtgttctctgaggagatacatggaacagaggagggacaagagaagacgcagaaaggcgagtgaggagactgttgttactgtccagtagggatgctggtggcttggaccaggaggatggcagaagagatgaggaaagtggacatatatggaacatagtttagaagtgtaactaacaagattgattggtagacaggatatagtgagtactaaaaagggaggagtgaaaggtttcacagaggaataagatttcacagaaaataattctatgtatttatttattttctgccttttccattaatgatttgcagcttcttacaagagaacacagagagtcaaatcaaatcttttatctcaagaatcagaaccaaaggaaaacagcacatgaataaccccaccctagagaccaacagagttaccatagtgagtttcaaatttgactccgagtttcttagcaggtggggaaaaaaagaaagattatatagtcaagataatatttgtgatttttcagagtaaaaatccaaagcacactattttctcaaaaaagagcagagtctcttaacactggagtctgggtaatttttcccaggtggacatttgacaaagaactctgcttgcagtgcagagtgggatcttaaacatgctggtggcacctgcgttatgacattgtacctgattttcctaagagatgttggtactgctaaaatgcagcagagtggggaaaggcattatgggaaccttattacggttcatggaagagggaatgctaaactgtgcttaaaaaccagaggatagaaacataacgaaatgaaacgctgaaaaagtatagagactggaaagtggaaattgccctgggtaagtcaaaaaatcatgtgtattttccctatatttgctttgactgttctacagacaaagtttatttttttctgattcaaaaaattagtatatacacacacatcagaaacaaaattgaaaaatactgaaaagaataaataaaataaaaatctctcccccagagataaccatcattccatgttttatgtatttctcgtgaatcttatgaactcacacatgcacacacatacatacatttgtgtgatgtatttatgctacatttcctttcttcttggttgtacattctttgttttttaatgtttttgaaatcaggatccttcttatagtagatttaatgttttccttttttctgaactattattaagccagtgatgcctcttgatatcaatgctgttacaatggaggaaatgtggtatatagccacaatatcagggttccttgtgcatatataatttggcctcctgctacttccatttaacattcgatcatgaatattgtcacatgccttgaaatattttctaaagatgttatttttactggctatatatattctatcataggatgtcccaaaatggacttaatcctttcctcactgaaaaacaatttctcaaccacataccaataatagaggctactcacacatagcttgaagtgaaactatacagctccatgttacccctgaaaaggggggtgtccgtgtgtccaacaatgaaccaatggtgcagaggtcttgtctgtttcactgcttgagctgtggccaggccatgctgtttaacctcattgggcctgggtttcctcctgtttagcataagaaggctttctggagtttttttctgtttaatggatgctgatagctaaaccttggttccccaaccaggctataggaaaccagtagctttgaggtttgagttgtgtcactgtgaggaattacacagacctatcttgatgctcccaagccctgggggatgctgtgtcctcaagacgaagggcttatcactaccctggcactcagatcccagcctcctctcagaaactctgcaaattgtaatgcagctctgtgggcagagctgctaatacttaccctcaaccctatgtaaggttcagcattttaggccaaatgtagtttcctgatgaaaatatcttccccagaaaagccagagcttgacgtgcaacggaccaaccagaggctgctgggattcccatgttgtgcctggctgcagctgtgggcaggttaccaaccccattgggattttcatccaggcctggaggatgttagaggtggaaagggatttggaggtcagagatgttgcattacttaactttcctctttgtataaaataagcactcctcaaatatttgttgaatgatgagtgactgaaaatgctcagtgtggctgccaagaaaggtacccgaggaaatcagagggctttgatgttggggaagaatgtgatctacacaggtctgtttgtcttgaacatcctgtgattctatgaattgcatataagaggaaggagggaggaagcagttttctcctcagcccctgccacctagtgcttgggaaagtcagttcaccctttggggactcagtcaacaaatgcattcatgcagcagtgtgattcattgagtgctgcggtgagtcaggcacaggtaacaaatctatagggtcaccagggaccagcagtcaaggattcctgccttgtggaatgaagagaggagaattacagatgactccaaagttcctcacctagaaacaggactgcggactcaaggtttcccaggcagattcaaaattggggaagctttcctggaaatgaagctgtggaacagacttcccctccccattgccccccaaaatgccaacctactatgacaaaccaattgagtgaatgttaatgaactacaggtggagcctttaagggtggctttgttcccttggattttatattcatatatgtttttgaagatcaatttttttttttaacggagtctcactctgtcatcccagctggagtgcagtggcgcaatctcggctcactgcaagctccacctcccgggttcatgccattctcctgcctcagcctcccaagtagctgggagtacaggtgcccgccaccatgcctggctaatttttttgtatttttagtagagacagggtttcaccatgttagccaggatggtctcaatctcctgacctcgtgatcctcccacctcggcctcccaaagtgctgggattacaggtgtgagccaccacgcccggcctgaagatcaatatttttgtagcttctaatctcatctcctggaatctccttggggcccctcaaatgagtgttgttgaaggctgatgacaggagaagagtttggggggctgtaaagcactaggatcccatctttcattgacttgtggtgtgacctcaacacatcctcctccactttgggactgaaagtttctcatctgcaagggctgccagtcaggctggctctcaaggggcctacactcaaggattctagggttttggtccagtcatttccggtgtcaaatcccttttgtttataaagtctacagagaagctttgggctgctgagccattggtgttgatccctcatcctttacacacttagtgaacactctagaagactttgccctttcccctacaccaaatagcaaggagaaaatattttagtagtagtggtggtgacactgaccaattaaccttccctttgcaccatccttggatttacaaggcatgttgccatccactgtctcctttgagttttacaaataacccttgaaggagggaagaacagggcatattctgtccattttgtaggtgagggattttaggatcagaaaggttaaggacatgtccaagtaggagtaaatggtagagtgagtcatccagtccctgactctggacccccttctgctcaccttgcagccagaggcagataacacatgtccaatattaggtcaaagggaggtaagcaaagccctgtggggaagggcaggaggtaggagttgaggagagaggaagtgggagtcctgggagggtgcagatctagaaaagccagtgccatagtgccaggcagagtacagggcatttcccctgggggcatgctcttccctcctgccctttgtaattgtgcttctgctgaacttctgcaagacatctgacgttacttttctttctttctttctttctttctttctttctttctttctttctttctttctttctttctttctttccttctttcttctctttctttctttccttcctttcttttctttctttctttctttctctttctttctttctttccttccttccttcctgcctttccttccttccttccttccttccttccttcctttctttctttctttctttctttctttctttctttctttcttttttttggagtctcactcttgttgcccaggctggagtacagtggcatggtctcagctcactgcaaactccgcctcccgggctcaaatgattcttctgcctcagcctcccaagtagctgggattacaggcacccgccaccacgcctgtctaatttttgtatttttagtagagacagggtttcaccatgttggccaggctggtctcgaactcctgacctcaggtgatctgcccacatcagcctcccaaagtgctggcattacaggcatgagccatcacacccggcctgatgttacttttcatggttaccaggtggacaaaacagaggaatgtgtctaaatcctagttaaataaagtaggttcgtgataggttgaacaattccacttgctgtttagtggataggagtcaataggaaaggaggtgtctagtggcctaccactgggcccatcctcagctgtgtcactcactataccacctcctgggaaggcagatgatggtgcacatggcaggctgacaaatgtcatttgaagttgacactaagctgggcaaagctgaggctgtttggaatgacaagcataggattcaaatgatcacatgatgggctgactcaaccaagaataaatacaaggttctgcttgaggatcccccaaacctatatttgaataggaggggagctatgcacatatgaattcccagcatcatttgtggaggaaaaaaggaggcatttaagtttcagtttctagtatacaagaaatgacctgtggaactgtcagaaaaagctatcagcagcatgaactgtattcatagaggtagatattttgtcagagggaggtggtgatctttgtttgttttgtgcatattcgtggaagtgggattactgagttaaagattatggttattttttataactattagtatgtattgccagattgacttccagctggtatgtacccattttcctgctcaccagcaatatacaaagaatgttcctttcactgcattcacaccaacattaaatgttattcttttaaaatgtaagtaaaaaaataaagtcatattttaatttgcatttgtttattaacagcaaggataaatttcattttaagtgtactggttatttgtgcttcttttatgaatcataagttcacgttattttccagttttcttttggagttttcacctttttcttaatgattccagtgagctccttacagatattaactcttctccatcacatttgatgagaatatttcaaagggaaatattttctgcaatttctctttttctctctctggatccaggttcctgaatgcctccgtctcaacttgcatgaaatgtcccgtgaaattcctggagaggcttccaggccatatgctcgcagatctggtgctcacatgtcagaaatgatgtggctcattcttccctgcctctgccaccatatgcatgtgcccctaatctgaccagcagatcagcagcttgggggaggacatgcccacggctggcagaaagctgcctggcaaatcttgacaccctggaagagagaagatggcgatggagattcactttctaagaatgcattcctttgttctcaaagaaaataatggatttggtgttttcttgaacttggggcatttaaatgcatctctaaatcaaactgcagcagagagctcaggttcaggtgatggtctgtcacttacctctcctgtcgccgtggacaggccatctcacctgcctgtcttccatttctttagctggccacttggataccaatagagttgtgcttactgtgcttaaatattgcttttccaggggaggtttgatgactttgtctactcccatactcctcagatgccggaaacgacaggctctgtgtacccctgtggaccagccagattcttgagcagattttcctgatctgtttaccaggaaaatggtatacccagcagtttcggcaattccagagtccttggtggcctggcagtaatggtgtctctccagtcacccagatgtccctatacagctctctacatcagggtttggccatgggccaaatccagccaccacctgtttttgtaaataaaagtgtattggcacaaacctgcatatttgtttatgtaatgtctagggctccttttgtgctacagcggcactgttgagtagttgtaagagagtctgaatggcctgcaaagcctaaaatgcttactatctggtcctttacagaaaaagtttgccaactcctgctctagattgatggttacaaagtctgacagaggatacagttacagggacatggcaaagccagaaaaacgaggaccgggagtccagctttcaacaaagccaatctattcaatctccagactaccctttgtaccaaggttagatccatccttcctttcccattaaaatatcttaacttttatgaaataaacgggatagtagacttgtagttttatttttaatgtccttactccaccagttaaaaagttggccactctatgtagagccccaaaataatttgaaaatgttatccatctgtgtaatccccagatcaggaaccactaatagtctaccttgaaaggtcctttggaagccttccattcaacccatctttttccatttcactacttgtaaccatacttttgccagcagcatcttcatttatgcattcattcattcatttgtatattcattcatatatttacctagcaagataagggctaaagactgtgtcagaggatctcacattttctgatctcaggacccattttattcctaaaaattactgacaacccaaagagcttttgcttatgtaggttatatctatcaatatgaaaaactaatactgagaaatgttaaaaagatttatttaataatgcagttagcaatagcaacaaaaacctactatacattagcataaatttttttattcaaaataactatttttcaaaacaaaaaaatgagaaagatggtattgacccttttgcaaatctctttagcatctagcttaataaaagacagctaaatttttatgtctgcttctgcatccaatctgttgcaaaatgttgttttggttgaagtttgtggaaagaatcctgactcattcagatttgtagttggaaaagagaggagtattgccttttcagataactgtggctattctcttttggtactacactaaaactcaacatgtggtagtctcttagtttagttgtgataagaaatctgaaactatatcaatgaacttttggtacctgatttacattaaattccatgtttctatcttgtactttaaatggaccttttacccatgcacaattttggagtatgatgcattggtcatttagaaaatattggctcactagccagagatgttttgaaatgttggcccatttaattatacaacatccaagaaataaaattaatttatattacccctgatctcatcagaaaatcctgtaagtattgggaaacactcaagctcatgttgttgaatatgagttgtccaaaacgttaagtttctttgggacacttaaattttagctttggcaaccatatgatggttgtttttcttgaagcgagagactccctacatttgattttgagaaagggtcatcgaccagatactgaataatcagagtaatcttaatttgcctatcagtcatgttttcaagtaaaaatgatgtcccacctgggcatggtggctcacacctgtaaccccagcactttgagaggccaaggtgggcagatcacttgaggtcaggagttggagaccagcctggccaacatggtaaaaccctgtctctactaaagatacaaaaattagccgggcatggtggtacatgcctgtaatcccagctactcaggaggctgaggcaggagaatcgcttgaatctgggaggcagagattgcagtgagccaagatcgcagtactgcactcgcactctaacctgggtgatagagtgagtaagaccccgtctctaaataaataaatgatgtcccatggaaaaaagtggctattttagcatgacactcgcagggacctttttttgaggtaatcattgtactgcaggaggagcagaagtgctagacacagactccttattttgttacacaaaatattaaaaagctgtctacccacgggttgagacttaattaatttaatatgttgctctgcttcatcaaggacattgttaagtaccttcttaaagactgagtgcaaaagagtatgatgactaccagtccagtctaggcccgctgctttgattcttgctgaggcaccagcaatttactgcggccactgtccttgcatcgtcaatgcattgcagcaccaccaccagagccagcagcaaatcgcatctcagtaacactgtggagagtctttcacctcgtggacttcttgaaagggtctggggggaccctcggaagtgcacggaccatgctttgagaagcactgtgttggacacagtcggggatgctaggtaaatcagattcaatccttggcactgacgtattcaccatctgatggtacaggttgacacttgacaactcaaatctaagtcggtatggaaaaatactatagggcattattttttattgtggtaggatatgtataacatgaaacttaccattttaaccagttttgagtgtacaattcagtggcattaagtaaattcacattgttatgtaaacatcaccactgtctgtctccagaatatttttttgtcttcctaatcagaaactctgaacccattaaagaataactcttccttctcccctctccccagcccctggtaaccaccattctgtttgctatctttatgaatttgactactctgggtacctcacatacatagaatcatataagatatggctttctatgactggtttatttcacttagcctgatgtcttcaaggttcatccatgaggaattttcttctgttttccctttctttccttttctttcttttcttttctttctttcttttttttatttttttgagatggggtcttgctctgttgcccagactgaagtacagtggcataatcatggctcactgcagcctcaaactcctgggctcaagagatcctctctcctcagcctcccaagtagctgggactacaggtacacaacaccactcccggctacttttttatttaattttttgagacaaggtctcactatgttgcccaaggtggtcttaaaccttgtgcctcaagtgaacctcctgccttagcctcacaaagtgctgagattacaggcctgagccactctaggcagaatgtccttccttttaaggcctgggcaacagagcaaggccctatctcaaaaaaaaaaaaaaaaaaaaaaaaaaaaaaccaaagaaaagaaaaataaaacggaaggaaattcctcatggatgaaccttgaagacatcaggctaagtgaaataaaccagtcacagaaagccatatcttatatgattctacctatgtgaggtacccacagtagtcaaattgaatgaatataccacatgttattcattcatttatgaatatttgtgttgtttccaccttttggctattatgaatcaagatgttaatttttgcaaacctggcttagtcctccagtcagctcctgattattctttctttccttggcaggaagtcacggggtgactccaagcagggccccctttgcattcagcctgcccttctctcagcccaggtaagttcacgttagtcaagaattccagcattctctttctaacacacactgctcggacctgacacccctgcactgcatttccttgttgtttggtctgcgtaccatctataccagagtagattcagcaaacagctgctctcctttcgtttcatttcgacaagtctttattgatcgcgcattatttgctcatcaaacagatctgccgtttcaaacacttacagtcctggagttggctccacgtttgcctgttaaatctgtatttgcacacgttggagttggcagttcagctcaataaagacaaaaaggtctacgtgctggaagtaggtgtcttggtgagagtttccaaagcatggggattttttagactggctgaggcggccttacctaccaaagcctccctaaaccatgtttatccatcatttagatattttattactagatgtatcatttcatccaggatttgggctattgtgctgcagcatccagtcagttgagtgctaaatgacaattgggtaaattagactttcagcaaggagagttgtatgttctgtgaaacatacaggaagagaaattatattgtgttctgtcctctttgtatgtctcaccgaagctccaggaaagaagctgccagccggcactcaccttttaattttgaaacagcccttgactcaccatcattcattggcacatctcattcacacacacttgcccttctgattggaaaagtccctcctgttttcacaatggaaaacaagcacttgagacctactaataatagggaaaatgaaatatctgcctcatgcttcactgtttataaaacccttccaagtaggttatttcatgccatcctcacaatagacttgccattaatgatgtaaagtgatatgtaaatgctcagcccagtgtctggtatccagagggaattctgagtgggtggttgttagggaggcattatcatccccatttatagatgtggctcagagagggtaggcccattaaacacagccacacagcttgtaaagagccatttcctaaactgtaaatttatgtcttgggatgtcacgtttagtgtatgtgtgtatatgtatatatcatgttttgtatatatatgtgtgtgtattgctgtgaacagtagatacataatcataccttccatatgtatatatagagtcacgtttttttttttttttgtgtgtgtgtgtgtgtgtgtattgctgtgaacagtagatacataatcataccttccccaggacctgcccagacatcaaaataatctgatgtactaactgcttttctgttcctgttttaatacgagcctcacaccaatgaaaggacaaggcggaggaggaaagggtaggaaagcagaaatgaatgaagaattctctaggtgtgtggtggtcacacactttacgtaatttaatccttagagcgaactgcaggggtattatttcactgttctataagcaaagcaaatgaggattgggaaggttagaaaacttagtatcacagagctaataagagaaggagctgggatcacaaaccagatgtgtttgatttcaaaattcatgtcctgtccgccatcacacaagctaaactgatgggcttgagctaccaaagttgggtcaagaaagcggcggctcttcaaggacatttggtccaatggccttaccctggactgcatggctgtgagaggctccgggcatcttcatatgttttatgaaattatgcatccatgggagtgtgcccaagtgcacatactccatgggaaggttcagagtaatcgtaagaaaccaaaataaattttgagactcactgatttattccaacactggtttgtaaatggagaaacaggtgcccggggaggggaaaggtgttaccaagctgtggctgttagtgatagatctgggaccccatcttcagtgtcctgactcccaggctacactcagtgccctccctccctctacctgacagatggtaaagcacagagggcaaaggtcaggattttaagagttacctatttggaactggaccggccagatgtccttggtggacctgcacctaagtggcctcagaaagttccaaggtgagcaaccggggcctgagaagggaagaacaaagcgtccactggcatcttatccaggctcaaaggggcttccatttgaagtgtgagaaagggtcggagctttgctttgtctgaaagggcagcctctgagctccgtatctccgaggtttataatttcagcttgtttctcctcccactccgccatgctggtcattatggcagaaagagcacttgatggaagaaagacaggtttgtctttgcaagaacaatttctctgttgtctgttgaatgccacccaatatgataagtgaaatgttgatacttcagacagactccactggtctgggtatttattcacttgccttagttatcagcaagttcagccagctggccaagaagcaggttttaacttctttgacaagtaaggacttgctgggacgtggtaatggaacttccaatgtcattgttgtgcagtcctttggatttctcccagcttgtccccactctggctcaggtttcgtcctgggaggaaggtggagcaagtggggagggcaaaatgaaggaaagctccaggcaaggtggccccaggtcccccaactgctgactcaacgccttacaccaagtgatgtgcactcagccaccaagtccatttagggatgctggttttcaaccatttaatcagtctatggtagtggttttacctccctggggacagttttgctgtgtgtggagacattttcacaagtaggggatgcagctgtcatctagtgcagcagtccccaatctttttggcaccagagccaggttttgtagaagacaatttttccatggggtcagggttggagggatggtttcaggatgaaactgttccacctcagatcatcaggcattagattctcataaggcacttgcaacgtggatccctcacatgcacagttcacaataggatttgctttcctatgagaatctaatgccaccactgatctgacgggaggtggagctcaagcggtagtgctctcctgctgctcacctcctgctgtccagcccagttcctaacaggccatggatcagtaccagtctgcaaccccaggggttggggacccttgatctagcagatagagggcagggatactgataaacatcctacaatgcacaggacagtgcccacagcaaagaattatgtagtccaaaatattgatagtgcgaaggctgagaaaccttggcataggagtgctggctgcatcaaggcatcaaggaaacccagcatccactggccatctgccacgctggttaccaatgagatacccacagcaaaggactatccagtgaaaatgccggtagtgtcaaggtgaactgaacttagggtgaaatcccaaggtgaaatctgaacttaggatgtttggattctaagcatccagctccaatcaacttaagtatcaaagggaacttattagaaggagagaatagagggaaaaactgatgtggctgacctctcagagagcaagagaggggcagctccagtgtggagtgtgcagagacctaagggcaatctcctccaagtgccactgccaggtcagccagtttctgtctatttgccattagcaaagggatgtgaatttcttgggagaatcctgggattggctaggttgaggcttgggtgctggagaggtcagggaaccttcagatctgcatgccaggggtagggggctggccccagagaggagccagaggtgctcagatcagaagggggctgggtgctggctgtgcagaaccaatacaggtccctgctattagcatggcataggaaaggccttgggctctgtgtcacatgactctactcagaggagccaggcagggcagagattgtcaggaaacacttggagaattgaagcagagacacccgaagtggcaaaatgtgctaggatcaatcttgaagagaacatacaggcacttggtagggtggcctttcatttcctgtttttcaacaaactgtgttttccagttcatgttttaatctgacagacatttaatggctttctctggtatcaaggagttgtgccagaacaccgagcctcatcaggggctcgccttgcctgtgaagagcttacagtctaatgagggagggggagagagagatagagagagagaagcagaaaaaaaaaaggagcgggagaaatgggagtgagatgaaagatagcaaagggggtagtgccatcggagaatgtgtgctgggggcatgggagagctgatgaggttggtcagccggtcatggaatgccgggattccacttggagcatggtgattcttcttactgtggactcacccccttagcagcaaaagaggaagacagccacaaggacccgggaagaaagtgctgctattgccaaagatgttccagtgtctctagagcagcattctgtggtgggtgttgtcctgctgttcccatgtgtccagtgtggggaggctgctcccccgtgaccctccaggccccgaggagaggccatggtggtgttggcaggagagtccctgcatctgttccttttatttgttctgttaaagaaaaaggcccactgagggtgtgcaggagatccaatccaccagtcacatggcaattatttattatgaggcttgaatactttcctgattgtataaggttttattgtgtttttatatggagggcagacttggggagtcattttggcagctgagaggaggagggaaaagagctttctgggatcactctgggaattaaaagttcacctctagatggaggttcaggggctaagtgagattctaggggcttgaccagaaacctcgaattccattagtgcttaaccctctatgggaagttaggaggaaaggtattttcccttttctcccaacatgaatcagattttccctctaaatagctcaactgttgggctccgagagaaaagaggtgcactgtgatctggctggggcaaggacgctgctccctctgtgtgagccactccctccccctccactgcacccttggtggcctgggctacctccagtgtgtcacagtcccacttggtggaaagcagaggtctggctcgaccagctctgagtgcctcagtcctgcaggtctgaaacatggtggctcctccgccagactatgaacccaccaccaccttcccagaaacactgctgtctgatgggtttcacttttgcatcgggtttgagctacatcaaggacccaattcagagaagagcctttttcctaatacacaaacacacacatgtgcatgctagtgtgaattccacccatccttcaaggctcaggcctcccctctcccatgaagctgacaatcaccacccccagcttctgctccttctccccctgttccccctcctcctcctctgtctcctcctcttcttcttacttcatcaccactatttactgagtgcaaaccatgtagcaggcaataggctaagtactttaaagatactattaatatctttgttaatccccacaaaaaccttattattgcctgtactttatacataaacagcctagggctcagaggagttttgctgctcatccagggtcacacaggtagcaagtaatagcaccaaccgttgaacccaggtaagagtgatgcacaggccatctcggcctccggactagactccagtgacctgcacctgcgctggttcccactcccgagaactctctctggatgtcttgcatgcagtctggtgctgctagcagccacgctctcccctgagcaggctgcttggcctcagcagaaagtgcatggaaatccctgtttcttcatctggctctggggttactttatgtgtgaccttgggcaaattatgctctgcttcagctttctggactggaaaatggaaataaaaatacttaccttgcagggttgcctgtgatgctcaatgacctattacatttgaaagttcttgataagtgagagatataaaatatcattatttttactatgtcctgtctccagtgccactaggcagggtcacaagctccttgggggcaggccctgtgcaagtgcctcattattcccacagagcttctggccagtgctgaatatataaatgacacttaaaacaaaggggttgacctaataaaagcaccttgtttataaatgtgctttctctataatattgccaaattgccctccatagggcctgtgccactttgtacctggagcagtggcaatcaatgagctctactgtttctgtacacttccctaacaccatgtgataaccaacattgagatttttgccaaccctataggtaaaaatgagcatctcagcatgatttaaatgtgcatttatcttattatgaattaggtgaagcagagtttcatatatttaacagccactggtatatcctttcatataaatggctgtcaactgtattgcactgttggtcttgtttcttcctcattgatctgtaggatatgtatttgagggatcaaggacatatcatttgcaaatattctttcctagtttgtcatttgtttttaactttatgtatgctgtaactcgtttgagaacatcagcaaagagaagccagcacataagacctggtggaaatttaggagagtccacgtgagctcacaatgtgcttctcgcgctgagtatgtgtctgtgtgccaagagaaatacagagatgcaggacaaatgaggtgaaaactttttttacagatatatttattaacttacactatttatagttaaacaactatggatataatatagtatggaattcaacatttgtataaattttttgagtaaagcgttgaaatgtcaaagtaatggcacacctgcatctgactgctttgggccctgcccccagacactcttttaggggtttttcagtaagaaagtttgaaaagtgctgccctcatgggaatcagtaagctcaagttcttatctcagttttgccctaaattatctgtgtgacttggatgaatcatggtaggtgccataaatgtcataaacttcagtggtgtcataaacatcctaagccagaatagccagtctgtgggcaggggttgctatttactgctgaatcctctgtgtctgggacacatacctggtacatagcagaggctcaataaatagatatcgaatacaaataaagcgacatgctcaaagtgcactttgtaactgtccccagagggacagttttcagttctgtcagcatctaaagggctggcctactctatgtaggactctgggataccaaggtgagtgaggcaggtccctgtccttccccctgtccggaggaagcagacacatgcactctggtgtgaagacgctgcaggaacttcctggctccatgcccctccccactccattcttgcctgggtgttgtaggacactgaggccgaggccaagactgacaactttgccatgtgtatcgaagatcaccttattcactcttctgctatctcaaacccctacccccattttgtgggggacctggggtggtccaggccctgtgagactatcagcaaaagcagtcttctcacatcatggtggtcccgacccctgtcatgcaccctgccctaaagacacatgatctgggctgtttatggggtgtgggctctgagatgtgggtggcagctcctgggccatcggcaggcagtaaagtctgcagtgcaggcctgttttccagctacagctgccacatcaaaaggccaaactccctgcaaactttgccttaattaaaaagttacggtaatcctcaggatagaggccggttggacacccctggagacaaaagttctctctgtggccacggaccaggcccttccacccaccccaggcactattaaaagtgggaccacgctgtgggcatcacagggtctggtgaaataggagcggaaagaccctcttctttctccatactcataatttgctttggagggctctagagccaaacatttgaaaaggggctctggcttcttggacagatttctcattctcacatgcccctgtatgctttggggtctttcccagctgtgttttcaaatggctcaagcccacggaggcaagtgttagagagctagggcctgtggaacacccaagtcccattccatatctgtagtcagcgtggtaattcatattttcattttccccatgagcaaaatgagccctggcaatggaaaggggcttgcccacagctacccagtatactgaaggccagcaccctgctcacggtcctaactgaatcagtccactgttatgaaagttgcagagatagcgatgttcactggactatccatttgctcctccacattccccagacctcttatacataggcagggtcatgtgactggccagtgacatgtcaaccagagtgaaatgcatccgttcttctgctgcatggaaaagcagatattggattctctagcctctctctgtctcactgccaggaccgatgatgacagtgttccacatagtgaagtcttcgtgggtttggggcctgcataagtgcccctctctgctacttgtagtgaactcacattacatatttttgctgtgctaagtcacagagctttttttcttgcagcagagcaacctagcctaacctaagcaatatgctatttaacaaattagccaatgagcacttggtttttactgactcacttgttcatgagggccccgaagagtccatagataaccaaggagaagttgaataaaggaagatttcagctcaaacataaaacaatacttttcacagagtcatgtggagatgaatgtgctgcttcaggacatggtgccatctctacttttgaacagatttgtagctgaggccatatggctttttgcaggaggatggtggagtcaaatccaatggagtggagtgaagatttatctcctcgtgctcagggtctcctctcccagcaattcacatgcatgtgaattccaaagagactccatctctgcaggatggttcttccaaatattctcccctgggcagatggtttttttttaagtgtcctgtatggcacaccagcaagttagaaaagcaaggccgggtatcagctccatatgccccttggctggcatctttgttcagtgcagaaaccatccaactgtacatagcagcaccagatactgggcaccatctcagcaccttatatatgccatttcatttttaaactttctaccatagtccagcaagatgggcactattatccccatttaacaaaatgagaaaaccaaagctcagaaaatttaagtaaattgcctgaagtcacatagctagtaaacagcagagttatagttcaaatctgttctatttgcttccatgcccaatgccctttctatcactctacagctgcccccattcaagctgggagtccatgcccaaggtcatatcatgggcaaagacagggcccaggccaagggtactggaatcctaagcccagaacaccagctccacagtcctacccagaaaagtgaaatttccacaggtgtgataaacagggactatttacaatgctctgagtcttgcctcagtggaaatatttaaggtagtgtcaaaacaaaatctattatttcatttatgaagacattcataggggctggggaaggatgcaatgaaatatttgcttctgtaaccaactggcattctcctgtttcagtccccaagtatgtctgaggatctgggtcctgagtgtaaaataaaacatacttaattttctcaaatatcactagttaggaaaaaagcaaaagaaaagcagagtaatttccttcctcatctcctgccgcaggtgattggattgcaggattgcatggagggagaagtgattttgtttcttggatggtgaaattaagtgagcacttcccaatttattcctaaaaacacggagacaccgcgtttatgttcctgaaatgagaaatcagtagaaacacaactgggtaaagaaagggaaattaaaaagaaaatcaccaatcatttgattatatgacaacacgtgaacactcacatacttgattgtactctgcaagtctgtagaaaggaggatcatttaagaaaaaaaaaaaaagacgctggtttcagcatgttttttgtaaggatgggctatggcagctggaaagctaagtgtcctgaaacaatggatggccctcacatttgtgcaaggtcttcagagtttacaaagcgctttcagacgtgttgtatttctcctccatgtcctggcttatgccaggctctccagctcccctttcaacccaccctccctgttcctgctccatgctttctgtacctggaatgccaaactgccagatgtctcatcccctagctgtgccatgtgcacaggtgcctacctacacaggaatctgcactgctgcttctcagccccatgcctgggttgcctccgtcatgccttcctcacctttaagacttccatcacctctggtgccgcctcctgcagccttccctgagtgctcccagccttgcctggccacccttcttccctgttctcccatgccctctgtatctctcagtccatgcagtcaccaggatctgaatgttgaccttgctcctctcttggctgagtgtcccctgtagagcagggaacagcttcttcctaggcagacactggacccagcaaagagcgtggcttagagtctgtacccaagaattaccgggcaaatgaatcccctgagggtgtcattgtccctattatatccaccaagaagctgagggtcctgagggctgggtgatatgttttgtgtccccagtgagttagaggtggtgcctaggctaaagtccaagttgggtaattcctggcattcctgtttgctatggaacacgaattagatgcctcgtggaacacagagactggggtgtatttgaggttatgcgtgttggtgctggggcttccttcccctcttagaagcagagttgtcttgaagttaaaaaaccatgtgatgtggccccattgcccagtattctctgtattggagcggaagtacaggataagagtctccactttatcaatgcttatggacttcagagtgaagagatcaaccaggaccagattaaaggaaatacagttaaaggaataaagttatgtcaactcctttaattaatgtgtacatttatagtctcaagtatacagacactttctatttaaaaaataagatgaaattatgaaagggataaaataaaagtcaaaagacatgcttcaaggaggaactaaataaaatagtaagagctgcctgtggtggcaaaaggaaacacaaaagagtgaaagaaatatacaactcaaatgaggatttgactatatacagctgccagaggctgccagtgaatggctggtcagcagcattgctggccttcctccttgcaggatgttcttgtataaatccagcagagccttggtgcaactcacttcttctgaatgcctactatctgcatgcccctgaagacacaaagaaccccagaaaaatggcaataaaacataattaagaaacaccaggacaatcttcactgcacagtgggagcccagaaggaatgatcatctctgtctacaggaacttgttcccagagcaaacaggcacctgagcaacccagatgggtgagggtgacaggtggagagatgggagaaagatctccagcagaagcagctgcacaggggcaggcagcaaagcccagagctaggaaaaggtgtgagtcatacgtttgcagatctgtaagaagtttattatagctggaaggaaaggctgaaaaaatggtgttgatgctcagtcctgtttattgaacacttagtatgagctgggaccagaactaatgcaccattcactggcctcaccatcacgacaacaaatgaggttgccactgttactaccccctttttggaatgagaagattaagtcactgaggtggagtaacttgcccaagatcacaaggttggtgtggatccaggcccatgtccatctctgtaaacccatgttctagatagtaaaatgtctcccatggtgtatcagtcacccatggctgtgtaacaaattaccccaaaacttagcagcttagaacaacagttttaaggtcagaaaaagtttaaggtcagagtctgaaatctgggaggggtcttactgggtggttctgggtcaggctctctcatgaagttgcagtcaagatgttgtctgaggctgcaggcatccaaatcttaatggggctggggcaccatacatcctagttcacttggtggctattggcagaaggcgcctgttctgcatgatgtgggctctccatcatgcttctgacctggcagtgtgcttctccagaacaaatggcccaagacagcaagcatgaccaagacaccaatgtcttttataccccacccttggagtgccacacttctgctggacgcaatcagtcacacaaaccaactgtggtacagatccggggctgaatgctaaaaggcaggggtcctgggggccactaagaggctgcctcccatgcctgggcatcctaaactatttagactttctgttcctacaagaaatgggtaaggggggattgggatctgaagtttcggttcctccagtgggaattccaggggccgaatttattataaaatgcatgtagagaggcccagcttgacccacagtgagaagttcagctgctttttccatccaaacagcatgtgcagtagaatggcccttcccctccctgatggctgctcgactgtgcagcaagtctgtcaaaagatctctgcacacactaggtgctctgtgttgtgctggctgagttgaatctggctacagctgcagctctggggaccctgggctttgcagtcatgttcagaactccctcagacccatgtgcccacttcctcagaccagctcatatttaccctctgaggtggtcactgacacagccactgactgcccttctgagcaggggctccctgcagatcctcagcatgctgggtgggcatgagcaggctgctctgaaaagcttggcttccctttctgaggattttatcagtatataaaaataaacagagttggctgactccttgatgtctcagggttgcattttaattgctgctgcttccgagaagacaggccagctccacttcctggtagacgcccgcactcacaggaacagagctgaactctgggtgttggggccagagcatcccagagtgtgactgactggtttgcaattagcacttcattagagggacacctctggttcacaggaccaagactggctcacagagcctgcatagggatgaacatctcccgcctgcccacagagtgatctttctagaacccgcctctagccacactacttcttgtttaaagttcttcttacccctccctgccttaaggaccaagttcaaactctcagcccggcttacagggactgccacaatctggcctctgcctgctcctcagcttcatccacgccctcaccccaactccctggccctgcttcctttattttctactgcagtcagattcaactactcgtagctggtagatgatcgatgctgtttttcacctcatctctgccttgaatgcccttcccttcccaaataacatctattcctgcttcagaattaatcttccccctcctgtctgttatctgggaagctgtccattagccaccctgagctgaattatagtctccttttcttgcttccacagcagtgagatggtggtgctgagccctgaacgctgtctgcttcctagaagtccctggcagcgtccccacccccacggaaccccctcacccatgttcaggaaagctgccttgtgaagctggtcatgtgggatgtcacctcaggagggaggagtggcctgcccagcacagcccgcagcagctcaggcaaacacagtgcacctcacttgtctgcatcaccatggcccctaggagtgagcacgagcttccacaacctttgctgacaaacaggggttccgcccaacacagccatgatgcctcaacatccggagagaccctgccttgtatcagcacaagactcctgggtttaatgatgcttgaccctagcttctttcaagactttggtcttcatttgtgcatctgcagggagcagggagcatggagggaacagcaagggctgggagtgggtaccaagtcaaattccagcaccacaacagggagcctcgtcttcagccagttcattcaactcagggggcttcagcgtcctcactggtccagtacaggcaacattccccctggcctgctgtggggtaacaggaaaaaacatggggtgccgccaatgacattgggagatgtatctgggggtgaggttctggagagcttcaagccctgggggatttgggtcttgaaggcacactgtggacctggagcagcactagccctgcatggcaccaggaccctgcccctcaccatgaaccagaaccctctccctgggagatgagttctcaccagccagggctgcggggttgggggcagaaagcaggagcagcccctaacagctcagtagacgacagcttctgggagcctttttcaccaggatctgaggcctgtttacatgggtcccccctgtggtctctgctgcttaatatgccttttgaaaatgatgctcagtgggatggtgtgtgcacatttgtaattccaaagagccggctggtttttcacaatctgtgcctgctaatttctcagtcacaggaagggaaatagcaaaaagtccccaatactccttgttgagtggattccctaatagcattacgtagtgcttcctatttacaaagcacttttatttctctcaatgagaaaggcagacctactgctataagcccagggggaacccggcatccacagaggagaaatgactcgtccaaggtggcacagtggcagtgagaaagaagggcaggcacagctgcaccccgtttctcctgccagctaagtgcatgccccttcatagcaacctctggcatagacagaaggagagatgaagcaagaagttcccagaatgaaggctgtttcccctaagaggtgggcgtcctgccacaagaaatggctcatcgggaaacactgagtgaaaacccacattcagagcaaggcttcccagtaactgagatccagcctgaggtttccaggagctgagcctcagatggaatgagggcgggctcagagctcagccaaccctttgaaactgagcctgcgggtgaagtcaggtcaatacattcacaggcgtttcaggccctatcgacgtctggggtgggaaacccacccgaaagctgttgaaatacaggggccagcactggttctgcagaacagtggctctttgagtggaaggtgttcgagaattaagtttccccagtgttcccagggctcagactttaagccaaggggggctggggcccccagtgcctgatggagccgctgataggtccctgctggctaaaagtgatgacattggcaagaaactgatctttctggggagcagaaactcaagagcactcaagtgaagaacacaaggcaagttgtgttacctgccacaaagccccagctttcaggaccaggggaggggtagatggggaccacttggtattgggtatcaggagacccagaccagaccctgaaggaggaaacggctgaagcgagacctcttatcttgtcttgcctcctccttcggcatataatcggaacgtgcttaggccagaggcaagaaagcatgtaatccactacctccctctgtgtcatagacaggaaaattgagatcctgtggcatcaggagccttgttcttgggtaacagagtgtcagacatgggactaggaagcaggcctccagattccccgtccactgctggtctggacttggaaaacaaacaaaactcaaagcctccagccctttgtcaccatgcagcaggccacagccacagcacacctccatctggcctcctccatatatttttcgtgagcccacagagtgctgttccctgctgtaagctgatgcttgcacacaaatgtctggccaaagcagtttttgtttaaaagctaagtcagtttgtacaaaagcacaccctgcctggcatggctcccttagcacattcccactgctagtcaatgcctggttgaattgtgaagaccaaggacatgcaatgtaggtgtcacctgtgcactactggagataaccccggggcggggcagctgctgacctgggctccagaatctcaggtgcaaaatgcagcttagatccaacagggctgagatagacacaaagagatgcaaccctgaagcatggtggtattttaacaaacatgctgtacactggatggcttataaatagcagaaatgtatttctcacagtcctggagctagaagtctgagatcagcatgctgccatcatcagattatggtgagggccctcttcctggttgcagacaaccaacttctagtcgtatcctcacatggggtcccttttataagggcactgattttattcatgcaggctgcaccttcatgaccaaattaccgcccaaaggccctgcctcctaatcccattacactgagtggtaaggtttcaacatatgaattttggaaagacaccagcattcagtccataacaggtggtccacaggtaggcttgagtgggctaagggttggcaggaagctgctggaattgcagggaagacttcacccatattcatgcctgggcatttgtctaggaagggtgtccctggcatttgtctaggaagggtgccgtctctgcatcctccttaggtgtctcacagtgacctggtcccacatagcccagtctgagctcaaatatcctcttctgacttcaaaaacgtaagtgttaagagtttctgtcatgcctaggtgaccttggctgctaaaaactcagtatcattgttttctaggaactctgtactttccataggatgtcattctgttttgtgctacagcaatggagatgaagagctgcagtggaagcgtgagggcaggggttacagaaaagaggtataaattctcttggctttttttttttttttttaaaagcttttcttattgaagtgcaacctgaaaaacaagcccccattggagagtgccatgacacttcctgtgtaacgcactcaaacgtcccttggcaactgggagctggggaacctgataaggtacaagctacagatatgcctgggagtttgtaggagtagcaacattttgtcctcactccaagtctcagtcaagaaaggacttagaattttaaaataaaataatgattagattggaatcattgaataccagatctaagaaaaaacctcagttttctccatatgaaatgagactttaggacttgcccacagaggtgatgtggaaacccaatccttttgactccaagtcaaatgcctacaaagcctccctgagaattgggccttgagaattgtaactattcatattcttgttgggataatcactctttggcaatggcatcatggaatcaatctcataaatgaaatattaaaacttcccattttcttggctagattttgttgttatttcaccagaggagagccccaaatgcaacctctttgtataaacgtctttcccagggaccagggtaaaggtatttttttctaaagcacttggctgcaaagcaccttagaggcatagagaatcagtactttggaatacctgaaagaccacctaggcaagtctttccattttgttgcagggctttctgaggcccagagaagaaaagcagctcaaacagatcaactgtatccatccaattgtccctttcagaaagttgaaataagggggaaaaagagaagtttctagctatgatgggcactggggtttgaagttcacacagccttggggagctgggtggcagttattttattttatctttaatttttttgcgaggatgaataacctgataagtaagtcggtcctcagagggtggggagtggagcaagtgagcagatggcatttcttgccctggctttcctgcgatgctttagaccctgttttattcaagggaactaagttagttgattgaaatctaaaggagccccaaccagaacaaggggattcaggtatgcacaggagctggagtgtacgacctctgagaaccctttaatcagagcagctctgatctcaggagtcttaggtttcagggccaattgcagttagtgagacccacgctaagacaacttatgccaattccactggagttaaaggtggcctctgggaaagggtcttttgagctccttgctgtgcataagatggtccatagaccagcagcattggcatcagctgggagcttgctagagatgtagaacctcagccctacccagaccctctgaatcagaatctgcatttttgcaagctccccggtaattcctatgcgcattaaatttaagaaatgctggttaggaaatagcattttttggacaataaaaaaaaagatggagtggagccatgaggagctggtggtaataccacctcacctccagaacaaactctccacttggccttgggaaaaccgtggccatactcagaatggctgctttctcatctgaaaatgagggggttggactggataatctttattctctaccctcacaggcatttctcctatgagctgaaagggggtagtcctgctcagctgaagatcagagagcttcttgctgtgtaaaacactccctaatcagccttatgtcaagtcccccgccccccgactaaccacagtgacaagtctcaagagtgcaccttgtcaggctgtgaataaagttcaggcagtttggttaattaccctgacaccgactagagttagctacccagcagctcaggaactcgtcttaatgattataggaacacacacaccgcagcttcgggcacaacctccccctttgcagcctacagcctggttttggaaccacaagttcaagcagaacattcccaagggcatcaggggtctagggaggcatcaggaggtccccctttcccattccaacatgggtgtgaagtcattttcccaatgtgccatagtgaagcctggtaagcataatagccatctcagtttctctctcatgcccctgcttggaacctgcctgtggtgctccactgctgtcaagaaaaagccatgcaggatgtgcccctcctaattctccacccacatctccattaatccctacctcaaaccttctgccctggccccagagggctactcttgggtctccacatgagccatgtgctttcttctgttgcacatgttgcttctgctcaaagcacccttctctgctcttgaccatgatccttacccatctttcagattttaatatctatatcacttcccccaggaagttttcatgaccctcatgaccaggttgagtgcctatctttccatagagtcctatgctacatcattcataccagatatcacattgcattttaagacagcttcctccagcagtagtgagctgtgggctggcagtgttcatacccgacttacgtaacatctaagcctcatgaagacagggattgttttttgtgtcattgacaactgtatccagagtgctcagtacattgcctgggacatataagatgctcagtaaatgcctaaggaagggaggagggaagaaaggaaggaggaatggatggaaagaggaagggaaggaagaaagaaagaaaggaaggaaaggaaaaaatgaaggatgggaagaaaggaagcaaggagggaacaaaagaaggaaggaggaaagaaaggcaggagaaaaaaaagagagagaggaagggagggaaggaagggaaggaaagaggaaaggaagaaaggaaggaggaaggggaggaacgcttatgcttagcatgcctcgtgtacaatgagtactcgatagttggtttgggagtgactgcatgcatgaatggaggcctttctgcttctggcataaagtctggagagtgagagctcattaggagggattgcttgacaggctgaggcagaaaagtgttcacaaggcccatcagctctgcagaggtctgacaccaggtgaggagataagacttgtcccctgactgtgggacgtgggatgagaggtacagaatggggacttccatgagagggtgcctttgagtgaattaccagggagaagtgtgaggacccctgtccctctacccagagcacacatcacccctctcctgtgggctgtctgtctgaagatctagaaggccagttccaggtctaggctttcatctggactgagaggtagaagggaagaaggagtttctctaggcagggtcttcagagaggagaacactttctcagttcccataaccagtaaacggcagagctgagattggaagccacctccaaatgggcctcaagcccacggctctttctaagcacgatgctgtgtaacaagcttgggagttttatatttttaaagcaaagcccatttaaaaatatctatttctttacatgtggtggcagcagtgggataatagtcaaatgtcaataagtagaaatcgggggaaaagaattggagcatttctggaagaccttcctctttctctaagccattttggttccagtttctcagctatttcctcagggtcaggggttggagaggaaggtttatatttttttaatttcgttaaaggatggaaagaggaagagaaatgttccctccttccctccctccgtttcttcttttttcttctctaacaacccattaccctacccaggtagcatcccaaggagctgtgctggaaggagctcttttctcctgtgaccagtggcacagaacagagcaggtgggatagggtgaaagttgagcatgcaggtttggacgtcagacacacctgggcttaaagccagcgttaccatttatgagccatttgatctctgccaagtagcttcacgtctctgagtcttcattttctcatctgtgcattggtaacaataatagcattaatcacctggggattttatgaaatagtgagataaatacaagcaaggtatttagtatggaatcacaatccctagccaccactccaaaattagaatgttctaaaaccttaaggcatttaaaataactcatttggcagtaaaatctgacatcatgtaaactcacttggcaacaaaatctgacctgaactgatgtaaactatttggagttcttattgtgactactcatatgttttgctgtagaaatattgatgtgtttgattatagggtgatacctcagtacttcctggggagttaggtaacatgagctgtatgtaccatatcacctttctaaaatctagagtgatttgagtttcaaactacagatggttccaaagattttatacaaggggtgtggacctgtagaatacctggccatggtgactgctcaggatttaagagccaccatcccttctgtttctgggatctaacaatccaaggtacaggggtgtgaacctgagctttttaggcgtgatcagagagctgcttacataaagcttgtgctagacacaaggtatctagacacctggacacaggtgtttgttaatccagatgctcggactcaaccttcccccattgaactaacttctctggcagctggaacccagcactttgaacgtgctccccaggtgactcggagatctccttctacagcctattatgaaagttcagagcacgatgactactagcagccaatactaactgaggaatttctcctgtccagggactgttctaggatataacattagtcaatcctcacaagttcagtgaaacatttttctccatttttcagataagagactggagacacagagaggctccagaacttacccaaggtcacacagcttctaaatgggtgttgttggaacctactttcagagacctgattccaaaaccctcactgatactttccgtgagtccagatgaagagagggcttcaaggaaaatccattcagtgccaggatgctaccagctccctggggcatgggactgccatcctctcctaggcgtctgtcctgatacttccaatgtaagtgtggaaaaactcaagtttcataagttttgctcatgtgctctgccttggagagggtgggaagtagaacagacactggcctcatgttttgctgttggttacctctcaggcatgtgatccttgtaccggaggtttcacatcacgtagcccctgcacagctgatctgtgaatgggaaattgggttgggccatcaccaggtccccttccagttaaatatttgtcccaagtcccagatgatttgatatgagagccccatgcctaatgctgtttgtggattcattgaatcaattattgtttcgttcattcaattcattcaacaaatagcttctctgtgtctactactatttgcactcaattctcagagaagtaaatgtctaaagtacccacttaataacttaaaagctgattttaccaatttcatttcactgtaaggcctcccaaaggattaacatgttagtgtgcaccccctctcgcaccagcacacttgcccacaaaaccgcctcccattgtttgaagggaaacctacaagtggatccctgcccccacccccacagcactttctaattcaaatcatctgccattcactggctttctgccctggggcaaatcctccaccttcagtcctactttgatcctctagcccaggccgctttcatttcacagttgaagtaacaaaggttaaaacagatgacaactatttctagagagctgggttttttgccccctcaactacgcaccgtggtgaggcgccgaggaggccacatcacaaggctggagaaccctgggagcttggtagtgttggtgagcgagggtttgttcttctctagcccactatcctaaaggctgacttccctccaaggactgaacctcgaaatttacaatgcagggccccaggggctgcggtggggaagggcctttcactattgctggcagctcctagggcattttcctggactttgggggcagattactatgaaactcctatctcatcctgcaggttgggaaactaaagggaagttctttgtccagggtcagagcatgtgcatgggcaggagggaaggtgggggaagcagggagtcagtaaaggaaaaacaaaccaaaacccaacaaaacagagcccagtgcagtgttcctcctgggggtagccctttgatgcatccctggtacctaagaagctggctccagccaggcctcacctattagcctcagggaccattctccccagacaaggtctctgttcactgggccatgccattttcttctcatccccctaccacaactccacatacttccttagcattgtcttttcctgaattaccaaacacagcagcctgagcttcaccggggagctgggagctggggacatgttcctgggagtctctagatggatggctttgagtttttccagcagaagaggagcagccaaacccagatgtgagggccctccccctccaagttcagcctgccctggtggcttccttcccagagtcaggtcttctaaggagtgcttagcaagtatgtcagcttccagaccaaggcctgctgttcttggctccgggagatgtttttcagcacagtatgcttgctgtagactgctctgcaggggtgggggtgggagggtgagggcagacctctctactgatcagaattcagagtatgactcctccaatctgtccccttggtgactttacatgttctcaggacagctttcagaaagcctcctgcctgctacttgcacttggggatgtagggggaggggtcagcagtcgtgcggggactatatgtggaatttgttgagatcaggcagaaggaagtgaagacaccctcttctgatttgtgacatgtgagaacattctcctgacagaagcagctcccggtaatagtaacagcttccgggccctcgacaggctgcagcccatcaccttcagcgtcctgccaagctcagcagcagcgtggcaggagggggcagagagctggaggcagcgtctgcctggggatgggggctagaggtagacaccgggagaggcagatctagagggagactgagagaacagagacaggggcatgagagagacaaacggaaattgaggcaagaagagatcagatcagggagatacaggcgcctgggaaggcagagagtaggaagcagaaatagtgctaaagatggagacaagtggagaaggaactgcagagattcggccctgggctggctaccacccccatactccctgaaggcctccctgaatcctgcaaacacactccctgcttggaagcctagcagctggcccagctaggaagaaaggtaagaaggtgcctcaggccaacccaccagcaacaaaaatgtctggacctctggggcttacggaggggttcaggacctaggattcctaggtgtgcagctctgtaggaaacagctttctccctgatgtcaagatttgggaacttggagtggtgctatttctctcaaaaataatatctttttaaaaacaaaatgttgctttctcccatttaaaaataaccttttcccacccctgctacctcattacaaaagaaaacaatgcaagctcatcatggagaacatggaaaatatgaaaagatacaggaaaaaaataaaacatgaattgtaatcacatcacctaatgatagccactgctaggaatttgatggttttcctttcagtcttttatcaatgcatagagctatataatcagcagtaatatgtcataagcattttactaaatattatttgacactaccacttttattagtgtatatattctaatatgtggacaaggctttctttattgaggtaatctatggttgaatatttaggttgcatgtaactttgctactatgaacaatgctttaataaatatctttctgcctacatctgcctgagtttctgaatatttcttcagaatatatttaaaggagatttaccgtgtcaaaactatgaacatttttagagcatacatacacacacatatgaatacacacacacacacacacatacacacactgatatggtttggatctaagtctccacccaaatctcatgtcaaattgtaatccccagtgtttgaggtgggacccggtgggaggtaattggattatgaggcagatttcccctttggtactatcctcaagatagtgagtgagttcttgtgagatctggttgttttaaagtgtgtggcaccttcttcctttctcatttcctcctgcttgggccatgtaagacgtgcctgcttccccttccttttgcaacatgattgtaagtttcctgaggcctctccagaagctattggtgctgtgcttcctgtacagcctgcagaaccatgaatcaatcaaaccttttttctttataaatttcccagtctcaggtatttctttatagcaatgtgagaatgaactaatacacacacgcacgcacacacacacacacacacacacacactcacatcttcaaattggcccccaggaataatgtacaattaaacttctagtgcagtttagacccaagtgctgatgacagaggatttgctagttaatgacagtcctctgtagcttgtaaggtaagttgagataggtgggaggtaagtataattatctccattttttcaaaggaagaaactgaggcccagagaggtttagtgacttggccaacatctgaaatggaactaagtggtcttctctactggtttccccattccagtcataccatcagcacccagggtcagaccttcacgggctctagcttggattaccccggaaccaccttgccattgtggtagccactagccacatatggctatttacatttatatttattaaaataaaacacaatttaaaaaattagctcctctgtctctttgaccacatttcaaatgcttaagaactatagatggctaccatgttggatagtacagatacgaagcatttccatcatagaaagttctattgaacagcattgctctagaaggttggcgttctgtcttctggtatggcttctcccacccccactccctcacaccaactatcactcattctatacaccatgggtgtatcagacatcctgaacacataaatttgatcatatcactcaccagtccaaaacccttattgatcttgttacctgttatctgccacattaagaggaagcacaaatccacaactacctttgctcttcatctccatgcttttctgaaaaattattacacactggctgtgcctggactgaggtcctataggcacagagatggactaagcatggactctatactcaatgagcccacgatttgatgggttaaaataatacacactgcctggcctcctgccctgctttattattcctgatagcacttaaccacagccagcatttatttattgcctgttgcttccactagaatgcatgcttcatgagggcagtggctttttatgatttgttgacttctatatacacagagcctactgaagtgcttggcacttaggagttgcaaaacaaatatctgtgaatgaataactacatttcaggatattgagcttccaattctttctgatgggctagaaaaattggaaatgaagcaatgctccaccacaggagtttgcacctcgagcctataatgtttgaaatctgacctgtattccctcttgatactcaaatgccaggatattgcatttctgcaaacaaccaccattccctacattgttgggatagagaaaaagaaataatacaagacacattttatggcaactacttggtccaaaggagccttccaggtgggactctctcctacttgtaaaggtaaatcaagcactcaatccttgcaagttacccagcagggaagttcaaggagaatattcaccaaactttcagaagctggggtcaaaagaaatgaaataagcaactctctgcaactcttctgctttaatttttgagaagttttttaaataatagggagcattcagtttaagcagttagaatccttttttgtttgcctcttcatttttggcactaatggcagtaatggagcaaggaactgcttaaggaacagtttaaggaagactactgacaatggtagtggcagaacttagatcttcagacataccatacagaatccccccatctttgccctgttttccttcatctttacctttattcagaatcttcttatcaaataggaaacactttcatctccttctgttgattttttttaaaaccagttgaaaagcctctatcttttaataggaacatttagtccattcactttcagtgtaatatttttacacatttttttcctgacagttggatttatgtttactatttattttttgtttcctctattttattttcttgatttttactccacttttctattccattgatggtttccttctattttttttacacttataattgaacacatgcttttccattatataaaaacaaaatgccattattttcactactgttttcttctttactccaagatcatatggcctttaacatatttttaattccccactctttgtttctacagatgagaactttaaaactcatttacctgtaccttcttttcccatgccccacaaagttctagtttttcccaaaagagttttattataattagttccagactgttattagattttcccaatactttgtcatttctatttcaagatctttatttagtactttccttacacattccaagaaactctataattatccatttaaatttaaccatatatacattaattattcactgctctttctctctcttccttaaactgttaaaggaattctcttcccctcgccccaatctcccacagtctctgttctgatcccccttttatttctggtcagaatccttcttttatttctgtccttagatggtatagtggttttaaaataagtccaaaacttctttgatactccttccttcatgaggtagagcttagttccctcctcttgcatgtgggttggactagcttctaatgtgtagaatggagaagtagtgtgacttctcagagtaggccataaaaagcattgcagtttcctctttgctgtctcttttggatcatgagctctggagaaagccagtcaccatattttgaagacactcaggcagccctatggagacatccacatggggagaaatgtaggccccctacaatcagccagcaaggactgaggccttcttctatcagccatgggaatcagtcatcttggaagcagatctcccagtctcactcaagtctccagataactgcagatagcaaatcatcagaacccctgttgagacacccagaggaagcctctttgtcttctcattatctcctgaacacagcacacctgttcagttccccctgcaacttctcagaggccaggaagaccagcaggttccctcaggaatgttcaggctggcctatgaggtccttctgctggaatctccaggggttgaggtcactccaggatcttctattgttctgttcttctcctcggtactctcagctgctgaaacccaaactcttgcctagaccagacgggaaatggaattccatgctttctgtcagattttggaaatttgctcacaattttcagatcctgttgctcactgaccctagcactgactaactctggaggagctgtgattgaattcaatggggagggaagccgtttccttcccagagtgccatctctccactggcataacccattgctcctttgtgagactgagtcccctgtcctcaaaatactcaattcattgtcttggatgcagccgaccttgacatagactatgtaggctggtggatgccaaggatcatatttcactcatttcactctccctcattctcctagcacctacctagtaccaccagagacttgtgaaatagagcttattgttttctctggtggcttgaataaaacactgttcctccccttttgtagagaagggtactggagtgcctacctggggtcccaaagacatatgctcttggggtagttggaatttgggatgaggttgcactcaatcatccctattatcttgcctggattctcctgcaatagcatatttgcttcaggagtttacaaaaggtataaagtatgatccattgggctggagaagaggggctgagtctctgttttgtgcaatccatattggttctaacccacttctaagagtctatctggaggccttcaaggcctccccatactggacatggtgagcattgacctggcaggtggttctccagcagtgttctgggagcattgttctccctgggctacagtgttgatgtctccataaggctgcctgagtgtcttcaaaatatggggactggcttcctccatagttattgatccaaaagagacagcaaagaggaaaccacaatgcttttcatggcctactctgagaagtcacactacttctccattctactcattagaaggcaattgatgtcaaatatgtttagaaaacttgccaactatgtcatagagtacatgtggatattacataaacaaacacaaagcaggtaaccagtaaagaaacctatttaaatgtattaaaccaaaatgtcccaaacatacatgaccactgatttcattcccctttccagcatatattgcccaacagcaacctgtggaagtattttctgtggataatactttgggaaacacagggatcctgaagctccaagggaccttggagttcacatggagtccagtttttccctttaactcggaggtctaaatcagtagctctcaaagtgtggtccccagaccaatgtcacctgggaatcttctgaaaattcagattctcaggcaccactcaggcctagagaatcagaagctctgggggtggggtcctacaggctgcatttttaagtcccaccaggtaatttcagtctgagaaccactcccagtggactgagaagcaagctcaagccccattgtctgggtttaatttctacccctgctacttagtacctttgtgaccttgggtgagctttccaaattcccgtgtgaaatagtatccatctcatggggtggtcataagcattcggtgaattaaaatatagaaagcacttggagcagtatctgcaatgtgttaattgccattgtgttcctgattattgccattattgaatagttcctctgaatttacactgaaaggaaaagtagagtgttattgagacctactatgtgataggaactaaggtatgggttggcaagggagggttgcaagttggcatcttaaaattctgatatctgattactgaccttacagaacacaagacattcctgtgccaggaaatgttttgcactgtgacattctaggaagtatcttttcattacaagccatggtgcttcattataaactactgattttgtgagatgaggaactcagagggagtaggatcacttccagctgtattttctgcaccagcttctggtagtgactggaatcccagcttcagcttcagcaaatggcttttgactccacagagaaggccctcctctaggcacttgcacagagaatctcctttcagtttgtgttacaataaacccaatgacatagtaacctctgcaatttgaccaaggttgctctgtggcagagctgggatttgaacacaaagcctccaactctctgcctagtgttcccaccacaacattagggtatgttccatctggaggacccttagagagagagcatcaagttcaaccagctcaatttgcagagagaaggttgaagtgaaagggagcctgtagctggcttaaggctgtacagcactggagtggatgggctatagcaaaagctgagctctgctcctctaaactccgtgcctttcacttcaagacatggtgagtccccagcctgactcctgcggttagacatagtgtgcgggctggctcttgcggatttttctattcttttccaatcatcatgccatgagggagaaggactagtcacctgaggtggggtgggtgtggatttgctgtcaatggccttgtcctaccgcagatgtccctctctgggacacgcttggttgaaaatctgcagaaagctctgggaaagccaaacaaaaggtaagtagaatgggccacagggggcccattagcttcctggagcctcacggaacattcccaggagagatcattgctgggagtgtgtgatcagcgcaggcaccatcacaggcagctgctggcatattaatattccagataaatggcttttggctcaggcaaaagatcctgctttggagcaggtttctttttgaagctcctaagaggggcagcttgcaaaagaaggcgaaggaaaaagacagctttgcagaatgattccactcaaaaccctctgctcccatccatctctgtttattttgttcctctgcctctcctgattcatggcaggctcacaaaaaaggcgagagagagctcagctgcacacatcctcagggaggaagacagtcggcaattactcaggacactaaagcggccgtctgcacaacccatcagctttggagcctcaccacattgtgcttgaatcctagctctgccatttcccagctatgtgaccttggctggatctctcaaccttgttgagcctcagttttcttgactgtaaaatgggagaggataatgttttccttaaagggtggctgaggattaaatgcagccaggtgcttagcacaatgcctgctggtaggtgaaggtaggtgccattatcacaaaggtggcagctcagagcaaacagagctagccgagtgtcctgagcagggctggtgacatttattccctgcagtgaacctgttcactggctgctgagggccctgcttcttgtgctggatcatccggagtgtgtccagatgtttcaaacttagggaaactccagcctaaagtcctttaaatctaattttataggttcagaatctgagacccagagagtgacttgctcaagctcacatagcaaattagatgctagagtggaacaaagccttgttttttcctgtctttctcggcatataagatacattctccgaaggagccttactacttgaggcctttctctctttccctgaagccctgcacttagaaagggccatatttgtcactgcaggtctatgtctagcagaccagaccaggccagactggcagagggggcatatgatgtagatgttcgcagaccttgtctgcagggaggtcacctggtgagctgttcagaaatgggtctccagtcccacccctagagtaactggggcggggagcggtgtaggctgggtcccaggaatctgtgtccacaatgttcccctgagagctctgtgaggaaaaggtggggggcctcctggcctggaaggtcctcatcccccaccaccaggaggggtattgctcctgattcttgggtgaccctgagcaagttacctgtcttagattcagtttcctcatctgtgccatggaaggcaaatgctccttttctcagggattgtgggagccaaacagaaaaatatgtggcagtgtgtctaccccaacacctggttggggtagatacatgaaatgcttgctcaggcaagtccaggagtgcccagcacagcacccagaccagcatgtcccatggagggacatcaccccatcttctgtggtgaccagaggcaggttttcagtgcagatctaggcctggactgggcccccagcagggctggccaaggtactgagcctcaggatgtgggatacaaggcatgatagacatgcagaacaatgacagcaacaatagggcagttatgtgtgcttaccatgaaccacacatgcaccaggcacgctggacagtcagtcatttctcctttacctgggacacaggagggagccccatttgacagtggaggacaggtacctaagggccatgcccacggtctcacaggggcataatgcctggtccctctagccttggtggctcctgcctccagctgtggaggaaagggctgctggggcactgaggagatgttccccaaggtggccgccagcattttgggctgcagattcagggacacaggagctcaaggctcggcactgggccagggtttgagtaggcaagtctcacacctctcacacgcttgagccccatatgtgttcatgaccagaaaaagatgctgctccaggcctggctgcctcatagaaccagtgagagggcctcaggagaggaagaacttgacagcccctgaggaatataaagcaattttcaatgtcaggaagaagatgctaaggatacagaaggagtgggaggagagaaatgcattgctccaagtccaagaaaatgatcattatcaaaagcccaatttgagctcttccatgtacccagcatgtccagggctgggacatgatccattcaccaacaatatcccatccccctcagcaaacacacagtgctgtctctgccctttcccctgaggacagtccagtgtcttgggcacctgtgcaccactgctcctcagccattggggaccacagtgcatcctgagagtttctcactgggaccagacagagctcaagagggatgtcccgacttttgggggtggacggccaccagactaggactgatgcctcatttctaggagacgtgcaggaaataccaaggccactgaggagtgaatcaccatctaagtctcctggaactgtcaggaggaaggagcctcgaaaagatcaacctgagatcaggccagggcatatgcttcacctactgccacatggtttgccagggcttcatccatgaggtcatattactgtgcctctgagtttgatagcaatcatttaattctaagagtctatgaccctccggcattcggttccaccatccatccactgcttaccggcattcagagtatccttgggaagcagacttcagtccctaattgcatacctctcatcacagggaatcattctctcccttgccagccatttcatctcccaatggctctggccttgttagaaaattgtttctagtgggagctaatatgtctgtctctctggggacccacccgctctcgctgtcccctttagagatcttggaggtgaagtcttgcccttctctgcatcctcatgaaacagggagtgaccagagacatgagatgcaccatctgtatcaaactcctagggagcattaggcaattttgttttcactcttttctgtagaactttcccatctcttagcaaatgaaggcaggtctgatgctgttattcctattttattgatgaaaacaatgaagcacagagcaggtaactgaacatcgaaggccacgtgttgataagttgaagaagtggacctgagattcaggtcatcatcctctaagcctgaggctatctaggatgtattgtgtgaggttcagggtctgaattgcagggggttctggggtgtcccactgtccttcagggaacttggcctcgtcacaccttttctgaccagcacagagccccctgccctgtgtgaccttaggagcaggggacattttatttcttagaatagggccagacagcccaggctgctggctttcctccagcaattcttggggctgcttcaagcagaaatgtctggaaacttgtggagttcatgagtaaatggcttcatggaagtgcctgttaaaatttcctctgctggagactaaagtagacagagccaaagccagtgggcctcccacctccctcacggtacccctgggtctcattcctctttcactccagcccagccctggaaaacccacacccttgtctaaacaccagcaccaagccgacccaagcagagaccatatgtgttagattatattattgtttaaaatatttgctggtcttttccacggaagattattcctccctaccccattaggcttggccatttgatttgatttagccaatgaaatgtgagcagaagtgaagtgtgctacttctgaacagaagtattaagagctatggagttctactctgtttttcctcagccatgagactagatatgctccagatagaggctgctccctctgcccagtactggaatgacaatggcatagaacagagctgcatatcgtcagaaaggatatagaactcaagtgagaactaagcctttgctgctgtaggtcactgagagttgagagttatttgttactgcaacataacttagacaagcctgactgatacaccagacatggcaggaggtaatgtgttgtcaagacagatgggccctagggttcctccagagcaaatctcccatgacaaaaaaaaaaacctccccatgtgggaagagagagaaaatgcctgcaggtagacccagaggtgagggagctttattcccccaactaccctctgcagacttcactgactcagaatgtaaaaggcagagtttgcatttgcctccatctccccacacttccccagccagaaagcttatttggggcctctgataggaatgatgtgatgcccaatttttactcaattattgatttttatcctcaggagaaaatagtttgtgatctttaaataaggaaggaaaacagctcctggaattgattcctgagtaatttaatcaccttttgtccagacaactcagagctggctcaaggattagccacatattgatgcatgtactgaatttccagctatatccacatgcagagggacctggggagcttcactgccaccccttctccacccctctgtctcttgggagaagcactgtgcagagaactgctttggaccatactaccttccaaagcacccagacagaggagtgggagggccagtgagaccacatccatgccttcaaatacagaaaggaaactgatgctcagaaaaagcacacaccaaaaaatcttgaggtgctgggatgtgttatgtaacagttttcctcatctatggaagagaaaacaattgtctgagtggagatcaggaggctggggtctgactcctgctttctcccccgcagttgcagcaataccttggcaagctgcttgtcttggagtctcagcgttactaacagaaggctggtttctgtcattcatttactcaatcattcacttaataatcactttccaaacacctgctatctaccagacacagcatatagatgacaaaaactaatgaaagtaaaatgaggtgtggtatgttggaaaagtgaccacagattcttcccatctctatgccattttttcatcaagacgtagagtgtaggtagacttggccatgggtctttcttggccatgtgaatttctttggccaataggatgatagtaaatgtaacatagcagagacttataaagcccctgcatattgggacttccttctttcctgtgcttgtatccctgagaccaccatgagaataagcccaagctagtctgctgcaggatgagagtcatgtgtcccaattcttcctatgtctcatgctgacagcctgccaaccactggcatgtgcgcacagcatacctagactgtccagccaccagcctacccatcgaccgaccacaaatgcatgatggtgcccagaaacagtgggctacaccagaaaaaacacacccagatgacccacataattgtgagcaagataaaatgattgttattttaagccattaattttgggggtgatttgttacagggcaaaagctaactgacacaaaaaggaagacatccattgagcatcttttcatggtagataaaggccctttacacagatttccttattacatctttactataaccctgatgaggtagataatatgcacctcactttacagttgagaaaaccaaagctgagagaggtcaacccactagtcagaccaaagcagtagagagccagaattagaactcgaagctaagatgggcataacctgccaaggaggtacctgccaagggaaaggtttgtgcagccaagtttgagtagactctgctttgcaggcttggaattcttggtctgtaggctatacaacccaccataaggcttcactcttggtgccctgcagagctgcatgctgtgcagggaaaaagtatgatgagtccagaaagcctgaaaaaagatggggtcatgatgaaagatgtggggagaagaggtcaaggcagtgctttgcagctgaaatgcctcataagaccagcttatgggagcctgcttctaaatgatcaattccaatctcattatgaccgcagctgccattaactcaggagctaattgctattagcttacagaaactcaagagggtttagccgcaaaaatttcatgacacggggccatctcactgcttaaatggccacattcctgttattaattccatttgactattagcttattactgttaagttattataactttgtataaagtccttgaaccggatgtatgtcctccatgtacatttcattatggggcacagagtgcacccagaggttcgatactttaattttcatttttctttaaagtataggcttatttaaaagcatcaggaaggttcttgatttggaagacagctctgtaagcaaaagccctaacaaaaaccagactttgctcagcgttttgatgcaattaaggtcttggcaaatgtagagtgagtctgaacagcagagctgagccctggaagggccctgggaaagtctggtccattcttacgttacagttggggaaactgaggactagacaggaggcaggacttaggtgagaaaacatgccatgtcagcatcaggcagatggcactatctgaaacaaccagctctctgttttagatgaattaaaagtctgctgaagatgccaagtatgtaagattacccacactagaccatttcagcagggtctgcaatcttgcctgtaaaaaatacctacgtgctaagaaatgggccaagatgcaatcattcactcctttccagtggagaggcagctggatggagaactacatgacagtgtgtaaaattagacatatttaacgggtgacgacaaggttctctctgtctgcgttcagaagcctcccttaacaagatccagttggttagttaagaaaataggagtgtgtacaattaccaagttcaccgtttgtttttgtttaactttgtagcttcttcccaagatgcctccaggcatgtctggaaaaatatcagcacttgtctgggcctgggaggtgttctctaaatgctccatggagttcctctgtggtcaggtccagggggcagctggtaaggaggggttagtggggccagggctctgacaccagctctgtctctcactggctgtgtggttgtggagtgtcacggtccctccttggggtctcagttttctcatctacacaactgaaggagcaaaatggaatgtcctcaatcctttcctcttccacatgtttattctaaatctcttttattggatttttgctcttaaaagcatggaggagggaggtgataagacagagcaaaggaaattgacagctcttgagtgcagggctttctctggggtcagggtttctgaaaggatcctaattaaagccaagtgagctctttcgagtgaagatctcggcagagttgcttgttgaccttgagaggtagggattgctgagtgacagagagagagaaagacgagaaaagagagaggcgaggagaaaaaggagtcagaaaggaatacagaagaaggagaaagggaagtggagggggcagtggggcagggaagacaagcagcctcagatgagggagagatttaaagcaaagaaacaagttggtgaaaatcaggggggaggagcagagagcagacaagaataaaaggtaaggagggacacaaatggagaagcgggggatagaaatgcacacatctatcagttaatttccagagcatacaaaatagaaataatcctccttcaaagcatgcatttgagggtgaagtgggagacagtatgacatgaaatgaaagccggaagcatttttcaatgcggacacataagcaaggctttaattattaactgattgcttgtgtatgtgcgtgcatgtgcacacacacacgtgcaagtaacaggccattgtgtccaggcattgtgaaacaagccacggaatccactggtcagagtcaatatttcctcaaaatggcagtcatttaaccattgtgcctgtctctgctctcagaatgtaactaacatcttaagtcaatagctttatggaatccctgcaaatcccttctctcttgctgccaccctggagaggcacagttgtgtgttttacctggaaataaaacagctgcacccctagggcaggcaggtgaagagacagcgatgatctcattgcctgcccagcccattttcctcgtgacccacgttgcagctggcatgcagtctgcagccctctgatttagccaacttggggtcctcttgctcaattgcaagaggacaggagctgtgggaggctgaggagggaacctggctcagtggctctgccccttcctcttctcttgcttctgggtcaggtgatttggcctcaaacaccacacaaagatgaaatattttgttccctcactgctcggtaactattctcctaagtccccggagtttctgagctgtgaaaacaaaacaaagcccatctcaggacagctgaggcccttttgccctcttggtttgccttgattttgttagtttcacctagaggacaggactagacactgtggtccaagttgggaagataaaatgttgtctgtttctgaagcaaaaaagctgaggctgagataacaattagcattgataaggtccctataggggcttgaaagagaaccctggcttgtttgtcagcttccgtgtgaggctgtgagcccactggtcatggttagcacttgagctatcccctgtttgtgggtaaaccagaactccaagaaaaaagcagctctgatttgtagcattcaccaatttccatggtgtaaatactcccactacagccaatttcaactggtaagtggtgatgtcacagaaggaggagctggaaagagaagaagatattcagctcttgctgttctgggaggaagtggccccagcacaccactgtttggaaccattttctcagggcttccttcccctgcttataactttcttcattacagggcccatactgttgcccatgagttcttctaaaatgtgggcatgatcgtggtgcttccagggttataaaccatcaatggctccctattgtctatgagataaaacctaaggttcttagcccagtattcaaggcctttttaatttggcctcactcttatttttttttttcagtcagatacatgacccatgtaatatgcaccatatttggactctgatgattgctctcctgttctcactcccctggattataagttcctcatgggcagacagtctgtgttcttcctttttgcatctccagctcctcacatgttgtatgtgctccccagatgttgcaggaaggaggggagggaaggccctgagtaatattggttaatgctggaccactggcctttccctacagggcctgtgctcaccagttcctccatggctcttggctcttgcccaccctctgcccaatgtgcccccccaccacttcctccaccatcaaactccaaacccacgtctcctggctctagcatcagctgtgcatggggatgtcttctccactgccgatccatccattccacagcagacatgagttgagcttcccctacatgccagaagcagctcctggcatgtgctggggaaacagctatggatgagacagatgacatctttgccctcctggagctgacacatgggggagattgatgatcaaaagaacagcagcaatgccccgaagctaaagggcacaggagaaagctggagcagagagggtgtcgcacgggctccggtttgataagaacagcagggcaggcgtcttgaggagctctgtgaggggaagcatcatgtctttgtctcccccatggggtctggccccttgtgcctcctccaggcctatcttgtggattctttcattcatcttacatagtcagaacatcccttatgaggcttcttcccctgaagaagtgtgcttcagtctgtttcatcctgagaatggccccgtccttgaccttagctctctcttgagatgatgcactctcgttctcatcttgtctgcacagctttcctgctgctcctttgctctaacatccactcctaaccgccacaaaatccagtcccaaccatagtcagtgaccccaaagccccatccaggcacttctcagtccttcccttgcagggcctctgtggggttggacccattgagcatcgcctcctgcggagactctccccatccctggacttgcctttgctcccccagggtcttttttctgactcctctgcttcactcccaggacatcaacctccacctccatctataagcaggtgcaccctcagcccacacctacagtcaacgcctctctcctgagcaatgggctacagaaccagccctctcatggccatctcccgccttgagtggcccacaggccttggacatcagtgggtgtgatcgtcgctcaaatcagccactctcctcaggtccctgctcgtgaatgggtccaccggtcagccaggaccccagcaaagaacctgggtgccaccacagactcctctctctcccatacttgcctcaataattcagcaattcctgctgcttttataccctaacttattttcaggtttatttctccatttccaccactgcccccgtatttgttattcagggcctcacttcctctcacctcctaacagatttctctgacccaggctggcctctgattcacataaaacctccagaataatccttcagaaacagaagtttgcccacacccctccctgtgtagacccatcctgtggctccctgtagcccacagtggaggcccacactcccaggcccgtcccgcaggccctccggggcctggtgcctgcctgtctgcctgcctgcctctcaccacaccatcctcactctgcctggccctcggtattccaggcacacccggctccttgtcattccatgcactcagcaggctgtttcatggctcagatcctgtgcttactcagggtcctctgcctggaatagcccgactttctccccgagccagtccacctggctcacccttcctgactctgcacctctcagctcaggcattccctgctgccagaaacttctctcactgacaacccatccctgaacagatcccacaggacagactgctctccctgttctgtgcaccccccaccacacacacacaccatactgtaattccctgtttgcaggcatttctccagattgtgaggggagcacacagccatgtcatactcatctttcaccctccatgcataacttatattgttcacttgaaaagtcatttgctcaactagttcagtgccaggcacctggttagaagacgggaaagaaatgtacacttggcagggaagcaggagaacatcatggttcctgcctttctgtttaagagctgtgtacccttggtaggtcctcaacctgtccgggcctctgttccatcacctgtaaaatgagctgatagcaaagcagctcatcagcgggttgcaggaggattcactgagatgtgcaccgctgagcgctttgaacagtcagctcctcttgttattcccggcacactgtgggacctgctcatggacatatgttattccactctcttttcataaggctctagtgaaataggtgttgttatcctgactttccctgttggggaactgttggcagaggctgagtggtctcccaggtctcccacgcagtcagagatggagcaaagtgtcaccggctctgtctctctgctcagaacaccttggggttgctcctctgctgacctgatttcaagggaaagagagaccctccatggagtctgaaggagaccatttcctgcaagccagagaaaaccctgtggtgggcagccacctgaggacacagggcactcattgtcccttgggtaacttctccaatgcccacagagctgacgggagagtttctggaccatcacggttcacacaggaaagctggattgtgtgtctttaggggaacctcaccaccccttggggtgatgtctgagctgacagtctggccaggtgcctctcacacaaagctgcttcttccccatcagacggactcctgggcagggagtgggtggtggggcacaggtggggcttacctgacagggcctttccagcagggtccccttggggtctaactggcctctgccctatgcttgctgtgttggcaggatgcttgcttggatttcagcacctggcccctcactcagcatgcctgccctcagagttcatgtgcagggataaatgcccctctatttgggatctagaggtgcctggcagggattcagcccctgtggggtttcctgttcttccaggagctatgtccagtggagcctctggcctcacacaatgctggcctcccagtttggcatcctcagcacagcaaagtccccaggaactgttcccatgggatgcccaagtagtggggcccccaagacctttgggaaatccaccctgtggggtcactttcctctataaacagccaaggtcaaatgatacatgtgtttctgatttgggaggactgggcaccagggttggggagggcgctgatcaaagggtcagggagctgggaggaagcctgtttagagaatggggagatggaaaacttttttatttcctaatcagtcagcagaagagattttctgagggggtgcctctgatcccagagggagtagaggagctgatgccaagaaaaaggccccagcccacagtcctgggaacagattcctggctttgccctcattcattccatggccttatgcacatcttgtttccctcatgagactttgtttccacatcagcatgctgggagacacacccaattaatcaatttccccatttgttatttatgagtgtctgtggatcaggcccagtgccaggtactggagacagagaaaggaaagtctcagcccacagtctcagtgctctggggaaccgggccatcagctccactctgagcaagggaaaggccaagaggagctttgcccaggtatgtggaaacacagaggaggggttttttgatgggtttgaaggtggcccccaaaagatagatccagatccatggactcctggtaccatgaatgtgaccttctttggatagagggtttttgcagatgtaattaacttactgaagtcaccctgaattattcagatgggtcctaaatttggtgacacatgttctaataagagatagaaggggagaagacacagacacagggagaagacagccatgtgaaggcagagacgggagtgaggcatctacaagccaaagactgccggcaaccaccagaagccaggagagaggcctgcaacgggttgtccctcacacccctcaggaaaagccggcaggccaacaccttgatttgggactcctggcctccagaactgtgagaaaatggattgccactatttcaagccacctgggcagtggtgctctggtgcagcagtctatgggcaactgagtgtctaactcacatccaggaaggttgtcttgggaggtttctgaagcagcggcattagaaatgagtcctgaagttggagtagaaggtcatcaggttgcagggaggtgggcagaaggccttcaggaggccttaccggagcgtgcacaggcatgaggcaagaacaagcactgcgggggctgaggacaatgatccagtaggactggagcctgggagcctgcagaagacagcgtcaaagataggcctactctaaagatggtactctgttgacccagagtctggatgtcattgtgagggtaatgggctcattaaaagtgttcagtaggggagtgctccagtcaggtgtgctttggaaaggtttcacaggaacccaaagagaagaatggatccagaactgacccgtccaagactaggaggtctgtttggcaacaatgccagcctggaatggtgggagatggagtgggcagaggcgaggcaggcacagagcccaggggatgggaggacacagggggaggagacaccatcagcagagcctggactgcctattgtggggcactctaggaggccacccaactaggggtctgggtgatggcgtcattccacttactgaaccatggagagagagtggcctcaggggtccacgatgagttaggtttggggacatgttgcatcttcatgcgattgctaagaggatcaatggactataacatatgcaaagtgcccagcacagcggccagccagtggcgctcaatatttatcaggagactgcagaaacaggcccgagggagggactagacacttgtctccatctccatgcctggcaccatctgcagtgctgggcacaataggtgctcaatgaatgcccacagaattgaaatatgggctggacctcaaacaccatctgccaggccatcataagcccaacactttgcagcaagagattcaccccacagaccacatcgacatccacgcagttgcaaggaaatcaatcggtctggctccagctgtcgaaactaggagccaagaggaaccctggacaaatagtcttcggctcagcactttctccatctggaaagaaaaccaggtgggggcaggggaggaacaccaggccatcagaaggttataagtccataaataagagatttgtggtaaataagctggcgaacatatccgctggctgctcttttttatcactcacctagacagcaaaattcccccgcatcttttctgcaggccaataaatatccttcaaggagcctgtatttacatagagagcaaggcgggtgccactgctccacaggccccatgtcaagaaggaacaatgtatggccctaaagagaatggctgtgcggggaatcaatgcaaatgcagtttcttttcccagggtgatgctcctgagcagggttcagcccgagttcaaggattgtgctcaggcgggtgctgaggggacctttacatggaggaggtgaatctctcccctaggcagggtccccagctgcctcaagcccactctggggctctgcacccaagaccctttctccaaaatgaaagaggcctaaaggttatactctgggacctctagatcaaccactgggtgttatgccacagaaggattcattaaggacctactgtgtgccaggcgcagtaggtaaatggaaacaaggacagacaaggctcctgccttccaatcagagagctgggattgagtggcttcgcccagtagtggggaaggctggtcagaagggctggcatataagctgacacacccagtgggatttgaacatgagcagaggagagagggtcctgagtagagaccatggcctgctcagagcaccccaggtaagagacatggaagcaaggtgccaggaggaggtagaaggacatctgatacctggagcgcagtgggtgagaagaaaccaggtgagaagagggactagaaagaaagcagatggctttctgggatgtggctcctgcagactcctccagccctcagggacttttttttgtatgggcagtgggaggctacttcaggttcttagttaggagaatgacattcccagagagctctcattactaaaaaaagcaatcaacaatttttctcatgaccacatgctctgggtattgtccccttcatcttggaataatgcccagcacacaaaaaagtgcttaataaatatcagcggaaccactgagtcaacgtctgaaatcccccacagagcagacctcgcaagcatattttctattcgagtgacccaggaaagcggtgctatgggcagtgttttgctttctgcctgggaggtgaaggggggcgatgtggtggcagttgagtgacttgcccaaggtcatccacaggcttaatggctgagctgagattggatttcaagtgttctgtttgttaaaaagagcccaacatgatgcagcttaaaaagagggctagaaataaaagtgggaccaagacatagaagacagagagagaggaaagaagagcaagaaggagaaacaggcagatgtctcatcttcctgtacctgtaccacttggggctttatttacagaacttggtgtaatcatataggatgtaacatcttttaaacatttaccaaaccaagagcataagcttttaaacctacacatgcattcacatttgaccatggtacattgttttactttatgaagaatggcgaacactgctttgtgaacatctggctggtcttttttcaaagccagatgtggtaaacgaaaaaagacaagtccataggctacacctgccaggagcaatgaccaggatttcttaaaccatgtacatgttattccttttggactcagctgaagatacttgctcctgctccagaaagccttagagtttctagaaggctgaaaagcaggaaagagagaagctcctgcttttcagtccatagcaatgcagggaaatcagatggggtgacatgtcacagacgcacccacctcaagttcaaggggaaggaagaaggaggccttgctgtggccttctggcctgtgcaatatttgcagccaggccgttagagaagagccacacgggagcctgttggaagggctggcagctgcgtgctttttccgttgttgataagggaggcatttcctaaacctgccactggccctttgtctccttgcatgtatacaggttgaacatccctaatccaaaaatccaaaatccacaatgtcccaaaatctaaaacttttgagcaccaacatgaccccacaagtggaaaattctacacctgacctcatgtgacaggtcccatatattactaaaagtattgtataaattaccttcaggctgtatgtgcatggtatatacgaaaacatacatgagttctgtgattagacttgggtctcatccccaagatatcttattatgtatattcaagtattccaaaatcccaaaacacttaaaatccaaaacacttctggtcccaagcttttcagataaaggatacacatctggtgcagcctgtcagagctcctggggaagaggagctggcaagaggatttggatgtaaagcacataccatattaacaaagcagaaacctcatggtcagcttctgggctctctcctggtgatcatagctggctagtgatgttggtaaatagatgactactggatagaggggcagtcagggaggcagctggcaaaatttaaagtgtgactggccttggacacaggataaaatctggttgctcgagccctgactctatctgtgattgctttgagacttcaggcaggtcatttgccccagtaggaattagaatccccatcctgttgttgtcttcataaggcaattgtgtggttgcagaatgagtaccagtgtgaatatttggaaaactgtgatgcgcactgtacatacgtaagagagaagtggtgtgttattaggccgttggcaaacacttaccactgtacaagacctgctaaacttcctttcagaggcaggcttcccaagggacagaaaccagtcagcaccctgagcccaacccaggctttaggctgagttggaagcctgggcaaggagagaagggaactgccccatctccggtgctaggagccttggagaatgctcgtatatacacagcctgcacgcacaccagcctccatgcctccctgggcactgagggtggggctgggctgggcacaatcacttcttgtcccccttaaggtcctctaaggctgccctctgctcctgcccttctctcagtcattgatcacttggacagatatttggtgggaggatgagagagtcctggatgcagaaattctcttggttccttcagtaactccatgatcagcagcaagctgagacagccaagtgggagggtgtccctggtgaaactccaaccagcctgtccactgaggtgagccttgggaagtttatgggatgtttgcaacagggaggagcctggcccctcctcttcctgtgtggtacctggaattcaaacaaccgatgggaagtgctccagcaggggactctggccttgccgaggatcgctatttcctcttttctgttccccttttcatccaataagaccctgctttactcaccctttaaaccatctgcaagcctaaatttttgtgtccgtgggacggacaagaactctgtctttagctaactaaggaaaagtcctgcaacaaagctatttactttttctgcaccatagtgtgtaggatccatgccctgattaatgcacagggttaccttaagaatcaaaagagagcatgggtatgaaaattgtttataggcttgaaatatccttacacgtgtttataggtttagggctatcccatcatagtccctacacataggcctgggccagagaactagaagttgtttaacttggttcttagatccaactcatgcctcattaaataccaatcaaggtagtatggaataaaaaatttcatgctaaattcaatatgagttgaaagataaatattgactggatatccagacaaagccaagttcccacctcccctagacactgatgctgaaatcagccatctcaggtttataaagatcctcagcagcctctccacagagctgagacccctgtaagcagctgtagaggtgggctctggattttagaaatgagactaggatttgtttacgggtacagacatctgagtggtccttcagtctctggccccactcattctgcaaggcagcagcagcatccccagcatgacttagagttttcctttctgtgagaacattcctggagtccttccatccctgtgactctttggtccctcaagttggatggggacatcttctcttaggggatgattttcataacattgtcacttgctggtgggcccagtaacacctttgtagtcagtgctgatcattatgtactcatttgagatttgctgcggcaacattgtttgtaatgtatttgggtgaggaagggtgttaaagaggctgtcacaaagtctccctctggtaaaacgcaggcagtttgaacatgcaaacttcccctcatggcagctttcccctttccattcagtgcttcttcagaggcccactttttccagacacggcgctgtgatgactggtaggagccacgaggatggctgcgtggggagccttggtcctgtcacttcctctctgcatctgtggacaagttgttcccctctaggtgactcagattcaacatcttgcaaatgtcattctcagagacctgagatgatgattcactgagataaaggacgtgaaagtgcttgcaggatgttaattggctataatcattgttagcattgctgctggcactcatggacttcctgcagcaggccttgttctaagcactctacatatgctaaggtacacagtcctcgtgacaactcttctacatgggccatcatttgtccccatgacatggatgaggaaccagctctaatgaaccagcacggttgcccttggccaacagatatgggatgtgctgtgggcctcctaggtgggaataccccataaggctcaaagagcaggtcgtatttgagaggagtattgaaaggtgaaaggaatgtcatgtacttaaaaccaatggaagctgcctcatattccaagggatgatatggacatgtagggagtgcctgagttggagcacgagatgagcatatgttgaggcagggaagaagaatgttgctgaggccagaaaggcattttgtgccgttatgcaggcacttttctgctttgttgccaatatcacccagtgttacagaaaggaccaaaagcagcattctcatactgtctaattttgctcagaaagagtggcagaaaatttgtatcgcatccaaactggtctgtttttggcagctgcgggtcccacatccaggaggagagttagcaattctctcatcaagaaaatctccccagggacctggaagcagctttgcccagttctctggcagggataccagaagccattgctgccagaaaggtcgtggtctctctaaggcatggctctccatggccgagacccatgatgatgaggtactcctgctctggaagggtcttcctcacacctgcagctcatgagaaccctccaaaactgcttctaaaggatgttggtgacatcaggtggttaggcccatgacctgactccctgagaaggtggtgaaaagggcggttgtctaaaccactttcctatttagatccaaactatgtggactgtccttcaatgaaaaagaggctatccatactccaagctcttgccagagagctcagcctggagccaactgctggcaggaagcccagctgagacagtggagaacaatggctgcgcttctgcaccactgcacactgaaaggctgtttccacacacggcatctcagggccatctctccagccacccctctaagtggttcttagttttcagttcatagatgcctagcgggttaatagattaataaatgagatttagggatccatgaacccctctatagctgtatgcaaaatgttgagagcaggtatgtttttcttaggagagaggctttagttattggtttttatttatttatttattcatttttaaatcagattctctaaagaggtctctgactctaaaatgggttaagaacctccactctaaggatggatgagtttggtccttatattatgaaagtgaccaaagaagccacccgtcctgaccttatttatttaggtcctgctctgagatgtttgttaatattatggtccagctgttacccaaagtcagatgaagaaatttctggatcttctagttaactcctattgaagacatgatccattagatccattagagtatttggcaccaacctgggacccaagtgatacattctttttataaattggcactaggaaaaactttgtaccttttgatgatgggatgtatgtctttctttttatcaactgttgagaactgtacgactcaagatgtttgcctcctttctctggctgctgggctgctgtgaagttctgagttatatttgatgttcacttagtcaatggttacatttgatgtgcatttattcaggatttttgctgatctcctgtgttctaacatcagataagcacaggggagagaggattgaacaaaatagaggtggtccctgctgtaacacatgatgtttagcccccggtttttgtgcatgtagttttctattccactgcagattgtgaatagtggtgatcaccaacacccagtgtccactgtgtccaggcatgatctaactgtttacatatatgaattaatctagtgtccctgagacacaatgaccttaagaggtaagtactattatgaccatagtctaaatatgaagaaaccgaggaagaaaaaagttaagcttctaaagttcacagtgctagcaagtggcaaagtcaacattcaaagcccttggccccaggctctgcacttagatgtggaactcacacttccatcctcaccttgccagctgctttgttggggcaatattgtgtgtttgtatgatgtaattcactctatggagcattttacccccactgctgactatagtccctgatttgcctttgtttggtaaatattgctcttcccattgctgagatagcaatgtcgacgttcagaaaggtgaagcaattctgtgcctttaaggccaacctagcccccaaaaatcaagcgatctgagcccaagcccagaaggccttcttcccactagtctcactccttttctcctaatgcacatttatgtgtcattataagtggccccagtcctgtgcagggatgcaaaaagaaacaatacttggtgaatttcatttgaatactaagtggagaagtgtccagtggcctttgttggttttgtgactttgaagatcctccagtgctggttaaatgtaagattacacctggttaacaccaagaggaacctggaagatcattgatctagaaacttctgaaagttttttgggaggataaagtctcctcagagaatcttatgcaagttatggacactctttttccaacccagttccctgatcctcattcttgttttgacaattttaatgatactgtgacatttcaggataaattgtcattgttttcagaaagagctttcagaaaggctcattgcttgttttctgcgactctaagcacctttctccttgtcactgagtggtggaatattttctttttttttctgcaaaggggaaaaagggaagtgtaattttcaactctcagcgtaacttgtctttgattaatgtatattgtaatcatcacagaatacacagctgtctattaacgatggaaccaaatgagttgaatagattatcaaagagcagcagccccaattccactctaaggtacatgcttgtctttagaacattaatctcattacaggtttaagtctgattccaatttccctgacagtcggcaagaaggagaggaagattgatcaaatatgccaggagcagagagagcgcagatctcaatggggctgaggaaagagagcagcatggtttcttttttaaatgattattccaaagggatgagaaaggcggagaagagattcaaggagcattgaggatgggtggcagggtcctggggtgagcaggcaggtgacaggaacaggcagaaggggctgccagggaagtgggtatctctggggcattgctggtgaggaagaaccaagctggtaggaggcaggagagggatgagggattgtggcaaagtcaccagagccagaccttcagccacacatccctcagaggcccttgcacatagcacagagtggagttctggacttgaattactgacaactcaatcccacacctggaagaaggcccaggctctgccacaaagctggcctggaactccagggacagaggccataaagcaggtcttattctaatttgcttgagagtgaccctgagggccttgacctcaacagtctcattgatcatgcttatacccaagccacacaagcccaaggaactccagcactcccaaatacaatccacagctctttttccatatcatgccagatcaaattcttaacacagtcaaactctttagtgtcccaaacaagctccataccatgtgcacagccacccacatttatacccaacctgagtgcaaattttgaaaaagaaagttgtgcagttcattctctatcttcagctactcctgaaccagcctgggcattcatcttcattcttctcccccaaatacttcactttctagctaaacctactcactgttcctcaaaatcacagatgttttttgtatttccattcttttgcgtatgctggtccctctacaagagcactctttttctcctcatccatcagaaaaccttcctcttaaagttcaatgcccatccagcagtcattgaagcagggtaatggccttaatttagcccccttgtaacagtgatcttcctcgtacagtcagatttcagtgcacactctctcttggccacttgtacacccacattaatgccgctaccatgtagggtgagagtcaaaggtccacctgtctacctcacctccttgtctgtgagtactcaaggatgaagagtctggcttgtgaaactttggtatcctaaagtctatcatggggcaatagtaagttattagaataaatgaagggccacactcagctttaaaaatctttccaggtcccccctcacctgccccacctgccagactcagtgccagatttgttcacttgccggctcttgatgagatgagaggggtgtgtttctatcccaagggacagaaaggacaagaaaataaaacttagaaggattgagcaaggtgtccaaatcccagagttcataggtggcagaacattgagcttggtcttcttgagtccaaactctgtccacagtccaatatcacctctgagacagttaaagttcataggctaaatgtgtgtggttcaagttttgttttagacaacactccaggagctaggccaggactagtgtgaggtgagagagacacaacatataaggaagtgctcattctcaggtgccaaccctgcatttgcagcagggtgactgcctcctaaagttcatgccctaggctcatcatttatctcaccctagcctctgccctgccagggacacatatcagctgtgtagagaggaagagccttttgttttgccaaatatttgggtttctgggttggctattgttttacaggttcatggatgatccttcctgagcaccaactctgtgccagatactggggacagaaaggagaagaaatcaaggtgaaatagatacagagccttgctgttgtgccagaggtcaacacacacacatacacactcacgtacacacacacatacatacacacacacacacacacagagctgcccctcctgcagctattcaaaggtaggcttcacaaccctgaatgataagtggtcagacttccaggatatgttgttagccaagaagaagggtgtttcaggcacaagagatagccaggagaaagacacagaggcaggaatgcaagagcatgttctaggagccccgtttgtaaggcagggaggtggaccagctcctggaatgtctccaagctgaggcattggcatcaccctttgggagatagcaaagtcaggacctgcagagtcacagcgctgggttttccacagtgagggtctctgcccaaggacagacagtgccagcaacgagtgtctaaagcaaccgccatctttaagaaccatcaccctaacctcagccagccccagtccctcagagttgggaaggtctcacaggggcccctgtgctcaccctccctggtttattggacgtgttcagccagtcccagtgcctgccaggcatcctgttctgctgaaagttcacagaacatgtcaggcagcagcaggggatcctggcccagcacccctgctcacagggcaagaacgggctctgcaaggctacggctgggaaaatcatcatgtacggtgggggcaggattggctgtgatttcccccttcaagttcccctgctccatcctctgctgtgacccataaattcaccgagatgaagtcattccccagtccaggctgtaaaaagtcagctgcgtagctagggagtttgcagccgagttagattataaaataaaaccaggggttctggaagaggagggtcaaaccctctgagcactgggggaggggagaacattgttctgttcttttaacaagaaccagcaggttttcaactttgtaagattcctcaccccactctcccatttctctcccaaccccttttagtaggagagtcattcctgcaaccaccatggtgcttccttagtgttaaaaaataaaactaaaatcaaaaattgtaaaactggcctgaaagttctctcctccctgctgagtttgaaacatacctcattattctgaagtcttctgaaatttgagcagaagctgagagctaagagaaggcccagatcctgcagccttcccctctgagactggagcaaactatgatgtggggagactggctcccaatgagtgatggaaagactcagtcttctcatctctaaaaagggcacataggagttgttgggatatcacattgcctaagatctcctccagcttagtcttcaaccctttcattaactcccaaaactatttatcgagcacttactgtgttccagacattgggatagaccctagggatatagcaacgggcaaagcagatgaagtcttgctttcgccctcttcatctggcaaggtttgagtatctggtacactcaaaaatgaagctgctcgtgttcttgtcaccttgacagtgagaatgtccatcaaagtgaggctggtgatgtctcacacatgcaagggcctcacagctcaatgaatgcttctccagtctcattctacagggcctcctacatcagcatagaagactcattttctcagaaaggaccatgcaagatgcagatcattatgttggcattcattggctggatgtgggctttgcaccctcttcccattccatcaccccaaacctagtactctctcccagtaggaggagacgggaagaagttttaaaatgtgtgccgaatactttctatgtgccaggcacagtgctaggcacttgtacatacattttatctttacagtgactccccagaagtgtgcaacagtcttgtttcgcaggtgaggaaactatcatattccaaagacaaggttcttagttgcatctgagttctgcaaatttaatagcatggggaatatagacctaggaggactttgacctcacagccagcagcttatgtctcaatccttttgtctttcccaggtagaaaagatcttttttcttttgagttttcctggagttcttagaataacgacttctaaggattaacttcagttatacgctagcaaatgtttaacattgctcttaagaaaaaaacaaaccttgatttgaagcatttgctgatttccatggcattgtaccccaactgtagctaatttctagctatcaatgtgaaaatggagttatacagtatttccaccgtacagatacaaacatgaagaaatgtgttgatgtctttgtgtctcatctagagaacctgcagtactttatgtgtgatgggattgcaataaattcttttcacagaccacagttctcactgggcatcactatgtgtcttagaaatagtatgagtttggaatcaccttgggaaaacagtatattggacctggaagaagcctacaatatttacttaatgctgtgtgacaaatttcttcaaatatgtattatctcacagtttctgtgactcaggaatccaggcctggcttagtggggtcctctggctcagggtctcccacagcctgcacttgatgtggagcctggggctgtagtctcatctgaagactcaaccaaagaggatcgtctccttagtgcactcaagtgtttgttggaggggccatttccacgtgggctattggactgaagggctcagtctctaactggctgttgcctggaggtttttcttagtttctcactgcatggatctctccacaggaaggcctacaacatggaagctggcttccttcagagcaaacaaatgatagagcaagagaatatacacaagataaaatgcagagaatttttatagcctagttttggatgtgacatctctttacatctactgtattccattcatctgaagtaagccactaggttcagcccaccctcaagaagaagcagtatacaagggtacaaatggtaggaggccaggatcattgggaactatttttaaagctacctaaaatagaacctaagtgacaacaataataactacaaatacttactgagcacttattatgctccagaaactgttgtaactgctttccgtatgaagtcttatttcattattacaattcaggagattggttctgtaaaccccattttacagtgaagaaaactgagactttgacagtttgtgtaactacctgcaaactattcatctaggaacttgagagagctgtgaggctggcagctggcctcctctggagcccacactctcatgacctgggctacctcttctgagaggtcacttagtgactttggtattcttccctttttgcacattacaagtcagagccagaaagcttaagtaactgtcttaggtcacacagcaagctacgagcagaggcagaactcagatcttaatgtctcctgagtgccttggtttttgaagaaaggctaaagaagtaggcaataaatccagaaagtagtattaaactttctctctccttggcctttcagctctctagaagtgtacaggagactgacacttggcccaactctgagtgttatctgaaagtcaagcttccctccaccccaagttctgacatgaagatgatggccctcagtggtacctatgattaatccatgtcatttttctgaaatacttaagcttggtttcacagggggaaaaaaaaacccaggcccgtctcagacatcagagtaatgggctggttttaagttctcctgggggcttaataaaaggtggtagtttgggtaacgtttctgtgataggcccttctgttaatacttatctagctaatgcatcttccaaatggcctggtgcagctttcaggacattaaggagatttcataatgttgttctacgtatggtatttttgcactggatttttttcttcctttccagttgtataaattattttatgaaaaaggtggcaatgctaagggaataggggtgggaggaaatgttaagattttacaggacccagcctgaagcatttttggagcccagagggagccaggctccacattcttgaacacaggaggaacaggaggaatggaagcttagtggagcggcggggcctgtggctgacaaacaccagctgcactgagtacatatcacatcatggcctggcagacgtcttctccttcaaaatgacacaggctattagcagactcaccgcaaaaggatatgccaggagtggatgcatggaattcctgctgatatactggaatcccaagactaaagcaggcttccctgcccttatcagaccagccaagataactggagcaagggtggaatctgcacacaagaaagaaattccaccttacaaataccaggccccagatccaggccccgtgtttgatgaatttattgattccacatagctgaaggcctgttctgtgccaagtatactgcttggagttgtagacacaggatgataaaatatagtccgtgctgtaagggtactcctggaccaatgggaaatgcaaatgacatctaaaccaaccacaaacatgcagtgtgatgagtgcatagatagattgaagccaggagtgggacggaggcatggaggacaggcacagagtcaattcatggggtggagacgacttttgaaggatcacgcttgagctgcgtctctcaggagagggaggagaggccagacaaagaaagatagtcacacgatgtcacagagcatagttctttttggaccttctctgagagatgctttggatcttctctgagagatatattgtggaccagaattgtaggaccacagggtcctttatttcactaactatttctgtatgattctcatgaacaactgcaacaaaattcctacagctgtgtgcaagggtacctattttcttcatattctcacccagagttaatgttttccagttttctaatgtttgccaatcagatggggtataaagtggttccacatcccaatttgcatgtctgtgctttcttgatagtttgccttagccacttggatttctcctatgaattgcttatttatattctttgcatgtttctctatttctttttcttcttgttgattttcaggaattacttgagcaacctacttattaatcatttgctggttttaggccttgtcaaagtcttctccaaattgtcatgcacctgttaaggttttgaatggtgcactttgatgaacataattctgcctttaaattctgatgtaaatccacttgtttttcccctatggcttgtgtttttggagtcttattttaaaaaaattcaggactccaaagttaaaaaaaaccctacatattttttctattagttttagtcttaattttgacaactagatctttaaaccacttggcatttatttttatagaaggaatgagataaggactcaactttatttttctctgcataggaagttactaagctactattcctaacatactttactagctaatttattctttctccaatgatttgtgatgctagctctaccatatacctgttgggagccaattcttcatgtgtatcttgcatttctgcataccttataagcagagactgtgacagactgtttgcaactatcttttcaaggatgtttgtatagcaaacacccttggaaatagagatactgtctccatgcagaacaaagggcaggtttgtttactaccaagtataataaaataacttctccctctggggcaaagttcaggcaagcttaccgcccattacaaaaggtttgggtttaagcttagtgtttctctcctgacaattaacccactatgtgtggaggcatcacccagacctcttcatgtcatcctgtgggaactgggatgcgaggaaccaacacaaatgctgatgttctgactattgccattgctatgagtaattagctgcccgttgtctctgaacctagggtcttgtgtcttctgctaacaacgatgaaattgtggcaagttcagactcttaacagctcatgaccataccaagttctcatataattgagactgtatacttttttattagtatatttctctctctctttctttttttaccccagtatcaactattttaattaccattactttgtagtaagtcttatcgtctgatagggcaagctcccaactttgttctctgtcaatgttggcttaattatttcttagcattcattctcttataaaaaatttttttggaatcagtttgttaagctctgtaaaatcttgtctgagtttttattggaattattttgagtgtgcagattaatataggaaaaatggcatctttctaatgctctctattcatgaatatggattttatctcacttccttaggtttaaattttcttccataaatgttttgtacattccttaataagtcaattgctactttggagagtctgttgctattgtaaatcgtatcttattttttattgccatttcttgttgttaatggaggtatagaagaacattattacttctcacatattcatcttgtatgttgctgttttgatttttgtatgtaaatgatcatatcgtctattaatgatggggaaatttctctttcttttcactctaccattatttctttctttgttaacaagaacctctagaattacatggcacagtagttgtgacaacagttctgcttgttattttcatgacctaaaaggaaatttctcttaagtatgatgttttctctacatgtttagcatgtaacctttgttgaattaaggatgctatcatctatttatttctgtaaaaacttttttaaatattagaatttcatattaaactttatgctatttccgcattgactgatatgatggtttttcccatttctatcattaatatggtgaatcacatgaatagatatcctttgcatttctgggacaaatcctacttagtcacgatgtatttttaaaaatatactgttatattccgtagcctaatcatatatttagagggtttacattaatgtggatcattgtataaatttttgtgtttactctgaatgaaatggagagtcatctaaccctttccaggggaggggtgataagattagataaatgtttttagaaggaccaccctggctgcagttgtgaaactagattgcagtgaacaaagaaggaaacaggcagaaaagttaatttgccaatttgctttgtaaatccagatatgaaatgatggtttctagcagggtggaggcaatgaagaagatgaacaggctggaggctgggtatattttaaaggttgagccaacagggtgtttgctatgttgaatgttaggagagaaaacaaggagtcaggtttttgagcaagtggaataacagagttgccatttggtgaaatgaagaataatgcaggtatggcagattgtggtagagacagatgagacagaggttggtggctgatatgaagagtttgctttgggacatggtaaggatattgggtatctaatgaacttattgccaggaccagaggacctgtcttcaggtgaagtttccaaaagtactgcctgaaacttcgccccagaaatgttctgaggagggaccttccaggccaccaatgtccctgtcatcaccacatactaatataacagaatttcagatttctcactatcacagttgctgtcagctccatgccacttctgcatccaaccacgactgtgcatcactactgctactaaaccgactaagtgagacctcttaatctccaacctcaccagcaaatccagattcagtgctgagttctttcttccagttattcagctctgaattaaactctctggcaggtacatctaattttacatgtacaggttacccgacactttgtgattgagcatatatttgtgccatgctgcaaaggaggctgggtaagtaaatgttctgacttctgctgcaggaagacagaactcataaagcaatgtacttacaagacatcacaggggtgtttaaagggttcgaggcagccagaaaccttgataagtatctattagaattcctagctcacctttacttcccaaattgtactgctttcatctcttacttttggcttcttttgctcaagtgatggtttggtttggtgtgtgtgtgtgtgtgtgtgtgtgtgtgtgtgtgtgtgtttattcgtccatattttgcatgtatccatggattgtccctttttattgttgactattattccattgtatgaatgtaccacaacttcttttctgtttgtggacatttgtgtggtttccattttggggtgattatgaataaagctgcttcaaacatcttactataaatagtgtgtggacatgtttttatttctcttggataaatacctgagagtggaatgcctgggtcattgaatgggtgtatgtttccttttataagaaactgctagacttgtttccaaactggttgcaccattttatgcccccacaaggagtatatgatagtcccagttactccacatcctcataaacacttgatgttcccaggatccaatctcaagatccatctcactccagaacacatctgtctggtgctccttcatgccctttggcataaagggacctatccacttctgaacatggggaatctccctttccctgggctcctttcggccaacaggagacagtttcctataatgcttattcttgggctgaccttggccaagtccttttcattcccccggacctcagtttccttgttgctgaccagaagctttggagaaggtaattgcttcacttcctttcagtggtgacattttcccgtgagcctttccaatctatgttctttcctcgtttccttttccatctgtcacttgacactgtgcaattgattacatttcctttaactgtcttggaaaacagcttgtattttttttatttttttttacaaaaagagactttaaataaagctccattttgctaacaaatttgagaagaaaagtggaaaggaatgtgacatttattgaacacctactatgaaccatgtttttacagatccaatctcttgttgaattcttgcaagcaccctataatgcagtatttctgagtggcatttttacctgtttcacttttccctccatctctgtattaaagttctttggagaaacagaaccaataggatatatttagatagataagaggagatttgttatgggaattggctcacataattatggaggctgagagaagtccccagcctgccatctgcaagctgcagaagggtggagggggaggttggtgtaaatcctagaatctgaagacctcagaacctggagcttcgatgtccaaggacagatgggtgacccagctcaagaaatgagaaggaatttatccttcctccacctttttttattaaagagtcgaggtcttgctatgttccccaggctgaagtgcagtgacgtgatcatggctcactgcagcctcaaaagcctgagatcctacctcagccacccaagtagctggaactccaggcacatgccaccatgcctgggcttttttttttttttttttttttttttttttggtagaggcaagatcttgctatgttgcccaagctggcctcaagtgatccccccatctgggccttccaaagtcctgggattacaggagtgagccactgcacctggcctcttccgcctttttgtgctatttaggccagcaacaggatgatgcccacattggtgagggcaggtcttctttactcactctattgattgatatgctaattttttctggaaacatcctcacagacgcacccagaaatcacgttttatcagctatctgtcttagcccagtcaagttgacacctaaaattaactatcacagcctcaactgctcttccttgagccagcctgtgaccactccctggcctcattcttgtcttgcccacatcgccacctccccagaatgtccccagccagtatgtttgaaacgtcagcctctcccactccccccaatggttcccctccactccttctgcttcactgttttccatatcatcaccacttgactaaaatgtatttttattatttttttaaaaaatttttagttctggggtacatgtgcagagtgtgtaagatgtatttttcttgtttttttttcctcgcccaccccaaatagaatttaagcttcatgagatcagaaattttttgtttcttttgttcactgctgtatcgcatctactaggcacctagtaagcaagcaagcaatgttgaatgcatgatgatatatgaatgaatgcatgcaggagtgaaatgaagaaacaaaagttctgactgtgactagcttatccttggtgaccctgccagtgaatcatgggcctggggatgcaaagatgaatgaggtgtgctctcctcctgggagataccaccacttaccctatctaaagaagtcctccattcatccttttttcatgcatcctgccttatgtgcactatttcatcaaataatacagatgcatttgtttactagctttctaccccactggagggtggggacttgttctctgccatatccgtagggctaaaacagaacctgtgtgctgctggacctcaataaacatgtgctgaataaataaacacacaaatgaaaaaaaatgaatagcttaggcccctgtcatattttatagcacaaggaagttctcttttgatgtacttttgaactcgtgtttataattatctgtttaaagtatatatcctgcaggattccaagtttcccaaggggcagaaactctctcattcatattcattcccaagggctagcactatctgacctgtagtagacccttaataagcataataagcatgtgttgaatcaataaatgaagggtaaatgctaagcacgtgattgttggctaaccgagtgcatcaggccctcttgagcatgacggcagatcctctgcacctgctcttactccaggcacagcccgggtcatccattccatgcagtctctgaccacatggggcaggggtggcctggtgcctcccccacaggcttgccctgttcaactctctcgtcctccctggtatggcaagcccttggcatctctctttacttacacatcctcagccagaggtgtcagcagtttggagccagttttgactgatggagggtgggagctgatggataaatgtgtcgccagtttgtcccaggtagacagtcctgaggaccagttcgttatgcttccagtcacctatagaggtggccaactcaggttttccctccttccctggtttactccctgcctgtcactcctgcgcatttctcaatatactccctgcacacaagcctttgtggagggctcagctttcaggggaatgcaggtcaggatgccaagtgaagtgctggtgggcaagccatttttcctgtactaagtttcccaatggcctgtgatttagaggcatccttgtctttgataggcaggaggcagaggggttcacgggacggttgatcatgagactgctctccctctatggattccgaggcccagacctggaaggaagtactaggaagcctcgtagccacatcatgtcctccagtccagctttgttagtgttaaggctggaacgtggttgccatctgactacaatgtctaagtctcaactggctgaaactgggagaaaagatgtttatgattaattagcagtcccaaaccccaaaagggctttaaatggggtgtacataaagtgctatagtgataccaattgatgatcacatcctagggcagggaatgaggagtggtcaaagaaagccacagagaggaggtggtgcctgaagtggctttgagggaggaggagaatgctcagggcagaagtcggagaagggcattctgagcaaaacatccatgcagggactcaggtagagcacactatttgttaaggggtgagttagttaaggggtgatgccctgagttctttcctctccctagcaattgattcgttatctctggatatagatcagttaggaatgctttaggttgcaaataatggaaagcctaattttagttgtttcatcaaaaaggatttctttttctcacatgccaagctatctggagaaaagtgaatgctgaggtgtcagtgctttaacagtgccaacactctgtgggtttctcggttgatctttgacgaagacttggttgccccttgatctcaggatggctactgtaactccagacatcatgtctgcaggcaaggctgaatggaagcgagtgaagtgagctgccacttctcttcatttatcataaaagcaaaaggctttccaaagacttccagaagactatttccagctcattagccagagactgatcacatgaccacccctagctacagcacaagaggatgatgagtgggtatatagttggacatatgatggcacctgaacagaatcaaggttctattagcaggaaactatctgccttggagtttcaagttccatttatggaataaagggtatgatgatatcaagggtgaatggcccttccccaggaccacctccatgggagccacttcctccatcgcgtctaacctctgttatctttgcacacatgagaacaggtcagcaggtcagctgaggggcttgaggagcctccagcaggggctgggcttagttctctttgaggcagctctggaaccaggccagtactttccacacaggtggagatctcctggcagggggctcatcttattgttcctgctgtgctggtgtcccccccccccccccacaaaattcatatgttgattactatttcctaatgcaatagtattaagaggtaggcctttggaggcaattagttcatgagggctctgctctaatgaataagattagtgcccttataaggtatcttgtttgcctctttcaccacgtgaggacacacaggagatgacgtctatgaactggaaagcgggccttcgccagatactggatctgctgtcatcttaatctgggactcttcagtctccacaactgtaagcaacaaatcactgttgtttataaattactcagtccatggcattttgttatagcatcccaaaggggctaaagtggggagggtgggtgatgagcactaacactttggctttgaaactcagttgacaggtgcagaaaaggccatcttaccccaacctccaagccccatccactgccacatttgcctccacttattttggacaggaaaatgcagtctgggctcgggaaaactctgtgttctgacttcactcttcccctgatgggctcaggcaggtcctttctcatcactgagtctcagtttccccacctctaaaattaggaactgtgttatcccctttgattgcctggaaagattcttgctggagtggacagatccctgattttagagtcctatgttgttgtttttgtaccctgtgttctctgtttccctctctggctggctggatggtcatgggccatagctgtcttctctgtgcttcacattgcctgtttgtaaaatcagagggtgattgccaagaaatcctgctgcattaaacacatctgggcactgaggcagactatcctgagtgcccaaagtgaggtgagcagaggacacagagatgaagacaagagagctgttggggcacccaggtgtcaggggcaaggctcagcacatggaagctccatttgtttgggacagtggtccacaggcagtctgctagcctcacctgtgaaacactctgggcccacagggcactttacataccctctcctgcctgtggaaggtctgcggaggagctccatgcagacggcctccctacaaacacggactgccaccttgcctggcctccctctggactccatgacccaccccccgggcactgcaggatcagtggctgatggcattgccaaggggtgggaagcatggggggaacaggcccagagtcctgagctctgtgttcagttaggccactgtgtccctggaatggggaccagctgcccaagaggaccaggcatgtatgcctgctgtacaggaagtgagacacccagggctatctggggtgtgttttcaagaaaatcttgaaaactgcagctctagccagaggtaaacagggtttcattaaatcatgcctggcctgaagtgcagagagttggtctgtttaacaaagcaggcacgctccctgcgcgatggtcctggcagctgtgttggtgaaggacacacctccacagagaagagaaacaaagacagcgtagtcgtgtggttctggctggcatccccattattcccctgccctgctccctccggcaccttgtggatgtgctggtgtgcctgcctgcctacctcctgacacccaaccagtcatccaggtaacatgtcccaaacacctacgaccagctgctaagtgaagcattttcactggctggactggagttaaggcttgtgacacttctcttaggtggacattatcatcccctttttgctcttttccaattaaggaaacggaaacttttggaggttgatacatgatccagaattgcacccccaggaaggaacagccgggagattcaaatccagatcttgtcatccaaggtctggttccaagtctgcccctcagaacctgagcctcctggttgctcctccaaattatctcatcacagcgaattccacctgttcaattccacctgttctgaggtgagctgccatgactccacttggttcttaaaatggccccaggagatcactagagagtcaggatgatgcccattctgtggagtaaaaacaatggtcaacagagctcagtgactagctccaggtcccttcgccaatccaagaccaatccagttgcagatcttagaagtattccttctcttttaaagtgtcagacaaacagagcaacacacttgccggggtaaagttctaattaactttccaggctttaattctggtgtgcgaatgttcatttccaggcttgttggcaaatgtgtggaacatgatctctctctcagttcttccctttatgtttgaacctatatgctttgtaggtggggttcaaaaaaggcttcatgcttcaggggctgaggtcccttgggtccatggaacagaccccctcagcaatggacatgggattggggcacttgagctggaagacagcctggttcttcactcacagcccaatcctaagtgattcttcataccacctgtgggcagcacctgcacatgggatttcttcttcagaggtctgtgtgcttgtgataaaactcttgctagctgggtgaaggtggagggcacccaccttcacctagagtaatcacaaactctacagaagcctcaagtctatggaaagggcaccttcccctgccatgcagaaggggaagcacccgctgtgaatgtccctgagtttggtctattatgtgatatgcattactttgaggaacacccaaataaccttacggtaaagatgtcatctttcttattttgaaaacagaaactgtggttgaaagaggtaaagcaacttgctcaagatcatgtggctcggaaggagtacagcaggattttaaacttggtctgtgacacctgtgtccctgggcactcccctggccttcatgtgaccactgaagagaaatgatttggcttcctgtccagtgaacaacagaggaaggagaggatcccaggagccctctcttctcctagcaattcagctctggaaagacataagatgcaattgctgagcctcacccttttatcctggggatggggaactgaagcccaggatgaaaaagggttgttcaatgtcatagcccaagttggctctgccaaaaccattctctaagaactcactggaagctgagtactctccaaggcacagctgggggagactgcaaacagctggacccttgtgccttgccttccaaggctctggaaacagcatgttcacagaatgacaggtggcacagagctcaggacacttgggtcttcttccttggtgggttctatgcctggggccattctgtctctctcttgcctggtgcctttgcctccaccttgcttataagctcttttcttccaactacattcagaagctccctgaacatttcatgcctgttatcccaggggtatatggcctattcctcactgctacctctgtttacatgccataaagggagaagcggcttaaggcatgcaggggaggtgagttcacccatggttgaaaaaggcatctgacttcaaagctgggagcttggccccagctctgccacttcagtgatggttggcctcccacagcaaacccaacccaagccccaggctccttcctctgccaccccaggcatgctgggactcagccagagccggagctttgagctctggagtacagcttcatgtggacgtctgagtgccctgggagtcctggtgttatattattcccatattgaaggccatccaagactatgaaaactctaggacaaaacacttaaaattccaagcaaattcccagcctcgtttcctgtgcattccttcccaccaccctgggcaactcgatgggttgccccatggtcagagtctagtgaaaagtaggaaacatcaatcaaatgcattgcgagcaatggctacgcagaaagggtgggagtgtggaggcacacgtgtgctggtatggaagcttgaaaatggatggaggtgactagagacacctgttagctatgcaggaacacaagtagaacacaggaaaaccatcatctcataaattcattcaataacatcttcacttagctcctaccacgtgctagggagtgccagaggctgggataaatggtgagtcaagcaaacatgcccttgtgttctcagcccatacagcctgggagggaggcagacagcagccacatgggtgagtagataatcacaagctgagaaaatgctaggaaggaaaatacaggctaatgtgagacaagcttgaaggagaagctgaactaatctggagaagagaagaatcctacgaaaaagtggcctatgaacaagaatctgaaggatgagtagaatgtgcattggggaacaacaagagaaacagtgaaaactttcttggcaaagaatatagtttgtgcaaagcccctgggacagggaggatcatggcccattggatgctgagcatggagaggcaggtggagcaaactctggaggacactgggccaggttagagccttgtccttcctcctgagagcaaaaggaagccatcagatgggcagcagggggaaataccctcagagttgtatcttaggaaggtcactctgacagctttgacagaggtatagggtaggggcaggcagatgaagaaaaaattacagtcattgaggaagactttgcatcccccatgcaggtgagacagggtgcataagagtggtgatgaaagagtcggagagcacggcatgcatgcaagggatgtttaagagatgacattgcatgacctggggacaatctgtattgagaaggggtgaggaaataggaaatacccaggcaaaagggacagcagtgtcattagcagaaataagcaacagtggatgtggttgagcttggcccgttcttctgaaggtgagtgctacaccttgggagatgacacaaagacaaaagcgcacctctggccgaggaagagaggagaacagaatcatatctaagcaggggccagaggaggggccttgggaagggcaatggtgagaggcaagcagcattgtggctatcctggtccatgtcccttctctcttcctgtccccatctggtctgggtctatcctggtgaagccagagggaggggaagggctgactgcacactcttcagcctcaggctgggcagtgccctcatcacccccagcagtccctgcctgcctctcctggcactgctcagcctgcagccattcctatggggcctcactccactgcatcccctccactggctacaatagtaataatggcagctcaccacttacattggccatattgcttaggcctcccagtaactctctgaagaaagtactccatatgtatccattttgcagataaagataattgatgcttagggaggcaacttaattcactcaaggccgctccactagcagggggcagataggaattggagctcaggtctgtttgaattcaaaggcatggcttcacctctaatcctacccactttcccctgccggctcctctgcctgacagccaggctgggccccagtgcgggctgtgagactgctccccatgtccgcatctttcccaggcccctcctcgtgtctgagggtcttagcacctgcctcaggccacaggagggagtcgtgtccagcaggagaaatgcctgctctgcaccaggacccactggctctaagccactcttaggaatcagacctaaatgtcgccctcactggttccctttccacccatgtccccagaaaagtcccaagcagtgagcacctcacgtagagttgggggcacccgtgtgctatacaaaagcctccttgttgtttccacaaccccctcaagtcacggcaccactgtagtctctaaagttgggtcccagaaaaccccatcctggagttcccccaatccatgattcatatggacctcatccccagcccagacacctgagcacccagagcgtgggcggtggtgacaccacacagactcgagaagccagcctggacccagtctctctacttaaattcccttgctgaggacatggttaatttggactagagaaattctgaaggctcttccagctctgaaatttgctatttctgtctggaaaatgaccccaaaaatagcatattccattccatataaaacaggaaggctacaaacattatcttcctaatcaaaactttttgacaaattccttgttccctcaggacaatcatcgataaaatttccacaaaggaagggccttttattcgtgtgatttgctgctctatctagggtctaggccagtgcctgtcacacagtaggtgcacaataaatatgtaaggactgactgggtctatctgtttcctaggggtgttgtaaccaagtaccacaaactgggggacttcaaacaagagaaatttattatctgacagttctggagactagaagtccccagacaaggtgtgcatgtcccccgtctggaaaaccacagaggaaagtcctttcctgcctctaatagcttttggtgtggccatcagctcttggcattccatggcttctagatacatggccccaacctttgcctctgccatcttcaacctgtgtctctgtcttgtcctttctttattttattttaatttcagacggagtcttgctctgtcgaccaggttggagtacagtggcacgatctcggctcactgcaaactctgcctcccgggttcaatcaattatcttgcctaagcctcctgagcagctgggactacaggcatgtgccaccatgcccagctaacttctgtatttttagtagagatggggtttcacagtgttggccaggctggtcttaaactcctgacctcaggagatccacccgcctcggcctcccaaagtgctgggattacaggcgtgagccaccgtgcccagccttgtccattcttataaggacaccagacatattggatgagggcatatcctcaggaccttatcctaacttgatgacatcttcaaagaccctatttctagataaggtcacatacacaggtcctgggggtcaagattcccatgtatcttttggggagacagaattcaacctgtaataatgaatgaacattccaaatgccctgggctatttcacttccaacttctgtttccagggatccctgacggactgggctcactgtcacttttctgcagagcgggtgtgtgctcttcaggagccaggtggtggggatgctggggaggagcctcttctatttctagatccctaaggatggaaggaacatggggaccatctggcccaccagcccatgttacaatggaggaaactgagccagggaagggaaggggctggctcatggtctcaaaggaagtatcacactttgcctggtcacgccacttctgccgggtcaccatttatatttggcctggattccagagaagccttaaatgaggctgaccagaagcctaagtttgaagcagtaaaccctgcagtgtctgtaggggcttgtgaagaaggagccaaaatgtatttactcaaattaataattactgtactctataaggcacttccatggctgattcagtgaggcgtccatcagccagtcctcgagcgctggggaaaagggctgtggggtgggaaaccaggaagctaggagagcagacaagcagacatcaggggggctctgggctgaccgtatgacagtggccctgtgccacctcagagcccacccaacttaagtgaagagcaggcttctgtggctggagggaaggccaagtctgggcactgcatggcatcttccaccgaagcttgtctcccagctcagccccatgccttaaggctttgagctcagctccgtgtcgcgaggcagcgtgtgacagaagtgagggcaggctctcagctgcaaataaaaataaaactgcatggactgcttttccagaaattttcataagccaggacacaggtcaggagtgctttacaacatccctatgaaagtgtgatgagagagagggaacacctgcatgttccccttgagcaaaggatactcatggctttggtgtgcagtggcttggaagggtacagcccaatgtagccccttggtgcctgtgggcttgcctgctggctgtggtgcttggtggtggtggtggcagctccagggcagctatggggggcagcaccaagggcaggatgtggtgtcaggttctaggggagcgcaggaaggctggccccccggcagctttgatgggcaggcactggaaacagtggctgtgctgagaggcttccgtggagcttctgggacaaggattcctgtggaaagggacaagatgggaaggactggcaaaagatagaactaatgcagctgtcacagactggcggagacgactgctggttttgtttgtgtgtgtgcgcgctcatgcataacaacacctcagtcaacgacggaccacatacacaactgtttccataagattacaatgcagctggaaaacttctatggtctagggacatcctagccattgtaacatcatagcacaaggcattactcaggtgtttgtgctgatgctgatgtaaacaaacctagtgctctgccagtcatatcagagtacagatcatacagttatgtacagtacataatacttcatagtgataataagtgactacgttactggtttatgtatttactatactatacttttaattattttagattatatatatatattttatatatatatatatatatgcaagttaactgtgaaagagcctcaggcatgtccttcaggtattctgaatgaaagtattgctatcataaaagatgacagctccatgagtattactgccctgaaacccttccagtgggacaagacgtggcagtggaagacagtgacatggatgatcctgaccctctgtagacctaggctaatgtgtgtatttgtgtcttagttgttaacaaaaacttttaaaaagtaaaaaaccaataataataaaatttttttaaattaaaaaagcttatagagtaaggatataaagaaagaatacttttgtacagctgaacaatgtttgagttttgagctaagtgttattacagaagagtcaaaaagttttgaaaaggttatatagtaaaaaagttacaataagctaaggttaatttattattacagaaagaaaattttaaaataaattaaaataaatgtatttaaataaatttttaaaaatttttaaatcaaaaatttaaataaatttatataaataaattttaaataagtgtgcagttttataaagtctacagtagtgtacagttatgtcctaggccctcacattcattcatcactcactcactgactcacccaaagcagctgccagtgccgtgagctccattcatgggaagtgccctctacaggtggaccaaccattttttttttatgctgtaagttttagggaacatgtgcacaacgtgcaggtttgttacatatgtatacatgtgccatgttggtgtgctgtacccattaactcgtcatttacattaggtatatctcctaatgctatccttccctcctccccccaccccacaacaggccccggtgtgtgatgttccccttcctgtgtccatgtgttctcattgttcaattcccacctatgagtgagaacacgcggttggttctttggttttctgtccttgcgatagtttgctgagaatgatggtttccagcttcatccatgtccctacaaaggacacgaactcatcattttttgtggctgcatagtatttcatggtgtatatgtaccatattttcttaatccagtctatcattgttggacttttgggctggttccaagtctttgctgttgtgaatagtgccacagtaaacatatgtgtgcatgtgtcttcatagcagcatgatttctaatcctttgggaatatacccagtaatgggatggctgggtcaaatggtatttctagttctagatccccgaggaattgccacactgacttccacaatggttgaactagtttacagtcccaccaacagtgtaaaagtgttcctatttctccacatcctctccagcacctgttgtttcctgactttttaatgatcgccattttaaatggtgtgagatggtatctcattgtggttttgatttgcatttctctgatggccagtggtgatgagtattttttcttgtgccttttggctgcataaatgtcttcttttgagaagtgcctgttcatatccttcacccacttgttgatgcggttgtttgtttttttcttgtaaatttgtttgagttctttgtagattctggatattagccctttgtcagatgagtagattgcaaaaattttctcccattctgtaggttgcctgttcactctgatggtggtttctttggctgtgcagaagctctttaatttaattagatcccatttgtcaattttggcttctgttgccatagcttttggtgttttagacgtgaagtccttgcccatgcctatgtcctgaatggtattgcctaggttttcttctagggcttttatggttttaggtctaacatttaagtctttaattaattcaagatggaccaatcattttttaaatctttattccatgtttttactgtaccttttctatatttagatacataaatacttgacattgggttacaattgtctacagtattcagtacagtaacctgctgtccaggtcagtagcctgggagcaataggctctacaatatagcctaggtgtacagtaggttgtaccatccaagtttgtgtaaatgcactctgtgatgctcagacagtgatgaaatcacctaaggacacatttctcagaacatatccctatccttaagcaatgctttcctgtaactatatgggtatagatttatgtaacaccagcttcacaatcaagatacagaacaatttcatcacaccctgacactccatagatctaggctaatgtaaacatatatatatatatatgttaacatatgtttgtgtgtatatatatgtttacatatatatgctatatactattatatatatagccattctaatagattccaatggcatctcattggggctttattttattttgaattttgtgaacttatttgccacctgtgtatattctctagggaggagtctgttcaaattacttgcccactttttttttattatggtgtattccttcttctgttgagttttgagagttgtttgtatattctggattcaagtcctttatacaatatgtggtttataagtattttctctcaggctgtagtttgtttttcattttcttaacagtcgttttcaaaaggaaaatctttttaattttgatgaagtctaatttaccaatttttttcttttatgaattatgcttttggtgtcacatccaataactctttttgcctaactcaaggtcaagaaggttttctcttatgttttctcttatattttttaaaaaaatgtcgtcttacatttagatctatgatccattttgtaataaggggtgaggtttttcttggtttgttttgttttgtttttgtgatggatgtgcaattgccccaaattgttatttgttgaaaagataatcccatttccattgaatttgtcaaaaatcactcagtcatatctgtgtctgtctgtttctgggttgacaattctgttccactaatctaagcatctaacacttcactgataccctgaggtcttgattactgtagtttataatatgtctttatattgggtagtgtgagccctccacatttattctgtttcttatgtttcaaaactgttatggctattttagttctgttttcatttcccattaaattttagaaccagtttatctatatctaccaaaaaaattatgctgtggttttgatcagaagtacattatatctatagaacaacttagagacaactgatctcttaattatattaagtcttccaatccaggaacagagtttgtctctccattttttttttagctattatttatttcattggtgttctatagttttctttatacaggtcatgcacatgttctcttacatatatagctaagtatttcattttgggaaaattttataaatggtatttgtttttaaaatcctagtttctagttgcttattgctagtatgtaaaaatatgatttttttatattgaccttatatactgcaaccttgccaaactcatttattcattctaggagttttttaaatgtagattctttgggatgttctatggtcatgttgtctacaaatagggcccagttttatttattcctttaaatctgtgtgccttttatttttttttcttgccttatttcattaggacttccagtatgctgcagaatagcaccagttagagtggaaaactttgcctactatataacatcactactgtgtttgatgttagctatggatttctttgtagacacccttaatcaagttaagaaaattttatttatagttcggtgaagatttttatcttgaatgtatgttgaattgtgttaagttctttttctgcatcaattgatatgcttgtgtgtcatttattctttcatttgttaatacagtatgatggcttgtgttggtcgattttcaactattgaaccagccttgcattcctgagataaacctcattttgttatggtatattattccttttatatattgctagattttatttgctaatgttttgctgagtatatttgtgtgttcataagggttattggcctatagttttctcttcttataatatttttgtaggttttgatttcagggtaattctagcattataatttgagttgtgaaatgttccctcttcttatactttctgaaagtgattatataaaataggtgtttcttcttctttaaatgtttggtaaattgtagcagtgaaactatctttgactaaagtttttctttatcagagattttgtaaactatcaattttatttctttaataaatgtagaactattgaggttattcactttttcctagctgagttagtaatttattgctttcaaataattggttccttttatttattagatttatatatataggatcatttgtagtattcttcttatccttttaatgcctatgggttttctgacttttggattttcagaagtcttgaatataaatgcccccctctcatttctctctgcccaggatggaatcaggcagtagcctttgatcttgataaagccatcttggaggacattgcttagatctggacaggaggtttgcccacataccctgaattgtgcttattcacctaatcatagcagtcctgaaaaatacagtcctccttatacaagccagcctctgcaggtcatgttgcttggaggagaaaatgtgctctctgtatatagcagatgtcaaggcagcagaagaaaagggaagtaaaaggagattccctgcatgcccagttccttctcactcactcataagatgaagagatgataagcttattatgctagcggaggtccctctgcatggaagcaggggtcagagaaaggagattcctctccaataaatgtttttggtgactgcacatgagctatactctgatgacttcagaaattactagggaagtattggagggaaggtggcctgatggtcctgcagtaacaggtgggaatgagagcccaataaatctaatttattaggccagtgtcctacataggttattatctaacacagattagaaaaatcacaatgaaatatattaaacactagattaaacatttgtgacaatgttgtgacaatatgaaggaagtggtgatgaagtgctggaggcaggggccaaaattagagtggggtcaggcaagacttcatggaagcttctgacttgtacagataatgaataggagacctatgtggctgaactcaggggtatgggcatgggaagaaactgagggagaagacgtgggagagacagtttggagggagttggaggattttaaatgtcatgtacatatttggatgtattctttgggggatgggaggacagtagggagttcatcaaaaactatactgggataggcatactaattttgaaaatattgaaatatttccataccaattaggaaaaagacactgttcaagcgcctctgagtcactgcccatcttcctcacacatttcagcactgtggttccccgacctggggtcccagcaagtaaaggttagtgcctgacccagcaagccctggtgttggcctgtggctggtgttcgttctgatgttctggctagttggtgcctggatatcctggttattaaatattttgtctctctccatggagctgaggtttagaaagtacccttaagcagcagggaggaagacatgggggataaagcaagaattcagggtggataagaccttgcacttcagctctctgtccccaagttcttcatctgaatgagggcaggcaccagacttcagatctcagagaactgtctttgtttggctttaaaaacaaaaccatagaattttctgtttacaatgaaagttccaggagggagaagtagttccttggatcttgcaccccctttaagtcaaacaaacatctgtcaaggaggaacaagacagaatttcttgtgatcagatgctcttggttctacagcaatttatcaaaggcccactcatcaattagagaaatatttgaaaaagcatcacagctcccacaagtgcctcatgtataattcaaagcaatggctccggatggagtgaggaggctacagaagccagggttggcttttgaaggcaaacctacctattgtttctttaattctaaaccagggaacacgctctgggaccctcaaaaattgcacttagccttgaatgtaggaggcgtcgaaatcttgagcctgaagtatagaaacttcctctgcttccctttgaactccttataggggtcatcatttctcagttcttcaaaattgggtctccctatgagttagaggcaaaaggaagtgacccctcatatctgggcaacattcactttcattggagtctccaatactgagtggttcgaaaaaggctaaaaataaagaaaacaaacaaacaagggatcaaatgacaccatgtaaaaaccacactccctcacttttcttacttcctttgccacacctcacaatgcaggtgacatcacccctattttgtacacaaggagactggggcagaaggtgggctgacttgctcagggtcacacaacaaattcacagtggataatattggcccttcacataccagacactgcctcttggggtctgaaacccaagttttaattttgatcctgtctttctatttgaacaacatggaagctgataatcacgaaattggtaatttttcaggttttttttcattgaaatttggtttcgaataataaggtcttattttaaaagatcaaatacctatgctaagaacagtggccatgttgcttgtattatttaaaccaccccacacctgaattttatttgaatagtaggttcgttgatttcccttctgtgttgcactaatggcatgctgagctcagctgagctcatatgatttagaaccccagtgccacccagttcagggcactttaacaaaggtgtgcacagggacagctgcagggaagacctctgtacagtggagaaaatgtttcccttggactcaacccagaagttactcttcctcttcaaagtgggtccccaactgcccttgaaatatggcaggacacagaggtggctctgagaggaacagagaggatccctgcagggctgtcttggcagtgggtcactgaggacagaccctctgcaaggcacgtgcaggggcaggctcacagtccttcttggctccacactctcagcagaacacaagaaatgcggaaggtgaagactgaactcttcactctgaattctgagcaatgataggaacagacaatgagtgccttctcccattagtaaagaagaccactgaagaagatgagatggcccagcccagaccaggaagggtaagagaggccaggggcccagaggggaggctccaagagcctgtacaatgtgagtggagacagccaactgggaccaagcagatccaggcaagcccccaggcagaaaggtccctgcagggaggggtctgacctgccctcaccactccatgccagggccccagcatggcatctggaacatgacaggtgctcagccagcaggaaggaggagcctggcatcgcctccctgcagaactgaccctcatgtcccggtgtggggtgaggccccttttctgagctcccttaatgcctaggagccctcatgtggttgggtaatgatctgaattctagttggcttccttcctggacctcgttttgcatcctcagtatcttccctaggatacagcatctaagaagccccataggaaggagggaaagagggaaggtggaagggagtgagggatgaagtaaggaaagaaggaaggaaggaaggaaggaaggaaggaaggagggagggagggagggaggaaggaaggaaggaaggaaggaaggaaagggaggaaggaaggaaggaaagggagggaggaggagacaggaaaaggagggaaggaagcaggaaaggagggatgaaaggaaggaatgagggagggatgaaggagggggaaggaagatgggaggaaggaaggagggagagaaggaagaaaggaaatagggagggaggaaatgatggagagagaagggaagggaaaggaaaggaaggggaggggaagggaagggaggggagggggaatagggaagggggaagaggaaagggggaaggaggaagggggaagggggaaggggaagagtttctttagccacactgggctaagggtttcaccaataactgaaggatgagaagaaactggaagggaatagcaggtcccactgcgcatcctttattcactgcggaatgtgatgatgctgttgtaaattgtgtagggaacaagacacagtcctcctcctgcagtggagctcagtttgctgctgttctatgagcatgtgagcctcatgcctctagggcctatcttggtcgtgttgttgttactagcccctggagtataacaacttaataaatattggttgacttaataaatgagtgggggagtgaataaatgatggatcctttttctgttctctgccaagtcctggctcctcgagcccctccgtgtgtggttacacatggttacctggcctggctgcactcctgatggcaggaccccacagcctgcagctcacaagagagggtcagaccagcagcccatccagcatgctggctcctccttggaaatgcccagcctcacagtgaaaaccaccacgtggggccttccagtggaggaagacgctctgcctgaatctgaagcttgctttattttcctaatcatgttctgcccttagtatagaggtaaatgagagaatgctccttccctattttcccctctgtaagatgagatggctaccccagaagatccccaagttttccagcattttaggcaaaaacgaaggcagggtgtaagtggcaatggcactctggtgccttcccacaaccactccacagagagtgcccagtgttctggggagcgtgtgtgggatgggcttgggaggagatgtgagtgagcacgagttagcattcatgtttgggcctgggaaaatgtgtcagagacacagaggggccctgctgtcactcttgccacctcctccccagactgtgaagacagctgacttccagactggaaagacaacctgcttcctgactgcaagctgggtggcggggctccctgcctccaggctgagagttggagaatggttgaacacagcaatgcaatgctggcttgtaattttattttctgaagacatttcagggaatgaggatagaaaccatcaaaaaacctaatgaaagctgtagatcctctgtccagagaaatgcacagacacctgatatttgcatctgacataagggaaatgaagacctagaagtccatttctgagctctgggacccaaatagagcctcctactgtaaagccttctaaagcagaaaggtctaggagacaagatccctgcattctacctctaatctgggccctgctccatccagcactgctttcctcattctggctggcctcaaccttaccatctgtaaaatggacagccaaggagaggatgagggctagagttcattgattataatcacaaaccctgagagcacctgctgtgtgctgggggtccgaatgctaagctgggaagcaggcacttgggacctgggaggggagtgcaggatttgaggggaacgtgctcttctccacagaccgggttcttgggaccttcagaatacatttctttttctctggcattagaacatgacctgttctgatggaggacccattagttggactgagactgcaatggctttcttatttgaagatgagaagaatttagactctctacttctcttccgcagctctgtctaaaacaggggcataacagcagttgggtttcctttggcaatggagactccactactggcttccttccaagtcatcttaaaaagggccttacagagagctgggaatggggtcacagccaccttttcaagagtaggaaccaagaacctgtgacttgcctcaagtccgcctgaccaggactggcaccagcctttccgagcctggtctgagtgttgggtgaactcacagcaccatatgagtgagaacaaagagatttctccctctctcccagagcctcttcattcctggtctccatcctccttcacagctttgctcttcctccccctaataattcccaggccaagggggaaggggcttttttgctcagtagtctggactgagaaggaaccagcctctcctatggtgatcatcagacagaagtgctctgcttgggaaagctcactccttgcagctgcaagctctgtctagttgatgttccatcctgtctgtggtcagcactccctgggccttccttctcccaccatcaccatagtcccctatccattccctttgagcccccatccccatttcttcatgggcaggaggcatagtggagcttctgttgaggtttgcttttggacttagatcgtatcacattcttcagatggaagccattaatcccactccaaattatgatcaactcacaaaaataatcaccaaaaacctatggagcaaaggctctgttggccaacttcttcaagaccttgctccatcattcaaagaccattgccctgtcctgtggcctgcagtttccttctgtggcctcatacaaccttccttctacctctgtgccttcctcggggctgtttcctcaccttctccaccactcaaaacccctctcacccttcaagacagctccacaccccctcctctaggaagcctttccagactacccaaacctgagtgggagaaactgtttaaccccaggctagctgcatgtctttaagaggaggccaaatggtgccaagccccatgccagctgcttcaacaggacaatgcctcagttagtccccatgacaacccgttgagataaatgttaataatcccgtttaacagatagggaactgaatctgccaggttgggggtggggtggaaatgggaaaaatgcctgaccccaagcttgtgttttgttccactgctctgcccagcctcctgtccctgcactgagcatttctttcattctgacttatttaccctgggttgtttgtgtgggttctcctatggatctggggtcccctcctgagaacagaggctgctgtattcctctgtgcctccttcccggtactgtgcacagagggactactcagccaatgtttgaaggattgaattaaatcttgccacgtagtggttggcattttccccacacctagagctgcagtaatgaaatttccaccatatgccttaaaggattaaaatgttgaaaatgtcacaacctggaggaaaccagagctcttgaaatttaccaataaaacaatagctgctgtgtatggagcatctgccgtgtgatcagctgtgcactttgtctctgattcttgacaatcaccccgggaatggttggatattcagttgactccagaatagctgcatcagggtttatggctggcattggttctgattggtcaggtcccctacaaaccacttgttatgtattaatattttcatacagcacctgcttataagtcacatgctgctatggacacaccattttatggatgaaaaaaccaaagctcagaggagagaagaaaattcccaaagccacacagctagacattgcagcccaagcagcctatggcacacacaatgtaaacagcacaccattccacctcaaacctggcttccagccctccctgtcccaggctagattgggccttctcccaccctccatgagattacagtcagtgatcactacagggtgggtgggggctggctcactcacaaaccacacctccaggcagtgcagtccatttgctcacaagagaaacactcctgtgggacaccagctttgccatccgagcaaagagctgcattagcactggtgtgcaacagagctcggggctacctggaccctagagcttggtgggcttggtggtcccactgtttacatggagatggagtgaaggcaaaacaggttacttggagaaatggattgcaagagctgatctttagtggttcatattttgctaactccacagggagtaagccatgaatttggggacacgcagtctggtgcccatcactgtgtgaaactgaccagggcccttgcccttgctgtctgagccttacttccccacctgtagagctatctgggctggctagaccctgaggtcccttccagttctcctactctgtgaaggttgaggctgagctctggggtccaatggcctgtgctcaaatgccagcactgaggtgggggaagtgtccgctcagcttccctgggctttggcttctgcatttgtcaaataagggcaataaaagcaatagctacctcaaccaaacattacacttaaagtggtaaagtgcttagaatagccctgtcacgtggcacaggctcacgagccctgcatagtattaccttaagctgatatggtcactctggctccgaatcttgcccagcaagtaccattttcatgatgcaagtgggaaatgaagatccagagagtttaagtaacttgctcaaggtcacacagctaaaacagggcccggaccagtcctctgtctcccccatgtccctgagctacacttctctcctcctgcaccctcacccaccccaggaaggagaagagtggtttgggcagcaggtgagagcaggtcttctccaaggtgggagaagaaacagcctgtgtgtttctccatccctgtatctaactgtctaccacagccagccggcaggagtgggagctatctggagcctatgttcagcagcctggggcttcaggcctagtttctttgcttaccagctgtgtgactttgagcagggcaggcaacctctctgggcctccgtgtcctgatcagtaacataagggaaagcagccctgcccagtctacttacagagctgttaccagcattaaccacaatgtcagatttaaaagttcttcccaggctgggcgcggtgacttacacctataatctcagcactttgggaggctgaggcaggcagattgactgaggtcaggagttcgagaccaacctgggcaacatggtgaaaccctatctctactgaaatacaaaaattagatgggtgtggcggtgtacacctgtagtcccagttactcaggaggctgaggcaggagaattgcttgaacccgggaggcggaggttgcagtgagccgagatcgcaccactgcactccagcctgggtgacagagcgagactccatctcagaaaaaaaaaaaaaatgcttccttttgtgtgggtggcaagggcctacacaaggaaggccctactgaaggctctgtgtccatcagggaccctgtgcgggctggccagaggcagtgggctggctggaaggagttgtgcccattggtggaggggcacgccaggccatagtgaccccaaagggaggaagtcaaagggttccctactctgactcatcttctttcccttcctggggtctcctaccccagctgcccactggctggactcaattggaaggcagagaacacatggcccacccaggcatgccaaagggtacaagcaagagaatacagagaacagatcggtgggacaagcaggagacatccagggccctgtacaggggcctctctgggaccgtgcccctccctccccagtcctgcttctgcacccccaggagctgactagacaataatgggacacacactggagatagcaccatcttcaacctgtcaggaggtttattgtaaaaggagatttagtctcttttttgcaagtaaaacaatgaaacctccataattgttccaggagaaataaacatgccaaaatatttaagtactaataaaacttaagaattatctcagcatatttaaatatagatgtatttttatggcaggcaatgaaggcaattgccagcagaaagcctttcatctaggccatttagtactcaccctcctccttcaaggcttgggtggggaggggacgagaaaggggctggggtggagcctgcacagtgacgggaagaggctccccttgcaggcaagtgggtcacatgcagtcactgagcagggacaccagatgctgggctggaccctctttatgctgcttgtgactccctccatccctgccgcagcccttggtggttctagtatcatctctatttgacagcagaagaatccaagacacataaaggtgaaataacttgccccaggcctcacagctggtaactgctagagctggaatgacatagcctgactgcagaacttacactcgctcattactgcctggccctgcacgaggaacaagggatacaggtgtacagtgagctgaggtcagggccctctcagcccttgccaggactattcaaaaacctctgaacgagtgtcacagactctgttcctacatgcctgtccaacactccccacatccattctcagggctgccacgaaggcttctctctcactctgtgtgtgtgcacacgtatattatctgtgtgtgtgcacaggggactttgccatcttctgctgaattgtgcttcctttcttgagactgcagttcaagccattaacagataccaggagcggcatgcaaagatgaagaaaatacagtccctgcatttgaggcaacttcaggaagaaactttcagagttttttccttaaaactctacacccacttaaaactcacttctcatttcagcccctggcaaccaccattctactttctatttctttttctttgttctttttttgagacggagcttcactcttgttgcccaggctggagtgcaatggtactatcttggctcactgcaacccccacctcctgggttcaagcgattctcctgccttagcctcccaagtagctggtattacaggggtgtgccaccacgcctggctaattttgtatttttagtagagacagggttttaccttgtagatcaggctggtctggaactcctgacctcaagtgatccacctgcctcagcctcccaaagtgctgggattacaggtgtgagccaccacgcccagcatctactttctatttctaaatttgatagtctaagtccctcatgtaagtggacatgtacaatatttgtctttttggacttatgctacttagcacaacatcctcaaggttcatctgttttatagcacatgttggaatttccatcccttttaaggttgaatagtgtttcattgggtgtgtatagaccacattttgtttattgattcatctgtaaggggacacttgggttgcttccaccttttggctgttgtgactaatgctgctataaacatggggggtacaaatagatgttcaagtccctgctttcctctcttttggctgtatacccagaaggggcattgctgggtcataggggactctatgcttttgtttttgagggatcactatacagtttttaacagcagctgcactattttacattcccaccagcagtccacaagggtcccagtttctccacatcctcaccaacacttgttattttctgcttgtttcttgttgtttttagtcgccattcaatgggtgtgaaggggtatctcactgtggtttcaatttgcacttccctaatgattcgtgatgttgagtatgtttgtatgttcttattggccattgctatatcttctttggagaaatgcctattcaagtcctttgcccattttttagtggacttggttttattattgctgtggtttagttgttacccatgtcctatttcaacatcagatgaaccactcaaccatcttcccactggtaacagaaatgtgtgaatgagcatgtgtagcaatgggtagaaaacaagcatttatgaaacacttatttaatcctcacaataatttcatgaagagctatgatgcttatacatgggaaagctgaggttcaaagagattaagcagcttgcctaaggtcacgcagctggtacgcaggagaaaggtgtttggatcttagccctcaccatagcctatctctaagatgatgccactctgtctcccaggctgcctctctgaagaagcccaggctcctaaaacagagcaggaggacagccacagcaatgtcgaatccattattgtaatctgcaccaaagagacatccctaggtgaatgatgtcaccagaaggttcggaccaaggcccaccattaatctcatggttacaaacaatataggaagattatgctggcctccagcccagttaagtggacatttggattttttccaaagcaaatgtggatactgtaaatacaggtcagctggtttgcaggaaatcagcatctagacgaagacgtgtctagcaagaatttccaaaagtcctactgcaaagagcctgggtcacagggtggccgcttggagtacgtctgtcacttataaactgctgtttttcatgcattcacttgtaacatacttgctgagggactcctgggtgcctggctgtttgctgggcttgggttcaggtgtgaatcctggaggtagagaggggcagggaattatgatcctggcaaccttctcttctccagaacagtccaccttcaaacagaaaattgacatgcagagaggtgggatccttacctgcagtcacacagcaagtggaaaagctgggaagacatcccaagtcgctattaagtcacttgactgccctacatcccaatattgttgttgtttaaactactgaattttctaaattgcttccctttctcggaaagggtacagcaatcctttgccacaatgtatgtcctaattttggtttctagacataaagtaaatgtagatatgactctatttatttccctggggagcacatagttagaggttaacccttcttcccagggaaaattagagaacaacacaagaaggtaataaatgtgagtgctcatggcatggtttgattaagtatctcatgagtgggacagacaatgagtccttttaatcgacttctgctcagggtctaggagaaggattgtcctctttcattaacgcaaacccacaagggctgcaacttcactccaggcactttacagggactggatcaagtggtcctggaagggggccccaagtttccccttctccttgggggtgggtgttgccataccaggctggttctaggggtgctgctctcctgatagaattggccagggatagatttcatatttccttgttgatacccttagcagagttgagataggattcacttgcttaaacaccaagggaataggggagtaaacatagaaagatctagaagtagtgtttcaggccaggggctttgcccaccattgctggctcacccctagatctctgcccaaacttcatgccagaagagttggttgctgacccagggctcccagactaggatttgggaatcctggctttggggctttggggcttctcctggactaggatttgggaaccctggctttggggcttcttcttggtaagagatgtcatttggccactctatgcagatgataaattcctcgtttctttagcatagaaactaaatcttaatcaagtatacagcaagtataaatgcttgggaaatcttagggaaggaaagaaggaaggaagtaagcaaggaaggaaggaagggatggagaaagggaggggggaagagaggaaagtgtatcagtgcattctcacttttctataaagaaatgcctgagactgggtactttataaggaaaagaggtttaattggctcatgactccacaggccgtacagaaagcatgatgctggcatatgctcagcttcttgaggaaaagcctcaggaaacttacaatcacggtagaaggcaaagaaaaagcaggcacctcttacatggtggtagcaggagcaagctagagagagagaacagggatgtgtcccacacttttaaacaaccagatctcaatatcaagagaatagcaccaaggggatggtactaaaccagtcatgagaaatccttctccatgatccaatcatctcccatcaggccccatgcacaacactggagattatgattcgacatgagatttgggtggggacacagatccaaaccatatccgaagtaaagggggaacaaaataaagaaaaaaagaaggaaaggaaataagaaaggtaggtagtgagagagagaggaaggaagggataaacacagaggaaaagaaaaaagaaggaaagaaagaaggaaggaagcaaaaaagaaagggaggaagaaataaggaaggacaaatagaaaactttctttttaacaaaagccatgagattcatctggtttttctgcatttgttgggagtggcagatatttttgtcagtaaagcctggtatatataactggtagtcacttaatgtttgctgagagaatggatgactgttatggagatttctgatttgtttacttaaggggagttctccttatggaatcataatggccacgattagtaagatcaagaggaatatgcagactaaggctttgattttaaatcacaaggaaatacacaagcacatgataaaattttcatattagcaggccagtttgaactcaacgtagccaagctattctcaatgccacctgtgtttagtgtgacttcgaggtcacagccagtccaagatcatttctctgagtcaagctcttatatcaccagtgaaagggctcttgtctgaacgcagctcatgactcacctcttaactttcaaactgagagcatgaaaattctcaaatgagctagaggaggttatctagggatagtcagagagagggaagaaaaggagtgcctatctagttgctgatggaaacagactgattaatccagatacaaaaaagacatttccttaaacatttctgaattcagaattgtttgctatcaattaaaatgttgagatgatctctttttttctaagtggtggcttcaccctctcctgaaccatttcccttccagaaaatcaagaccttctaccacattcactccgcctcccagttcatgattcagaaaatgaagtttgaaaaagcacctaaaaatggaagaggagtgaggagctctgcagggtgaggcccaacatctcgccacattaaccctgcgaactcagccccagtaaacgaggctgggagccattaatgcctaatgatgttgcattgtcttccaataacaaaccatctcaccagttggttttatagaggaccagctgttgttaattggggaagatgagcatgaaatggcagctttcacacctgaccaagagagagctgcagcatcagggggcaggctgagcctctcctgcatgcaggggggctgcttagatctgccttggtgaaggggagatgcagacagtaccctggggttcccgctcctctcacatccttagggggcagaaagaataggagagctcaagttcctttagcatctcaccatctccttcccaagcccagtgacatcccacataccatgctgtggcatctttgtgtacctgtgggagtccctctagcaaagtgaggggcaactcaaagctaggggcccaacattgcaccccgagagcctggcccagaatctgacatagtccagactctgcagaggaggcatggccaggttctttaccactgaccctagtctctgctccctggacacaggtgactggcccaggaatagacagcagtttataggctaccaacaaccagtgacatgagggcctggctctcacataggagctgggtcgatcacattttctcccttggcatttcatcaaagagacacaaaaagagatggtcacctagcagtaggctcaaatcaaagggagtagggaccacatctgtgatatagagaggttagggcagccatggaaggagtcaggattaagccagctggtccatagggacaggaaactggtgtgcacacttgagaagggacagaggtgtcagagggagacttcaagaaagttcccgatcaggatatgatttaaagcatgttggatctgggagccacagactgcctcagtggggtcacatccttggtcttccaggagcgctcactttgccgtatgataaatccaccaaaggagtcagcccctgttctttgtattccagagctccgtgtctagaaaaattgctccaaagagccatccctcaagattggcaaagagacataggcactgtctggtgaaaggcaggtcctgaggttttgccatgaaagccgaaggagctgggaactctcacgtgtggaatagcaatggtgtgcacgtaaacttggagtcacgggtggtcttcctaacacacctggaagcatgttagttacattatccccatttctcagatgggaaactgaggctctgtaatgtcgagcatcctgctcatcttcagtgaatggcagacttgaagcaagtccgtgtgactcccctccagttctcttttgatagcactgcactgttgctgctggcatttgagaaccactgcaggctctctgctggcgcgcagagccagggagctcagtcaagcggccttgactcctgcagactgagaaaaggacaggcctcgctcctcacctgtttgcctttattctcagcattgctgcgaaagacgggaatgcggaacattaaaacatgtactgtaaataaaccaaattaaagtaaaattgactcatttagcaaccagcctccgatcttgcattagaagcaattgaagagatttcacagattttagtaaccagataagattattatataaacagacttctgcattgaatgatgagccatatcttgaggagaatatttgaaatcaatagcaatacaggctgagaattaagtaatgtggttaagcacttttgaatgatgccatttttaagagctgattagaaataaatatgccaattgcagcagagctgatagctggaatcaagtgatgattaatcaatttgggcctgagagccagggaggccatcttggggagaatgttgccagccctgcactccagcttgctggaaaggggttgagaatgctctggggcctgatgcagcaggctcggggctgtacagaggccaatggtggccccgagaaggtctgagaaagatgttagagtcctcgtgcagaagcctagctctgcccacctggtgctggccaccacggtgtttgggaaggtgcctgagagccggcacaggattagctgtaagctgcttaagctgctcacgcagggtgagcctgcagcagagaggaagttatggttggggacactggtgaccctgggattgcgtttcgaatgcccaattaccactcgactggaaaatgattggtcttttggcggccctgtaatcatctctcacctggacaattgcaccagcttcctgatgggtccccacatgaaccgtgagcctggcggatgcattccacacatagtcaccatggtgatctttctaaagcattgctcagatcttgtcactcaccttgtagaaacccagtgctgcctcccctgcaccttaggtcaattccagataccttagcttagggttcaaggccccctcatggcccagtcatctctagttgcctcattttttcctttctcccattcctgccctatgatcgcgtcaaacagaaggttttatcagtgcccaggaatcccctgttctttgagtgttgtctctgctcctgctgggccctgcctacttccctgtctacagaagccccagcccctctcccacctaattcaaaggccacctccttgggaaagcccactttgactgttcctttccccaacccaaacataagcacaactagctggtctctctttgttacaatccttttcctgtttcatatcactatcattcattatgtctttttattctataagtactgattggcacttttgcagtgctactcactctggcctaaccctagagatacagggagagaacacagacatggcccctcccctcctggagctcagtatttcactcaggcatttaatgctttgtgcaactgtctcaactctggggggcaagacattcttatttaattctcctggcacaagtgaatgaatgaatgaatgaatgaatgaatgtgagataacacaaatgaataagaggcaaaggtggatcagtggatggaggctgcaataaagcaaatttttgcttggtggaagaagctggggttttgcccagcactgcataaactgccttccatggggtcgagctctcaggaacttgaggcatccatgcggaggaaaaccatctgtcaaagagaggcccgaaaagacagaattggctggggattgaagttgcagggctgggggctctagcctcagccctatcactgactcactatgtgaattcaggtagaccttagcaagagcatatcctctctttgagcctcagcttccctgtctgtaaaatgaagacattggactataagtggtagaagaaaatgggatacttcttcttgaatgttggtgaccttcaaacaacctcttcaacagcgcaccataaataaggttctatatgtcatgttagacacagagaaaaattttaacaggtatgagatgatggaagaaaagttaagtgcaagattttataacaggagtctgataaatgccagagacacttgtgtgaactagtgtagcctggggaggtttcttggaggaggtacagcatgatcgatctaaagggtaaataggacataattatttgaaaaaaggagacatgcatttcaggttgaagggagaggaagacaacatcttaaccaacaagacaatgtccccagtgcccctgtgacacatccacatgccatgccctcattgctaacctgggacattgctgaggaggggaccctgttagaaggctgagcttcttgcgccaaaggagcagatgtgggctcttctttgcaatgggtttgttgtttcctgctttcagcaggcctgcgtcctccagccccattaggatgtgggctggctccacctctgtaggctggatgtgggatgggaggctgacctggccctcatggaggaccctggctccaatcctcatggctctgcaggctgtgagctcctctgctgaggagatgggggtgttgaattccctaatggttccctagaaagggactgttgcatacaggtgagccaagaacaggcagaggacccctttccccaagtgatcagccaggcttgaggtctctcagtggaagcctggagctggggctgctgggaatggccgtcttttcttgagttgctcacctgtgagggccgtctgtctgccagactgctcctcatacttctgtctgaccactcatctctggcattcccagctctgtgaactcagggctctgttggaacactgggtgatgggacccacgcaggggccttccctgttggctgccaaactcacactgaggtcagagaaggaggctctgtgtggccatgcgagtctccccacttccctctcttaactcgctttcccactctgacttccttcctttccagaactacagtctgaggcagcaagaaggacccctaaaggtcactaagagtacatagagatggagaaactgaggctgagagaagcgaggagactctcccaagactccaggatgcatcagccaaggagcagagaccagtgccctgatgtccgacctgttttctgtccactacggcatggggtcctggcctcactatctgtccatgggctctttctctccattagaggtgaagccctggggacaggatctgcactttctacagaacccacagaagccatgcagaagccaggcctttctcccccgcttccccttcctctgcctccgcctctgctctccctggctctgagtgccgcggaccctcctgcccctcctgccttctgcttgctggcctggcctggctctgccaggccctctttcagcacctgcacccctgcagctttcaactgttggccaagtgttgtgctgtcaccaagttcgaaacgtggctacactattttctctggttctttctctttgggctgagccaaaaataaaaagcagtcacacccaaggttcaagttaaacgcatgtacttacttcccagtttccttctccttgacatacatggtatgaggaagagggccagagtgcaccccaatctcacccaccctgcaggagaccacacaagccaactgagggggcctgccacccaggtagaattgcaggacagcttcttctggcccagggagagccacctgctctgtcatcgggcccaggagcaggagtagtacagctgactgacttcccacatgtccaggataggagacatgcactcccttttcttatgagctaaccagactcagtgtagctgcagtttctgttggtgccaccagatatactcggctactttttctccacttcttcccaagaaatcacacttactcaagttttagccaagagagccattatcataacacaaatattttagaatgataagcctagaaagttctactaaaagttttgacgatgggtgcccatctgaaaggattgtcattatgtgacacattgagtctggaatccctggcccaataaggtgagacctgggccgttccccagctgaccactatccaaagtccaacttccacagcttggcgtggctccgatggacagtagcgtgaagagggtggattgaaaatttcgtgcggagcaactgactggaaaacgtacttagtgtctcttttttcgtggtgatggctacagatgtgccggaaagtgctggaaacattcttccctttctctgccttcaccaaggaggaaacggtgcagtgtttcttaaaactgaagaacttctccccaggggatttaatttttttttttttttatgtttctgagaaagatagtataattttctagcccctaaagaaggctttttagtttacaggaggaggactatcaggaaggtgagtgcaggtgatgtgggggaacatgcaggtggagactttgaggcagaagagaggaggagcagggaccctaggctgagctgggcaaatgccaccagcactagaggctggggtggggtgaacggctccccggtatctgaggctgtcgacaagccttgcattctaaagacgttagcaacagggcatgccccaccagcaaggagcatcttccctgtatctgaggctgtcgacacaccttgcaccccaaagaggttagcgatggggaaatgccagcggcaaagatgtctctccagtatctgaggctgttggcacatcttgcaccccaaacacattagcagagtgggctacatgcacatgggccttgtgagagggggtgtttgtttaaaggccaaggaaagaccagtgtttggaaactagaagtacacagatggaaaaagagtagtagccgtaggctgggtggatggatggtgggggaactgaaccactttcacagaagccaaagaccaagcccacagggaccctgtgagccttcccaggcttctagttgccccagtgatgctagcacaaagccagctgggctatactgggagtgcccgacattctattccagtatttcagttgggactctttctcttttattttaaaaaaattacctatttttaaaaaaatcaacaattactgaattcactcagttttaggccacatgtttaacacccagagtagggaaatgaatcagacacaggcccgtgggccctagtggggtttgagctctatcaggggcggtagttcagaaagaaaagctggcagcagactgtgacacagatggcaggagtgagggaggacgtggggagcacaaacaggggcggcccattcttggtggggtggagtcaggcatgggtttgggaaaaggtgtctcccagaccaagggcctctctgactagaggctggggtggggtgagcggcttcaacacaccccgcattctcagcatttggctttttaaagagactttctcatctatttccccaagtgattctcacaataactgtggtttctgatcttattcgccaacactctcatcctccccagctgtataaacatttgggcgaagtgactgggtataagcaattattctggaagcccagtgcatggcccgcagaggggcaagtgtgtgcatttgaatgatgtgtgccccctcatgtgagagttgggccccgagcaagcagctcagggaagcacccaggctcctggaggacccattgctcagtaacagtatcagcctcacaaacaaacaacatcaccctaagtgatccctccagatgtgctcaaagcaatctcccagtaaataactgtgtccagcccaacagggtggggacggatttagcaggaaaaggctgctcagaagagagaggtttcctccctttgagaagtttctctcatctcctgctagctaaccctttggcatgagatggaaggtgggccggctaggcctggaacagtaggctaggggatactgaggatggtgcagggctctgtgagcctgggtcccgctcaggaatccaggtgtggggctggggctatcaggaacctcttgttactaatcagtgcggataaagacttcaagaaaagggaaaccaacattctttgagcattttcattaggctctttggcacctgtgcactgagtgtgacgtgggtgttatgattcctcacttacctgagagaaaactgaggctcagagaagactgaggcttacagcaccacacagctgtgaggaatcagagttgataattgaacctggatgtgtttgagccctaggccagccccttctgcacttgatcatacttcctgtcatgagtgggttctgtccaaggacttggatggtgcaagggaggtcccatctgagggtgcaaacattaaatcaacattcactctgggggtcatgcaagtgcaggacctgcgtctcagggagggggccttcttccatgaagtccctgggcctcttcttgcctcagcttgggaggcagctctgggcctccctctgcccaggcttcacctccatgggttctccttctatcctttggctgttgcagcctcttttccagagaccatgaaaagggattgtgaaagcgaccatgacactgagaacacaagatgattcatctgtatctttttctacatcagatgaagtccagttgacatccctgcccacctggactcatgagaagttagtgtctgtccccttggagctccccctgcaattctctgattcatctgattcatgggagacccccatgcttatgcaatgaaataaattaaatgcggtcccatttcctcctctttattaatttattattgcatctgctaggactctttcccatgcctgcacagttctttcagaaaaggccaaatctgctggtacccgccacctcacttccactcgtatgtctcctgactccctggatgaagcgaatattgaagggcctctcttcagctccatttatatgtttctataccaaactgagcttgtttgagaagaagtgatggagctgtggtcttcacgcaggtgtccatgactccctcctcaagtcactaaagacttcagctccctgatggtggccagggataacaacttccacctgctgagtgcacaccatgtctgggcctggcgcagacactgttccagcctgaagaggctgcacaaaagctcaggcatggccagacagtgcttggttggagggccttctccttcctggaaaccaccctgtgtgtaatgtttgcgtgacatttcttggttcttcatagcttcacaggacagggtgtagcatcctggtgaatgaaaaaagcaagttgcagaatgatacataaaataaaatgcaatcgtgttaagcacacttgcaataggtctgtatttttttttctggatacatatttatatatgtaaatactaggaaaatgtctagaaggacacaccccaatcaatacttctagttgtctcccaggtgaccattggatgggaggagcagtggtcaaataatactttagtcttatctataatattttgtaaggagcagttatcttgattttatttatgcaattaaaattaattttacaatgaaaggaaatggcaaaaaatggcatacatgctgtgacaatcttagtgactgcaagtctgagagtaaagcctctttctaccattttgtgagctagctttgttacaaagaaagtgctgggggaattaaatgctagttgtgataggtaatttctctggaagcctaaggtcccacagcacggaggctagaggaattttttttaaacatatatttgttttatactggcaaaagtgacatatattcacagtagatgattttcaagctattgaaaagtttttttttttttttttgagactaagtcttgctctgtcacccaggctggagttgcaatggtgtgatctctgctcaccgcaacctctgcctcctaggttcaagcgattcgcctgcctcagcctctcaagtagctgggattacaggtgcgcaccaccatgcccggataattttttctatttttagtagagacggggtttcaccacgttggccaggctggcctggaactcctgaccgcatgatctgcctgcctcggcctcccaaagagctgggattacaggcgtgagccaccgcgcctggctgaaaagttttaaatggaaaatggaaacctcttgtaatccacccatagagtcgtaatcatggttaacatttcagcacaggggctaccgtggatttggacacacctggagtcacaccccacctctgccattcacctgtaccatataaaacttagtcctggagctgtgaatagggaagataatactcagtcatagggcgagaactaattaactgagggtgctctgcagtgagcgccaggagtgttcagtaaatacaagtactcactgtgcactggttggcagcgtcacgccttcatgtatgtttttccaccaaattgggatcatgcaatatacgttgtatttatcccttttatctgatattttaacatgcacacttttaatgtgggcactcttgagtccttggggacacaagttgagctgtgccaggccaacttgcagagctggtggtgagagctgtgtcctgcacctgctctgaagccattcatggctccctgctgctgccagagtaaatctaatttacttggagtctgtctgggttcttcagactctggccctatgctggctgccctgccttttccccatctgcttagcctgctccctttgcatccagattcccctgagtgagtcatcctgacacctcccagcctccagccccatgcccggaactctacctttctccttgtgtccattcaaacccagtctctccactggggctcttgtcttcactgttcaggtacaataatcccctctatttctcagttccacattttccagagcactggtgtgacccaaacactttcgacctcaatcagtcaatttcattcactgtttggtattcatttttctctcctcagctacattgcatgtccctaaagactggggtgttgcaatttgccacttttctttttttaattctaaaagttacctaggactgtgctgaacacataggaaacacccagatacatgttggctggtgtttttgcaccagataatgagtgactgggtgttttttgtttgttgcttttcctagcctcaggaatgtctcctggctgggtcagctgtcagctaagaaacacagaccttgtctcgtggcatggatatctgcagttgttatctttccagcagccatgcccttgttttttcataacccttttcccattctctgtccacgtgtttagcaatgaaatgggtcaaccctggcttagggattgagtctcattcctggtcacagtgattggtttaggatggacagaggacctacacaatccaacaaaataccaccctggaacttttactacacaaaaagggagaaatataaaggtctctccctcctggtctttgttttagaagataaggagttctggacctgccagcagccaccatatggaggaattttacctgagagcagagccactacttgggaaaacagtcaagatatgaagggagtgttggatgtgttactattaagtggtggtgtctgaaccctggatccagccaaacctgcagccaaatcctatccttgttatttttagctatatgaaccaaaatgtttttggttttattaaatcagtttggcttagcttttctgtcactcataactcaaagactctaggcttgcctcagcccctaattctaagacttctactatctgaacttcttttccacagaaactgaacattttggagcagccataacagaccccagagcccatgtccatcctcctggctcttacctcccaagaccacacaaggagctgcagatctggagctgggactgagtgtctccaggacagggctgtgctgctctcctgagcctttgagaggactgtgggtgctcacacaacccatcacagctgtaggtctcagggaaacagagtggtaatcatattacaagggcttccatgggaagctgcaagggacttgaagtgagcaatgcacacagcctgcttcccaggtaccttctgagaagtccaaggaaaccacatttttcttgctttcgtgattactgtaagatagcagagaatctgctcctgggtgtcaggtgtgctgaaactgggcagaaagctctcagtgccaggaacagccaagggtatctgcctcagctacacagggatagctgttaaacaggcaacccacaagcatgacagtcacatacactgcacgcacctgtcccggtggacagcagttacctcagggggccaaatcacagggcccccactccctaacccctggggccatcaaccacgccactcgttcttgccaagcttggacacagacttggtctctttctcaaggcagctctggatgaccacaaccaatgtttgagagtttgaaagtgaggttaaacatttttatcagctataggaaaggaattctgatgtgaaacactgtaatacctaatatagtcactcaataaactcgagcttctaatatctgaactggggaggcagttaaaccaggaggcatttagtgtgactgccatgtttcataggttatggaacggaggcccagagagggaaagttatcagccaaaggtcacttagagtattcatggcaggtctgagtctgcaacttgggtctcctgattcccagtacagtgttctttctactccccttcggcttctcaaacctcacccctaactctggtccacagctgaatggattcttcccatggatccaggagttcttgagtcatcacagaccaccatcactatgggagaatgcaccatgttggtggaggcagccacactctcttaatacaaaggacaggatgcattagtcagtaatggccacaacagtgctatgtaacaaaccaccctggaactcaggggcttacaatagcaaggatataacctcatgttcatgggtctgcagattaacagagaattgggtgacccaggctggacttggctggacaggcctcctttggaatgctggttggctgaggttggctccaggatgaggattggaatgcaagtggcttaacatgtgttcaatctgtaactcaagctagagcctagaagtctcttattgcaaatcaaggaagcacacaataatgagtggaaatttgaagccttttgaagccttggctcagaactagcatgttatcacttctacctacactctgttggtcaaataaagtcatcccaatgatatggatcagaggaatagactccatctctagtaggaactgcagaagtctcatgacaaagagcatggatatgtgttcttatacacagaagcgaggaagacttgagagcaaacatctaatctaccatgtgaagtttcaatctccccacattgtcccatctccattcttgagtcaatgtgctgccatcatcctacatctttgcctccacctcccttcattagagatgcacaaagttgcttcttgtgagtgagtctcagttaaactcctgcatgtgccatttaatgctccttctagaacacagccaatgaaagggctcctccctgctttcagtttttctcagctccagcccatcatggctaaagagccagatgaatctttctgaggtctagatttttatcagtccataccagtgtgaaaggctttaatggcttccaccacccacgacattgagctttaaccccccagcctggcattctaatcctaaagcattacactgctctgtccaactattacctactgttaggtactgactgtcctggcctaactggacagagtgtccttcatttgtctgcattttttggtctctgtgacccactccataatatctcatgcctttctccccagcaccttacactggctgagctccatgtattctgtatcagtagggttcaaccagagaaagaaaatcagtaggagagacatattaaaacatttattgcaaagaaatggctaatccaattctggaggttggctagacaactctaaaatctgtaggacaggctatccaggaattctgtctctggactacagattttagagttgtctagccaacctccagaattggattagccagagacataatttcttcttcttctgggaagacttagctctcttcttaaggtctttaaactgattgaaccaggcccacccagactgcctagcataatctcccttacttaaagtcaactgactatggactttaatcacatctacgaaggctttcatagcagcacctagattagtatttgattgaataactgaggacagtaacctagccaagctggcacacaaaactgaccatcacataaaacaatatactccttgtcaacttggaatctaaacgcatatcctgaacccaggcttaatctcccagtaaagataataacaaagtcatactcccatccaacataacacaactgtcctgcatacaactgaaaacgtgctaacccttctgcagaagagaatgtgatgtacttgggtgatgcccactcttctctcgtgatatcctgtaacttaaatactatgacataaacctaactactattaatatatacgtgtaatgataagaggataagagagaagaaaacaaaatcatttaattaatacatgtatataaacacacaaagatatatttatgacaaaataaggaagaatactcataattatagtccccacttctgcaaccggttacatgatcttagctgctctttataacttcttccatcacccatttcctttgtcctcagcaagcaccccagctagtcatggttctttgcctggtgaagtgacccaaatatttattcctgaaggatctgggctgttagcagtcctgtctgaattgagtgtcgtagttttccattgactttgattccaggacatggtaatactaagagacgtcccaagggatctcctgtgttccagacatactcttcctaacccctactgtgtggtagcaacccagttgccccttggcagtcagggcccatcacccagccagccctgtaactccccttctgcctgttgattcagaggcatgaggagcccaaggtagctgagagaccatcttaacttccagttcaatgggatcattgttatgactcctgatggaagcatttctccctctggaactaagacttctaggtcaacagagtataaaggggcagagatagaaagcaaagactatgctagagaatcactaaggatcaaggagaatctcttagaggatctggagatcaaggagttggggtagcaccccttactcccattatagtcccatttcctagtactcccatttctactccttgatccctggacccatgaatctcggcaatggaagaaacagcaccatgtattggatgctgatttagagtaattttgccattacttttaatggcaaaaacctcaattactttttggcaataaccgcaattacttttgcaccaacctaatatcaagccagctgcttcaaaatggcagaaacatggcaagaccagtgaattctgcaagtgagtgctcatgtctgtacttcactcgctgtgagatgagttccttgaccagaagcaactgtgtggaataccacgataaagaataaggttgtctctaagtccatgcatggtagttttggcagaagcactgagtgcagggaaagcatgtatatatccaaagtaattgaccattgaggagttcagtctcatccattacagcccgggtcacgtttcgtctcctccataaagactttagtaacctctcagaccaatccaatgcccattcatttgaccaacatttatagagagcttttgtgtgctggacaccctgctaggtgctggggaaaaaaacatgatctctgctttgaaagaacttaggaaattgtgaaattgaacaaacaaattgcttttctgtgtccttgcaacccaggagccatgggtttgacctcaggactgggcagttttctgtgccctggcagactgtgggtgtcctgagggcacgctccacagtctcaccccaacttgcataacactcaggacatgagatgtgctggagaatcactggcaaggcctagaaaacatgtaactaatagtttcacagaagccacttcttgggatgtggccggtggggattctgccctctctagggaggtagcaaatgtgagtggtgctgtgggcaaggcccttcctaccgcctgcttgttgggtcaggctgcactggcactcagctcatcagtccttccactcagacaaaatctacctcatcttgtttaggaccacattgtttccagccaatgcacacaatcagagccagtctcaaagagggcagagaaagccacgtgaccccacaggccacctacaaaccataccctcctgtcctggctcctggagaaagtcttcccaaagccagtgttagttcctgctccccctaccatgccacctttcctgcctctgaccagccactgtactttattgattaatattggcactatccatcgggcattgcatagctactatatgccaggtattacaaatttgtcatcttctcaaattctcataacaaccaaatatgtagtcatcctaagcttcatttacatttgatttccattcacctttagttcctgtactttgtctcagaggtgtagcaagcccagctgacctctggcactgcaggggaagagaaggaacattgagttgagagctggatctaggcagggtaagcttgggcaagccatttctcctttctgggccctggattttcagactgtgaaataagacaatatttgggctgaatgatgcctcagtcatttcccaggtaagttataaatttttaggtacagcataaaagccaaagtgctgatgctgtgcccagcaaagattaacacaaccaaaacttatgcattctacagagagcactggtttctttatgagcctgcttttgaaacaatgttgtttgcttggaagcttcccacttactcctgtctttgcaaacctattttgtggatgtgtgtgcaacaaaactgacataatagccatgtggtagaccacagtattggacctaatttttttgcccttccctgtgtccatgagtgggtcaggcttccttgtctctttgcgttcagccatgggacttgctttgggcagtgggcagaggcgatggtgtcaccagaggccgtgcactcttctgcttgcattcttgctcctctgccatcacaatgagacaaataaacccaggcttattgactggtcccaggaggaggatgaggatcatatgatacagagctactcttagccaatccagcctggaccagctgccccagccaacctgcagacacatgaaccaaatcagttctttgtcatacatggctgagaatatctgatggtttgttactcagcctttttgtggcagtagctcactgaaatggacacctagaaaggtatttataatccagcccctcacatccagatgagctttagtgttgatcttggcaatacctcccccacatcaccaatctaacatgtaattctgtctgttggccacacttcgcatgcctgcaagtgtgaggagctcactgtttcctgaggcagctgcacatttggaaatataactgctgaacttcttcataagaagtcaactcactctctcttaacttctgctttttggcccccagggccacacagaattgaatactcctcttttcttcctgacagctgttcagaggtgtgaaaagtgctctcacattctcccatatatttactgttagtgctaaacatccccttgtcgctggccatctctcacccctgttacaaagctcagccctgggccattcctgcagctccaccaaactgggtcggctccatctttctcctgcttcacaagcccggagaaaaacaaaatagcacaggtgcatccatcagagcagaacagcaaagggctgtccctgccctctccctggacactgctgatgtcccgtgcagtgagagctctttggactgccacagaacatcaatcacatcgatcctgagctggccccagacaacaaaccgaaggcattctcacacatgctgtcactacaccagtcctctgccctcctgaaatttcagattcccaggtgtccaaggcatttggaagaaagaaaagtctacactttctaaccactcttatctaccagtgttcctaggagtgggaaacagttggaaatcatctccaaagcaggcagcagggattgagccatttatgtaggagccctccagtccctgggaagtgggagccaggctgggccctctcaggtcaattgtataccttgtctcagagcctctcgcccctgaactgatggagaaggatcctcttaggacctgctggcgcttgagagttaagctgcaatgagctcaaaccagtttcagggagaagttttctcagtttaattcctgacattcagggccttgtcatcaattacttggccacttggctggagcatggcagcactgtaaatgtgtgcatactctgggtgcctggaggcccacggatcataaggcacaggccatttggcccacaagccaagcggagccttgtttacagaagcacctgtgggcaagtgggcatcccgtgtcccagtggcctagaaccaggaacccggtgactgcctggcccaagatggccctcttgccttagcaacagcttgggtaattgcattcctttccatagtggctgtttaattattcattatccaacttggtcagggaggggtagcttcttctgtacccaggctatatctgtgaagtcacagaatccagggctggaaaggaagtgaaagataatcttgtctaattcaggctggattttttttctgcaaactgtctctcttacattcctcctatcaaaggaagctcatgacctgcccaaaacagcttatcatgatgtgaaatctccttcctatggcttctacccactgcgcccatatctgcctcctgcaacccataaaccaaatcccaatcctgtaaagagcctattggtgaaaacattacccactgttctatacctgtcttctttaagccaaatagctccagtcccttcaactatctgcactgtcctctgtggcaaggtttctggcccaccatacccaggactcccctctgtggatgtttcaggagacaatagcatcacccaaatgcatcatggtggctggtgtggcatgtagatcatcagacagggagcaggacaaggcagctttgttgcccacaatctttcttatgccatttgtttcttaagcctgtccctccacctggaaaatgaatggtccactcactgtcagtgacataatttaagtgagatgaccagcgtgggggtaagtctcagcacacaccagtgactttgttgacaccaggatcccatgactaccgttgagcaagaaaaccatccttttgtgaacagtgccatgaatatggggctggccagccttgcagacctgctcttcctaagagccacagcccaataaagggagccaagacaaagaggaggggtctttacccagtgcattagtcagagcacttcagaaaaagagaagcaatagcacgtgtgggtatatagaaccagatttattttagggaattggctaatgtgattctgagtccaaaatctgatcggggaggtcagtaggcaggagactcaggaaaggttgacagtttgagtccacaggcagtctgctggggaggaaggaagaggcaatgttgtagaggaagaaccaaggcctctgctggtatagttctccctggagatcagtcttccattctacccaggccttcaactgattggataaggcccacccacattatggagggtggtctgttttactcaaaatccaccagtttaaatgtaaatatgatccgaaacaccctcacaggaacatccagaataatatgtgaccacatatctcgatccaactaagttgacacataaaattaaccatcacacccaggaagactcttatccagtgacagggcacacagaatgcaggacggacttgggatgttcttgccaagaacaacaataaaaatgccaccaaaagcctttctcaaatggcagtctgtctgtcaagtttacattatctaaagacaacacctgatgttcaccacaccattgactacaataaaaatggttacaaagtatagcactgccattcagccatcaaaactgatgtggtgttgtatatgaatacttaggtgggaagatgtttatatatgtatatatacatatatgtatatattgaagcatcacaagatatatgtgtaattgatagccatgtataataaaggtattgattttattcatcaagatggtagcagcatttctctccagatatgtaaatgatgggtttcttcctttttttctcttgcatgtattatgcagcatccccattaatatcctgcattacttgccagagaacacaataaatacaagtttttgaagtaaacaaaatgattttatgcagtcatttctgtcacctaacaatgcagaaaactgcaatatatttatataacatttgtctgagttattttccagcaaaatttaactaaacttttacatgccacagcctgtgggttttgttgttgatgttgctattttggttaaaaagtgttttcaatgtttttgatcagatgtaacaaagcactccataaaagctattaagtactgtgcacatatcagttatttctagaagacattctgttcttaaacagtggctgtcttgttccactcctgctgctataacaaaacaccttagactgagtaatttacaaagaacggaagtgtattgctcacagttctagaggctgggaagtccaaaatcaaggcactagcagattcagtgtctggcgaaggctgctctctgcttccaagagggtgtcttatggctgcaccctctgaagaggatgcagctgtgttctcacatggcagaagggatggaaggacaaagggacagatagctccctagacctcttttatgaggtcattaatcccattcatgaaggatctgccctcatgacttaatcatttcctaaaggccctacctcttaataccatcacactggtgatcaagtttcaacatatgaatttaagggtaacacattcagaccacagcactggccatagttaactccttcgcagtcgtattaacaaataatcatcccacattttctgctcttagctgtcatttctggtgaatcttcagggctcttatctgtaatatttttcacaacaactgtgtgtccatgggaagaaacatctcacctcttatctggagtcacatgcatggtctttataactgctgtttctcaacttctggtcaataaggccttactgtgtatgggtttctcaaccttggcactgttgacatattgggttgaaaaattcttgtgagggccgtcctgtgcactgtaggatcttcaacagcatctctggcctctacgcactagactccagtagcaaacttcaagttgtgacatctaaaaatgtctctagacattgataaatatcccctgggggagcaaaatcacccctggttgagaattgctgctgtattttgttaatgatccacataccctagagcaacagaggaggaaagaatgatcagataagcgtccggaaggacatagaaattcctttgcccatgtagcacccccactcctccctatgcccgtctgattggatctgactgacctgtgctctctggagtccagctcaaagctcttttagagagacccacactgctgtaaccagggccacctaggccatctacctgctagcagcattggtctgaggccatatcaacacagaagccagtggagagagggtgctgggaagaagaaaccatgagtgcatggggaagtgggaagatgcagacacatttacaaggcattcaaacagccaaaggaagctcaaagtagacaagaaggccatggggatggggatgtctctcttgctgggcctggatctcagagggtctggtcccctaagttagccagatcacaggtcctccttccccctgttccctaagagctgggcctgcaggcggggatgccattttaaccatacagggattgggggaaaaggaaaggaaaatgccattccagatctccttcacgcctgcctctgtaacttttgtgctattttcagttttggcatgaaaaaaaaaaacacaccctgatcagagcctagggagcagatgaaggggatcatgcttgacatgtaatcagtacggcttcatggctctgagaggtacccttgatctggcctccagcttttcttggctcattcagagcctgggagcagtccattccacatacaatctcagaacacaactccctcagcttggagctcaaacaccttcaatggctccctgctttctgcaagataaatctcaactgcacggcatggtcttcgtgtgagattcctgcagctgctgtaatgaatgaccaacagcagtgtggcttaaaacaacagaagtgtattctcgtacacttctgggggccataagtctaaaatcaaggtgttagcagggctggctccttcaggaggctctgtgagagaaggctccaggcctctctcctggcttctgaggttgctggccatccttggcatccttagcttgcagctgcatcacctgacctctgcctccatcctcacatgaccttctctccattgttttgtcttctctcctctttttcttaagagaacattggattgtcattgcatttggagcccacctggataatccaggatgatctcatccttaccttagttatatctacaaaaacctttattccaaataaggttacattcacacagtctagctgggcattgtttttgtggggggggcattattcaactcagtaaagtcttcaagggcctccaaaggaggcttcattcatttgttcactcactgatccattgattcagttgatgacccatgcttggcacatacccttctgggccaacctcctgcctgcttttcatggatcctgttccatttcccttttcccctattctccaccccttctcagggcccagctatattcccatcccctccaggaagtcttccttgacttttagcccacactgatgtgccctttagcaacataactccattcagatccctgtctggcttactgcaatctgatgactggctggggctgtctttgcaaggcctcctgcaagtcactcaccagacatgtatcgacctcagcttaggtagaatcagaaataatccactctgaagtacaaactgtgcctgcccaggtgtgttcaggggtaagggacagagtggggaggaaagtccctaccaccagtaacttacaaattatagccactgtgagtctctcttttctcctcactaccctacaattcccacttcacctatgagaaggcaggatctgcagttccttggcttattcaaattcatgaaacgagtcagcagcagccctaggactggagacatgtttacatgtaatcccatcaccagacctcagagaggatggctgggacagaagtccctgcaaacagacttcagttattggcacttgtcacactgtttcatttacaaacactcctccttccacatagatttccttccatcttctgagtctgctgtcactgtttgttggcaaaggcccccccggtcaaatgccagtgactagagaagcagcctccaggtagccttgagtggtcctcgcagtgtggttcatgggcagggcttcacatgggacaggctcctcccacttaccagcggagggacctcccacccccagaggctgcacagaggcataggaagaccttcccactcctgaaccccttccctctccagccaccttgccttgctcgccagggttcatcattgcaccgttcattgctgccatgctattccttctgcccagaaagcaacccctccctatcaaccctactcactgtcaacactcatagcagatgccatcttcactgccatccctgcctgtcccaggttccctccactctgtgttcatgctcccactgtaagcactcagcccgttgtgttacaaaaggagagtcccttctcgatctccttcacacgtgcctctgcaattctgtgttagagctgacccctcggccacacccagcacccagagagttggatgatggtcattcatctttgttacctggccccaagatggggccaagaagtcatagaggtggctctccttgttttcagcaatttacttgttctaggctatgacttcatagcgatctctgtttatcagaatcattcgtgcatttattacaagcacctaggctctcaaaataagccttggggctccctcccttccaccttcctgttcctaactgtggctaaaacaggacagttgaggaaaacatgagggatacatgtccacaataatacgtcttcccagacacattctttaatagcaaagtcaagaaacccttccactagtttcacaaaagactgaatctgccccttgactctagctctgtgagtagtacctttattttatggataaaaatgtggatagactagagaagattccaagaaaaacaaatgaaatttcaagaatgcatgacagtaaccaaaagcatttacttatttacttacctttttttttatttaaacagtttttttgggggtaaaattgccacacagtaagctacacagatttagagtaaataatttgataaattttgacaaacgtacacactgtaaagccatcaagatagtgaatatttccactgctctcccgccaaagtttcctctggctcttccatagccctcctaaccccgccccctcaaccactgaagcactgtgactacagattagtttgcatatcctagaattgtatacaaatggatcattgagtgaatatacacttttgtctagcttattttaatcctcataattattttaagattcatccaggtcatggtgtgtatcaattattcattcctttttattactgagtagtatgccattatgaagatatatcattgtaaagatataccattcatctgttgattgacatttggatttttcccagtttggggctatagttaataaagctgctatgaacattagtttacaagttttgtaaaaacatgtgttttaatttctcttgggtgaataccgaagactgaatggctgggtcatatggtgtgtgtatgattggctttccaagaaatttacaaactgttttccaatgtgattgtgccattttatatacccaccactgtgtgtgagggctctggttctttcccatagtcaccgacagtgttttagttttacccactctaataaacagtagtatcttattatggttttaatttgcatttccctagttactaatgatgatgagcatcttttcatgtatttgttttccgtccatacatcttctttggtaaagcctctattcaaatagtttgctcagttttttttattgggttgttttcttattattgatttttggaagttcttcaaatatttggacacaagttctatatttcctccaagtgagtgccttgttttcctttttttcattttcttaagaaaaagagcagaagtttttaattttgctgaagttccatttatcagcttattacttcgtaactgtaagattattgatttaaaacaaagaaagctgagtggcttacagtatctaataattcaaagtttatgccaagcctactatgtgccaggaactgtttggccccaaggagaaaaaagtacaagacatgatgcctgtttacacagagctcaatgcacagtaggggaggtgaagggagaacctgattaaattcgatccacattattggcaccaggagagagggacaaagagggtcatggagttcatgggaggcaatggaaggaaaaaggtatgagaaagtaaggtgggcattttcagctgggtctcaccctgagctcaggctttaggaagaaaattttccttggcttttggtttgtttctgggaaggccatcctgatcatttgctttgttcatttccaaggaggatgaaatgttgagcaacggacctcaatgaaagcaagagaggtttggatcaaatatggagcagagcttgataaagaggatgtcaagacaaggggaaaaaaaagaccaagaaagaagggggaaggaagattagtggcaaagaaatatcaagggaagtctcgactcataaaatagaaattaatggattacagagcaaggacattaagaaagatctttaagaggttgcaggaaatgggggaattagggcaaagctgagctgtcatgtggaacattttacataacaaactactggttaaagctaatataagctttatattataaagggtaagagacagcatgtgcccaagagaggagaaatgagagacaggataatagtcaggatccaagccctgactcagaggcagctcacttggctgtgtactcaatactcctagaggccaggctattgtcatctggaacttgggtcacttacatgggcttggaacagaatccaccagtccaggatgatttggtggatggagggcagattttttttttactgcagcatcttcagaaggccttttcaggtagtatttaccttggaagttgcttctttcccaaggggaaacattaaaaaatcaggagctacaaacatcttatcttctgctgtaatgtagcttggaagtgcagcagagtgccagtggagaatggagaggggctcagccagagaaattgctcctcgcatatacactcagtgaactgtgtcgcaaagggtaagtcttctcagttccagcatctgatggtcatgacgcatgctgactggtaggaatggggatagccagggttagagacaaggagttggtggagaatttccacctaacatgtaaactgtgtgataacagctgaagacgccatctgcagttggaataaaaacccagacatggccattccaacacaaggcattggggaacatgggacagcgaggggtacagggcatgagaagatgacaccaaaccaaagatgggaagcagacaatctcatggctatcccgaggtcttttgtttttctgtctctacaactttaaccccggagctgtcaatgcctctgtttcctctgtgcaattgaacacaagggaacacatactccatctcacgcagcatcctccatcattctcaactattttagtggagattaaaactgcagctaactggaaggtaaaataagactgtggcttaaataagagaaaagcttgtgtattttttatataaaagtctgggcaggcaaatcaagggccaatattgggtcccattgggtcagggacccaggaactttctagatctctatctcgccatctctgcagtgtggcccttgctctcatagtccaaggcatttatgttccaggagagagaaaatggtgaagaaagaggtaaagggtgcactccaggtctctcaaggaaaggacgtggaagttatcacaggacaggcacttctgctaacctcccactgaccgggacttagtcacatggccatgcaatgtgactgggaagcacagtcctgattcagagcagccacgcaccctaataaacattctaatccagtgggagaaggggaaatggatcttggacaactagtagtctgacatgttgactaatcagtcacaaagtcctaaataagggaaaacacaaagacatcatcatgtattgacctgcacgctacttggcaattgccatgaagtttctggcacccagagtgggcacaccaaataaataattccccattagaggagtctgggagggcaaagcagaagctaggacttgaaagggagtttataggacagagttaaaaaggaaaggggcaaagcgagggtggaatcatgctctgggggctatgttctccagtgtagctgagaagctggggaacctgggggaataatgaggagaaaagcagcaatttgagtgtgcacattgggagaaaagtcgagagagagaaagaacagaaatggagtatggcacatgagccgagtgatgggttggggtttttgtcttttgatggtagggaaagaacttcacattgaataagttcttcttaaacacttgctctatgcacggtctcatattgggaccatgaaataaaggaggagaaacaagacagagtccctgccctcagggaacttccagtctcagcatgtaaacttgtataccttacaatgctatatagtacttttgaaccgacctcttcaaaaatttcatcttagtttataaacatggtagctgaaatatttaccaaacagatattcaatagatcaagatctgacatcagacactggcttttaactcatcctctgtcacctacatggtgactttttagcaccaaaagttccatatcctggacaaactgagatggttggtcacccttgctatgtataagcttcatgttcttgggcaagttacttgacctcttccgatctcagtttcttcaactggaaaatgggaataataatcattttggcctttcatgatagtcatggacattaaatgggaatatgttaatcgggcttagcagagtgcctagcacaagtgttaatattatcctttatggttactcttaatagaactgttatggagctgatggagtcacatatattttacccacaatcttctggatgaaaactacatgctgcactggaataagtgaacttgagtatttatgatggttttgtaacatatttctcaggaatggcaaggagctactgttactggaaaattttcttttcaaattcaatatacatctccaatttcccttctttcatcttctctgtatactaatcatttttcccattgtcatgggatctgaaataagaatatcttgtgaacatccatgtaaagtaattgtctgaaatgttataataaatttgcttttaaaaggcaatttcaagtaggttataggaatgataggaaaatcttttttaaacttcctgtttttattcactccttctttcaatgagtatttaattgtgctattattcgctgtcaagcaacatgccaggcgctgggtacacaagaataaaaagccccaatctctgctcttaaggaactcccctgaagagatggatcatatattgcatatgagcaataaatacagagatgcaggtgctcaccaggctgatgagaatccctcaatgtacttgacagaatcagatagagtttctaaaagaagtattggatgagctaactcctgcattccaggtgaacagagaaggtgcataatgggaaaggcactgaagtaaaaagccccagcgccgttcaggtgactattggggttcagatgatgcagaagagggtggtggagactttgttggcaaattcatccaacaaatatttgctgagtacctattatatgaatggtatcattgaatatacaagacacagatgctgtccttggaaagcttaggacttagaaggggaaataagatgcacacacaaacaactaatgcaagatacctgttatggattgaatgtttatgcttccctcaaattcatatgttgaagccctaacccccagtgtggctgtatttggagacggaggctctaaggaagtaaataaaattaattgaggccataaagttggggctctgatcccataggattagtgtccttgtaagaagaggcaccagagagtgctccctaccccacaccccaaactgagcatgcactgaggaaagtgagaaggtgactctctgcaagtcaggaagagagcctcaccagacaccgaactggctggaaccttgttcttggactaccagcttccagatgtgagaaaattaacccccgttgtttaactcatccagtctgtggtattttgttatagcagcctgagctgactaataccaatagccatgatgtgacacagggggaaggaacaaagtagcactgaactcagaggagtggagatatctgctgcctcagggagccagaaccaacttgcaggtgtttaggtgaacttgatagtaggagaacattccagctattggaagtgtcctgggctagctggtagcatgaaaactcacagctttcacttgtctggaggatctggcatgtgtgatgcagaagcatgcaggacacactgaggtcatgttgtgaagggctttgaaagtcaagatgaagactctgggcttccttgaggaggcatgagggcacattggtggttttaaacaagcagagtttcatttagcactattccttgggctgagtaacctggaggtccctggaaaggctcaaccctagaagtgattgcagcaacgcaggtgaggatgcagtgtagggcaacagaggtggcatgtggcaagagagatccaggaggtcagatcaactacatttggcaacttttggatttggaccagagaaaggtggaaaataaatgttaataataagagagttgaaaacaaggtaagctcataaaatcaacttgctgacttgtcaatttgtagatcacttactcctagagtagtccacgtgaaacttaggctgaatggtcggcaccaggcaaagacttcacttccttctgttatgcctggctgttgtccagtctggaacctgagtgatgaggctactaaaagtgagcatgcaaccaggagtagaatgagctctagggcaagggtgatgttttccttcttgattatttcagcctgaagtgggaccaagcagttgaaaagtaccactgcctctcagagagatggaagccaagagagtggatctggaagtccaagtgcttagaggaacactcttgtgatggagacagaaaaagacagcagaagatctgggaacagcctgcatttagaatgttagagaaggaaggagaaacataagaggagactaaagtctttagaataattgggctacaaaccaggataatgttcagggaccattggaggaaggacccaatggaggagggaatttcaggaaagaatcatggtcagttgtgccaatgactgcaaattataggaaatgaggaaaggaaaaatattacatttatgatgagactcagcagccccattcctggagaagagaataaacagctctctgtactggacagctgaattctccccttgctgaggaagaggttcgaacagacaagcccccagggccccttggctgagcccacacactttggtctctcatactctgatgggacttttttcttacctggattgcaatgaaaggtgtgcacaggaggtacagtgagcaaatccgtactcagagaaaatgctagagttgtcgcagcccatttcaaagaccttgagtgttcactgcattgcctcccaaactttaacatgcatagggagaatccagtttatgatttaggggatctggggcaaggtctgagaatcctcatgcctcgcaagcttccagcagctgctgctatacctgctcactcaactgcacttgaaatcacaaaagtctagagcacagcaactaactggtggtcctggcaccacttgcttcatccaaatgtgtttctttgaccagcataatcttctaaaaaattagatttacttgaaaacatctaaaaatgtgcagatttcacgttttaataattccaaattctgtcttctcttgaaaccctcaggagatgtggccatcctgcccttacatgctggaacacagcaagtgctggagctgacctgtggctgcccattttagacagtttcaatgccctccagcctgcccaagtcctcatgcccaggcccactgcacacccccattgacactgtctcctggcccatgcaaccccagagttttccacttctcatctagagccagcccctcactcaacagaggagaaatgaaccctagagagggcatgggatgagcgggtgctgccactgttaaaagcagcactgtgtttctgcaccccagggtttgtgctcagtaactgtttactgaatgaccaaatacccttttccattattgtgctagggtcaacagctgatgctggtgtccacccacggtgcccccctaccctggccacagcacacccccctttatcgatctccttgattaataaacagtccatgtcagagaacaggagcctaaatcacacatctctttgtgcctttctccagatttcttcttttgtttcttggggagaggctgaggcaagtcaactcacaaaaatgtgcttccactgaatgggatcctggagtttatctaataggcaggttgggaaaaatgaaaacgctaattacttcagggaaagatggaaaatgagtcagctgattgggccaccaggcagccagtaggagctgattttttttttttttaaagaggataatgacttattctaggggatttcagttgtgcacacacaacaaaaataattccaagtgtctgctagcaaaatcccacgctgccgaacatcgcgtttgaaaattaatgtgacaagctggaggcctatttgccccaagatcagaagacaatgaaagcttcctccccaggaagtttctcagggtagaaccagaaatccggaactggagaacccagagggcaacgccccaccggagccagtggacgggaatcagctgggacgccatgctgccctcctttgtctgggtgatcaggcccagcctcccgagttactgatgatccatatggaagctggtggggctgcacattaattgccttgttcaacccatcattaaaatgatacgtctcgccttcgggagctgtgctggctggcggcgagttgggcacacctcctgggtagagaggtctcccaacagggccctacacacgcttctttctgaagagttgcacggtgatttggggttcatgctggtgccattggactctaggaaccaaggaccccagggcccttgctcccactctcctttctagcgggcaatggaattaatgaaccccgggcagccctggatgcagggcacactcggtcctttacagctctttgtctgcagccaggctcttgtctttcagagctggctgccgccccgtctctggagctgatgcagcagccagataatgaacagtatatcagcggaggcggcggaggggggcgacggggagagaggcgagcgcccgagcgagttggactgacttattattccttcactctcaaacaaaacaaaatcattggcctgccagggtcattaaggaccccggggttgtcatagaaacgacctttggggcctggtggttgttaatgcatgagtgactgcctgcattgtgtgtgtggggagaggtcagagttttgttggtggcttaagaaagaaagaaagagagtgaggaagaaagagagccagcacaaagcccaggattgggcggctgacattcagaaggaaggttgtccgccgtggcattgattagctgtctgggatggtgaaagtcctgtgcccggcacatagtaggtgctcagtaaatgtctgcaaaggtgaatggacacgtttctctggttaaaaatgccctcctatgcccactctgaattccacctccccgtaacccggaagccactctgccaatgctctccctgagagtgcttagacaggtaatgctccatcattgttccagccgagagtaacaaactcacaagtttcaggaggcacttctatgccttcaacttggacaggacaattttcatggttcccagggacccaggaggaactcgttggggtgggtgggcaggggcttttacagaggagaaatataggacaacagggcctcctctgtcagccttggatttacagatgcgccttcaacccactttctaaccagggcactctgtcccctgccaggagacactgagcaccacccgtgagacggagctccccctactggctggtgttcagagagctcaatctccaggggttgactctctccagcttgtcgggtttcagaaccagccctgctactaactctctgtgtgtcctcttgcaagtcctccttcctcagtttcctcacctggaacattagacatggtccagatgacatctacagcccatcccaagccttctgttctgatgcctctgggtgggggtggggggtggggggggtgtcttttctgaatttaggattttactttccaggttggaagaaaacattctagccaccttttgggggtgattatagaaccatttgatctctgagatgtctaaacctggttgccttctctggtgtcaccatagaagtgaggaggcccgggcctttcaagatcctctaacactgtactgcttatgttaactgtaacaccatgtcccctgatagcctcttgaagtctccttgtcacatttggaggccaatcccaggacctgcccactggagacacactcacttagcatttactactagagtagcttcttcttaaaaatagtttcaggaatctgtctgaaaccttacctggcagattctcagatctttgctcaagcaaaccagactatcactcacagaatcccttcttcagctcatggaccccagaacacaatggctgcaaaacccaggtctctgatgtgggcccagaacgaacaaacacctcatctcagtgaatcgcaaatgcctgcattgcacatctgtgctcttttgcaaggactttgctgggattcgtgatgagcacacctattacagaatctggagtgagagtgcccagtacagcgggggtgggggggtcccttgtgggcaaaggaccatcacattcatctacagcactgagcctggttcctgccctggagtagcaataagatattggagtgaatgtttggttccagtctttcatttaattcttataaaaaggcaagcagctacatcccccacagagcagatgaggtatcagacaggaggaagtgtgacttgtccaaggtcacaggaggagcaactttagaagccggacccacaagctccagtctgttatggctccgcccacagtgctgccgaagctgtcacctgcgtgagtaccagagagtaagaagcgaagaatcttgttatttatgctcatgttgcataaaatgttatgctcagatagagtcagtttacctttgtttttgtttttaaaatctgcacaactgatttgcataactgtcagggccatggcctggcacctgttcccctgtgtgtacaacagaaaggagacttttgcctacagtcgagcatgttttacttcctttctcattagttgcagaaagagagaggactgtgcccagcttggactccagttcaaatcccactaaaacatgctgaatcctctgtttggcataaaacacgctgaatcctctgtttggcataaaacacccaactcagattgttgacatatattctcttttcaacaaactgcatcttctcaaataagtgagaagacaaaaatccatcgagtttcctggtttccagaggtaagagaattcaagagcaaacacttcagcatgctggagcttaagtttccaagaaaagaaatgaggagttgctgatttggagaaaaggccccaggctagacatgactagcttacctggggttgcaattgcttctagctcatgtggtaacctttcacaagtcacttccccttgtagagtctatttctacttttctaaaacataagggagcccaaactttgaaatgttgtaattctgaagcttaggttcctataaaggatgataaactccagagtatttgtatttaatgaagtttaacaccaggttataaaatagagcttcctgggagaatgagccatcatctaaaccagcagaattgaacagagtgttttactttgcattaatatgttcccttagggacaaggacaaaacccaacattgtaaaaaatgtcttgaatatttgcatattgcatatagaatatttgcatgcagtatttatgtaaagcatgatgcttatttttcagggtgggaagggggaaatctagtaacttgctcagtatcaggtgcttttcatacagcattgaatcttcagcaacccaaagatgcatggtattcattgaacctctagagaaactgaaggccagagtagggacttacccatagttacctggtaaaatgcagggatatccttattcctttacagcacttttctctcctacaacttaacaacattcacagtgtaagagatatgcctggaataatgtaaaagaaatgaatttagctcagtgggtttttattcatattcctctctaggtggaagtttagacaaggtggcctctaagatccatttcacctttttctttttttttttctttttttgagatggagtctcgttctgtcacccaggctggaatgcagtggcacgatcttggctcactgcaacctccgcctcccgggttcaagcgattatcctgcctcagcctccctgagtagctgggattgcaggtgtgtacctccatgcccagccaatttttgtatttttagtggagatggggtttcagcctgttggccaggctggtctcgaactcctgacctcgtgatccacctgcctcagcctcccaaagtgctgggattacaggcgtgagccaccatgcctggcccaatccatttgacttttaaaccctaactttcagttactcatttaaacagtatttaccaagatgaattctgaaacataacacacccaagaaatattccagggaaagcatgttttgtggtcaaatatgtttggaaaatattgcaagttgtatcctcaattagagacttacagtgcacattacaaaatatcaaaggctctgataaggcctacaacaaaagcttgcataactgtttgatccatttgccaaaattattgcattctgaacccacataacacttatgaacatttaatgaaatgactttgctatttaacacacttggaaagcattagaataattgtaaagtttatgaatctgcatctccctcgtgtcttgccttctatcctctctgcgagcagagaaacagtggccctcaggaagggtcatgggcagggagagaggatgaggggagagagtccatttaaggttaaccagggctcgtgtccagcttctgcttggaagaccgactcacccgctgctcttaaaatgctgggagagtccactcatgaaaagcaagaacctggatcaactctgatttcctccatgagaaatagtcattgctccagcagtctcggaaactttgatacgataaatattttgatgctttctgtatatttatataagcccatttattgatgaaaacaaaatgtgtcacatttctgttttgatcagcccttttaaggaatttccccactcctttccattctaagctggaaacacccaaatctatacacaatagagtctcactggacatgtcatttatggaagttgttcccttgacttgacttagttaattccagtgcatcctttatatcacagcttatatgtcacttcctcctggactggttccctgcctgcagactagatttagtctgctttttctgcttctaggacagcctgggatagtctgtgagagcagtcattagggctgataattatatagccctaagagtttctttataaatgtctgattctctcactagactgtcaatctcatgaggacaagggccatgcctatttgttcatactgcttcccaaatacttagcatggactggctaaataggcactaactaaatatttgttggatgagtgaatgaatgaacaaatttccatgtgaagaaacaggcttcatctgcctggaccctacatcaatcttttgtactcctgtgctaccaactgtgattttgctcttctatttaaactctatttcacccgtcaagtttgatacatgatcttatgtctctcaatgcctggccttgcctccctctcttgccacctctttggatacatcactcacaagccgctaggcaacgcccacccatcataacccttcttctaccccactgggctgaccccaatcagatttcctgcccataggaagaccaccagaggggtttgtgatttgttacctacaaataaaatcattgaccttccaatatcaaagctaccttaaaggtcacttgttcaatttcaccttttgtctgatgaagagagcgggaatcagacaagataggtgaattgtccttggacagagagcaggaggaaaaaggagtccctgggatccattccatgtcagcattcatttcaaaacggtgtctgcttgttcattttttaaagtaaaaatttaaattggtacatgcatgacattcaagaagcataaaaggattctaaaatgctatacaaagagtgctcattacactgtatgtttatactgtcacttactcccattttactgatgaggaaactgagccttataattactaaatagtgcctctaggacttgaactcaagcctgcctcttcagagtcctttactttactgaaccctaaacacatgtaattggttcaagctaaagtggccttctataagctctagaccctgagctacttagaaacaagatcacagcctggcgcggtggctcacgtctgtaatcccagcactttgggaggccaaggcaagtggatcacctgaggtcaggagttcaagaccagcctagccaacttcgtgaagccttgtctctactaaatatacaaaatttagccaggcatggtggcaggtgctgtaatcccagctgctcaggagggtgaggcaggagaatcacttaaacccaggaggcagaggttgcagtgagccgagattgtgccactgtacttcagcctgggtgacaggagtgaagctccatcaaagaaataaagaaacaaacaaacaaacaaacaaacaaacaagaccacatacaccttatttatctttggcaacaccagttcctagttcaatatattgtcacataataggtcctaaataaacatttaaaggatgaataaattaatgaggaaattcacaataattaaaagtttgaagcaacagttagcatagcatgattttcatgaacgatgggcagggcaaagaagacaaggctatacatttatctcaaaaactcatagtggctagagagaaacatttgcctccttaagctgaatgaacttgtagagaataattttttttgctgcaaatgcttaggatataaaaatctgtatatatcttgttgaaacagcctagatatgagcataattgcagtgatgtgttactctccaaattagaaactagaaatggtggtggaaggaaggtaggaatcatggagggacacatgtcctcttcttaccattaaagttgatataaccattaaactctatataatcattacacacacgtgtatgtatggtgtgtatgtacagtattaaccaactgctttgagaaaattgtatgaaaggttagactgttgagaatctgcatgcatgaatttgaatatatgggaggaagtgtgattttaatgcttttggatatatatcttaaccctgccttggaggttttcaagaagtagtttcaataaatgtaatttgccttgtaattaacacattgaatgcttctaaagtgccctctttgtcttttttttaatagttttaagccatcctttgtcttgacatttgtcacttgctgaaataatccctcttttccatttataccacaaaggtgaacctcacccaagccccagcatggtgaaactcagaaattccaggaggagagggtatttaaagtgaagtcatgtgatatgtagaattgtggcccctgccccacaggactttgaagactataaatgttaaagtatgatatacgtcagttagcaccttgtttggcatgcagtccttgctcaaaacccagcaactatgtattgaagctgagtggggtggggggtgaaccaggctgaaagtggggaagacaaggcagaagaatgggctgtagaccagataatgttcattttccccagggctcctaggattgttttggtaattactccagcttcttcaacagcttgtgatttgtccagtgccagggaacctgaatttgcattgcacaatgcataattcatacggcatggagagcaattatgagctaattgagggttgtaatgtttaaagacaggactcattatcaggaacataagggatgttgggaggggagaagctctggagtccatggaggctcgttccctctaattccgctttccttaagatgactgtaattgtctcttgaagggcactgaagttctctcctagaagaggttctggaagctgggcagcggtagctgctcctcctactagaagagggctgaaagtgggctaggatgggctcctccttctagtgcttttgtttgcctagtcgtccaccttgccatgttgacacagttatctggattaatatgattagagggatgtgatgttcccataactacaatttccacttcctgggggtagggacagtctgggaaatataatttggtgcagaacttatggaatttccaatagaaaatcatctcttccagaaattataggacagtccatttaaatagaaacttcattggaaaatccaggagctgggctatgaaattataaggaaccctgggctggtagcaataagctttgaatctactaatgactaggttaacctctcactgaaaggctcttggaacattaccacccctctctggccctcagtttctccatctgtacaatgaggaaattgagtgagacggccttctaaggtcctcccaactctgatatgttgtttctgtgcatcacacctcatccttctgactcaaggttttaaagtatcttgacaggtcagccttttttctttggaaaccagctgtgtgctctttaaaactcagaagacatagtgtgattgttacatgcaacagaaacatttttaagttggttgtataagaatatagccaaataaatcacttttccattggctttcattacaaaatcagatatggtgcatatctcaaaatactgaatcaaagatattttaagtgtttgtatcagcatttactctctctggtgtgtgggaagttgtgataagttgagtcatggtgtgctgtttatgttttgccaccttttcagaactccacagaccttagcatatctctcatttaaggattgtttcagcatagactttttggcgtttactttttattctcaaccaaatattttgatatcatatgaagtactcccctttacaagctagctgtaattaccacgactacttgagctgggctgcaatatcatacctcaccagtagaggccactttctgatacatgatacacatagcctgaagtccaaacaatcatgggctaatactaagggtagaagaggtctttaagatcattttgtcccaataagccttataaatagttccatgccttatcacatctgaaaattacacattttgtaaaactaacgtgcttaaactgaagagtgcctgtcattgactctcatgtagcttgcacagtgtctcttcatttaaacagggcacctggccagtttgcatgccttttgaataatgaggacatttggcatattcaaggtggagattgtgttattctctgcctgtggtgctaatgcagctatttatactaggagccaaagcagatctttcaccggaaagttgggctgtcatgtctgtttaagcattcaaaccagctccacagcttatttgagaagactttcaaatgggttttcgtccagggtaattgatcacctgcaggctaaggatttctttcttttctttcctttttttcttcaaatagcttttccaacaatttaagaaactcttccttaaacctcaagaaagacagaaagacaaccttaagaaagtgagtgtctacttacaaggtctagttttgggagcttcagggtcaacagtcaggatacaccagacaaaggaaactcttatttaccttggagaatgggcagcaataaattcacggctgacttttcagatcatctttctccactgcaatcataggcagcagctccagaaaacaaactcattcccttagcaagcagcagagatgttctggttggccccagttggcttctttgggcaggaggattgatggcctctgctgttacatcctggtgagaataaccactcatgaacaccccatatttaatctttattttggagtcttcttaagcgagaaattgcagtaaaacaaaatagccatgttgctccaagggttaattagacatagcccagaaaaagcgatttccctctttctgccttaaattttagggttttcatgctgagtgactgttggcttctgcccaatggaataagataaatgggagttcctgattcggattcccctctgttcccagctgttatttctcagttttctaaaaagggggaaactctttgaacctgctgctgttcacaaacctgggacttgactctctccccttttggtttgggtcccggtatctttaggaggagatgatcagagtccctctctcaatggacttgtcatgctgatgttaaaataatttccatctcctttctcccttcctcaatcaggctgaacattttaattatgaaattggccactgtgttctggctttttcattgagttgtgagttgtccaaagtgacatcaagatcttttctctttttttccctcaaaggttataactaattcaaaatccatcagttcttgcaaacactttgaattgttcccttaaacttaaaacaaaatttacaagaaataaacaaccccataaaaaagtgggcaaatgacatgaacagacacttctcaaaagaagacattcatacagccaacaaacatgaaaaaagctcatcactgatcattacagaaatgcaaatcaaaaccacaatgagatactatctcacaccagttagaatggtgattactaaaaagtcaagaaacaacagatgctggcaaggttgcagagaaaaaagaaagcttttacactactggtgggactgtaaattagttcaaccatcatggaagacagtgtggcaattccagaaagatctagtagcagaaataccatttgacccagcattcctatcactgggcatatacccaaagaaatataactcattctattataaagatacatgcgtgtgtatgttgattgcagcactgttcacaatagcaaagacatgaaatcaacccaaatgcccatcaatggtaggttggaaaaagaaaatgtggtacatataggtggctggcaagatgactgagtaggaacagttctggtctccagctcccagtgagatcaacacagaaggcaggtgatttctgcatttccaactgagcctccactggtgatacccaggcaaacagggcctcatgtggacctccagctaactccagcagacctgcagcagaggggcttgactgttagaaggaaaactaacaaacagaaaggaatagcagcaacatcaaccaaaaagacatccacacagaaaccccatccgaaggttaccaacaccaaaaaccaaaggtagataaatccacgaagatgaggaaaaaccagcataaaaggctgaaacttccaaaaaccggaatgcttttctcctccaaagaatcacaactcctcgccagcaaggtaacgaaactgggtggaggatgagtttgacgaattgacagaagtaggcttcagaaggtgggtaataacaaactcctccgagctaaaggagcatgttctaacccaatgcaaggaagttaagaaccttgaaaaaaggttagaggaatttctaactagaataaccattttagagaagaacataaacgacccgaaggagctgaaaaacacagtatgagaactccgtgaagcatacacaagtatgaatatctgaatcaatcaagcggaagaaaatataccagagattgcagatcaacttaatgaaataaagtgtgaagacaagattagagaaaaaagaatgaaaaggaacaaacaaagcctccaagaaatatgggactatgtgcaaagaccaaacctacattttattggtgtacctgaaagtgacagggagagtggaaccaagttggaaaacactcttcaggatatcatccaggagaacttccccaatctagcaagacagggcaacattcaaattcaagaaatatagggaacagcacaaagatattcctcaagaagagcaaccccaagacacataatcatcagattcactgaggttgaaataacggaaaaaatgttaagcacagccagagagaaaggtcgggttactcacaaagggaagcccatcagactaacagcagatctcttggcagaaaccccacaagccagaagagagtgggggccaatattcaacattctcaaagaaaagaattttcaacccagaattttatatccagccagggtaaggcttcataagcaaaggagaaataaaatcctttacagacaagcaaatgctgagagattttgtcaccaccaggcctgccttacaagagctcctgaaagaagcactaattatagaaaggaaaaactggtaccagccactgcaaaaacataccaaagtgtaaagaccatcgacactatgaagaaacagcatcaactaatgggcaacaaaaccagctagcatcataatgataggatcaaatctcacataacaatattaaccttaaatgtaaataggctaaatgccccaattaaaagacacagaccagcaaattggataaagagtcaagacccatcggtgtgctgtattcaagagcacaatagccatctcacatgcaaagacacacatggctcaaaataaagggatggaggaatatttaccaagcaaatggaaagcaaaaaaaaaaaaaaaaaagcaggggttgcaatcctagtctctgataaaacagactttaaaccaacaaagatcaaaagagacaaagaagagcattacatagtggtaaagggatcaaaagagacaaagaagagcattacacagtggtaaagggatcaacgcaacaaaaagagctaactatcctaaatatatatgcacccaatacgagagcacccagattcataaagaaagttcttagtgacctacaaagagacttagactttcacacaataatagtggaagactttaacaccccactgtcaatactagacagatcaacgagacagaaaattaacaaagatatttaggatttgaactcagctctggaccaagtggacctaatagacatctacagaactctccaccccaagtcaacagaatatacattcttctcagcaccacattgcacttaattgaccacataattggaagtaaagtactcctcagcaaatgcaaaagaacggaaatcataacaaatagtctctcagaccacagtacaatcaaattagaactcaggattaagaaactcactcaaaactgcacaactgcatggaaactgaacaacctgctcctgaatgactactggataaataacaaaattaaggcagaaatgagtaagttctttgaaatcaataagaacaaagacacaacataccagaatctctgggacacagctaaagcagtgtgtagatggaaatttatagcactaaatgcccacagaagaaagcaggagagatctaaagtcaacaccctaacatcacaattaaaagaactagagaagcaggagcaaacaaattcaaaagctaaccgatgacaagaaataactaagatcagagcagaactgaaggagatagagacatgaaaaacccttcaaaaaaaattagtgaatccaagaactggttttttgaaaagattaacaaaatagatagaccactagccagattaataaagaagaagagagaagaatcaaatagacacagtaaaaaaatgataaaagggatatcaccactgatcccacagaaataaaaactaccatcagagaatactataaacacctctatgcaaataaactagaaaatctagaagaaatggataaattcctggacacatacaccctcctaagactaaaccaggaagaagtcgaatccctgaccagaccaataagaagttctgaaattgaggcagtaattaatagcctaccaaacaaaaacaaagcccaggaccagatggattcacagccaaattctaccagaggtacagagaggagctggtaccattccttctgaaattattccaaataatagaaaaagagggactcctccctaactcattttatgaggccagcatcatcctaacaccgaaacctggcacagacatgacaaaaaaagaaaatttcaggccaacatccctgatgaacatcgatacgaaaatcctcaataaaatactggcaaactgaaatccagcagcacaaaaagtgtatccaccatgatcaagtcagcttcattcctgggatgcaagtctggctcaacatacgcaaatcaataaacataatccaacacataaacagaaccaatgacaaaaaccacatgattatctcaatagatacagaaaaggcctttgataaaattcaacaccccttgatgctaaaaactctcaataaactaggtattgatggaatgtatttcaaagtaataagagctatttatgacaaacccacagccaatatcatactgaatgggcaaaaactggaagcattccctttgaaaaccggcacaagacaaggatgccctctctcaccactcctattcaacatagtattggaagttctggccagagcaatcaggcaagaaggaagaaataaaggatattcaaataggaagagaggaagtcaaattgtctctgtttgcagatgacatgattgtataattagaaaactccatcatctcagccctaaatctccttaagctgataggcaacttcagcaaagtttcagcatacaaaatcagtgtgcaaaaaccacaagcattcctatacgccaataatagacaaacagagagccaaattgtgagtgaactcccattcacaattgctacaaagagaataaaatacctaggaatacaccttacaagggatgtgaaggacctcttcaaggagaactacaaaccactgctcaaggaaataagagagggcaacaaatggaaaaacattctatattcatggataggaagaatcagtatcatgaaaatagccatactgcccaaagtaatttatagattcaatgctatccacatcaagctaccattgacttccttcacagaattagaaaaaactactttaaatttcatatggaaccaaaaaggagcctgtatagccaagacagtcctaagcaaaaagaacaaagctggaggcatcacactacctgacttcaaactatactacaaggctacagtaaccaaaacagcatggtactgataccaaaacagatatatagaccaatggaacagaacagaggccttagaaataacaccacacatctacaaccatctgatctttgacaaacctgacaaaaacaagcaatggggaaaggattccctatttaataaatggtgttgggaaaactggctagccatatgtagaaagaaaactgaaactggaccccttccttaaaccttatacaaaaattaattcaagatagattaaagacttaaatgtaagacctaaaaccataaaaaccctagaaggaaacctaggcaataccattcaggacacaggcatgggcaaggacttcatgactaaaacaccaaaagcaatggcaacaaaagccaaagttgaagttgacaaatgggatctaatttaactaaagagcttctgcacagcaaaataaactgtcttcagagtgtacctacaggatgggagaaaatttttggaatctatccgtctgacaaagtgctaatattcagaatctacaaggaacttaaacaaatttacaagaaaaaaaacaaacaaccccatcaaaaagttggtgaaggatatgaacagacacttctcaaaagaagacacttaggccaccaacaaacttatgaaacaaagcttatcatcactggtcattagagaaatgcaaatcaaaaccacaataagataccacctcatgccagtcagaatggtgatcattaaaaagtcaggaaacaacagatgctggagaggatgtggagaaataggaatgcttttacactgttggtggagtgtaaattagttcaaccattgtggaagacagtgtggcgattcctcaaggagctagagtcagaaatatcatttgacctagcaatcccattgctgggtatatacccaaaggattgtaaatcattctactataaagacacatgcacacgtatgtttattacagcactgttcacaatagcaaagacttggaaccaacccaaatgcccatcaatgatagattggattaaaaaaatgtggcaaatatacaccatggaatactatgcagccataaaaaaaggatgagttcatgtcctttgcagggacatggatgaagctggaaaccatcattctcagcaaactaacacaggaacagaaaaccaaacaccacatattctcactcataagtgggagttgaatagtgggaacacatggacacagggaggggaacatcacacaccagggcctgtcagggagtgggggattaggggagggatagcattaggagaaatgcctagtgtagatgatggggcgatgggtgcagcaaagcaccatggcacatgtatacctacgtaacaaacttgcatgttctgcacatatatcccagaacttaaagtataataaaaataagtaagtaaatacataaataaataaaatatggaaaaaagaaaatgtggtacatatataccatggaatactatgcagccatacaaaaggacaagatcatgtcctttgcagggacatggatggaactagaagccgtgatcctcagcaaactaatgtagaaacagaaaaccaaacaccatgtgttctcacttataagtgggagctgaacaatgagaccacatggacacatggtgggggaacaacacacactggggcctggcagggggcatggcaggagagagagcatcaggaagaatagctaatggatgctgagtttaatatctaggcgatgggttgatctgtgcagcaaaccaccacgacacatatttacctatgtaacaaacctgcacatcctgcactttacccctggaacttagttgaagaaaggtaaataataaattgttcccttagaccaaaattcaaatgctgccatgttactcagttttccaagcctcctcttggtttcctcatacataaaatgccatcccctttgctgtcttactaatgctgaatcatcagcaaaattgtgagctgtgagttaacttgccgggatgtctttacaattttgtattggtttcatccattcaagcgttcactcaacttgtaatgagcatcagttacaaatcaagcacaaagcaaagagctgggccatgagtgggtgaggcacaaagctgccttcaaagagtttgtggtgttgggacagcaaagctgttaccgttgttatgatcctgactgacggctgggacgaagatggacagggactacaagtgggcagagaagcgaggggccaagatctctgtcctttgagggtggtctccttccagtaaccctctccttgcctaccttctacttttccttattttaaaaattcttgttttgccctgacaccatgtaagccaactagaagttgtgtttcctctgaaagctagatagtgaagaggagctcattccaacagcttcctttgagagtaaatgctgggagattaaataggctcccttctttgggtcacctactggcacccatctttgggattcatatcattttccagctttgcaaacacagggggcttctcagcaaactgcttgttaggtcctcctttagggaaacccaccctaaaggtggagagaagagatggataagtgtggacagttcctttctagccaggttcacaggtttctctaactacctctgaaatatatcttaatttataaaataagccatttagtgctttgcagtttaaaaagtgctttcatatatatatatgcctcataacaagtctgccagctgttattagccattttttcatctttaccatgctaataagcacagtggccaaagccacacagtcagcaagcagtggagctggaaccaaaaccccagccttctccctgacctaccaatgtctgactttcaattgcaccttactgcgttttctaagcttatctgtgagatggatgttatacccatctcactacatcaaagactgtggctcaaagagtggtaaatggtttgccagagaccacatagttaaatataagtagaggagggatttgagtccttccagggtcactacatggacacttttatgctggggttctcagatgcattctctggaatccatgagttcataatgcgaaggctttaatttctatgataatctgtagcaagtgaatataagcttattccgatcatttatgttgatggttctcaaaatgtggtcatctgaccagcagcatcagcatcacctgggagcctgtgagaaatgccaattgttcatgctcccccacccccaaaactacacaatcagaaattctggggctggggcccagccctctgggtttaaacacattctccatgggttctgagacatgcttaagcttgagaaatggatctagatcattccctctcaacttggctgcccctcagaattacccagggagtgttttaaaagattccaacttacttggtcggagtatggctgagcacgggcatttttaaagtctctccaagtgattccactgtactacggagtctgagagccactcatctaaaggacaccttgcccccaaagtgtccccttacacattcatgtcctgtttgtgttacagtcatgctggcaccagatgagctgctgcagactcatgaggaaagagtcaagacaggctctttgaaacctccctctccaggcatgccacgtgaacagaagttccaggagacagaagagaggggtgacaagaaattgccctgatcaaactgccacagtgacacaccatgaaaaacacacagagattggctctgtggcaatggcatcatacccaggtcacaggtgcaaatttggtgcagcaaagcagcattaaatattttgcattaaattgatgttaatttgc

SEQ ID NO: 414 - DNA, 22767 bp, Homo sapiens
gcaaaagttgtggcaagtccagccggagttagcgacagggagggatgcgcgcctgggtgtagttgtgggggaggaagtggctagctcagggcttcaggggacagacagggagagatgactgagttagatgagacgagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattacctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcgtcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctctggatgtgagcattgctttgtctgctggtgactgaacatctctaccttgtgtcaattggccatttgtggtgtgtgtgtgtgtgcgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttgtcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctatgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtgtatatatatatatttaatttcaatggcttttggggtacaaatggcttttggtcatatatatgagttctacagtagtgaagtctgagattttactacaccttccacttatgtggtcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtgctgaccccaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctgtgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctcagactgtgtgtgtgtgtgtgtgtgtgtgtgtgtgtgtgtgtgtgtgtgtgtgtgtgtgtgtgtaaaagagagaagttgtggagaaatggggggctgattctgctcagattcatcaggatgagtagaaggcacccagctctcaccctggcctgacatgtgtgtccctgagcaggttacagtcctctctgagcctctgcttcccatctggaccctgctgggcagggcttctgagctccttagcactagcaggaggggctccaggggccctccctccatggcagccaggacaggactctcaaatgaggacagcagagctcgtggggggctcccacggacccgccgtgggcccaggggaggcagagcctgagccaacagcagtggtgctgtggaccgtggatcctgagggtggcctggggcaagtaccggctgagggtccaggtgggctttgtgtacctttgggtcctggggccctggtgacttggactccaggttagagtcaagtgacaggagaaaggctggtggggccctgtgcttccgacttcatttcgagtgatggcagttcccaggaaggaatccacagctgacggtggctgacagatcagagaatggaaggcgaggcaggcgggcgtctgcgtgacctcaggtgcttggggcccagcagacccagagaaccatttccactaggccagggtgccggaagtgtccacaggtcttagattccctgttcagatgaaaagatttgtgcctttaatgataaaagtgatctgcatagagtcaaaaattcaagccatgggtataaaatgcaagtaaaatccctgccctcacctatcccaccctactacacagagatgtcctctcgagtttcctagactcactctggaaatttctgtatacacacagaagcttgtgcctctgctcgtgaaggcagagggagggagagctgaagggccagcaccttctcacctgtgggccccctcagtgctcggtcccagagcatgcaggactgtgcctcgtgttcagtttgctggtctgacttcatgctccttgggcaggatatgcatgtgccatgctaggagacatgtggatgtgaagctgggggacaatgtcccctggctatgcctttacaagggaagtaaggaaggtaggaggtgagcctgggagggagggagggaggcgcggagccgccgcaggtgtttcttttactgagtgcagcccatggccgcactcaggttttgcttttcaccttcccatctgtgaaagagtgagcaggaaaaagcaaaa

SEQ ID NO: 415 - DNA, 117054 bp, Mus musculus
gtgtcatgcaagaaggaggcggcggcggcggccggagctggagggggaggaggggaggaacctgatcctcggtagcgaagggctggaggcaaacaccgagctccccctgagccgcctgggagcagggagggttctgctaccctgaggggccctccccgcggggcagagggtaagtggggaggcgcaggtggtcgccttgggaagggagcgcgcaggggggttaggtgggacggcgggaccgctaggagctacccgagccccaaggagtcaagtgtccgactaataggagcccaggctatagaagagttggtctgccagtagcagcaagaactatttgcctaatgacagttgtccttagccacacggtgggtggagttgtagatcccgaactcaggacccatctaaaggcaatgattcacggttgcaggaacttaatcccagcagccctggcgctgtaggacacccttgaaatgaaaaggccaacacaccccaggttcctctagcctttctggactttctgggttgtcttcttcaaatctaggggaaaggctgggaaactggcccaaccccactttagccacaaaaataacgctcttggccggtggccctagacaagcagcctctggtgcaattaaacaatcaataggaaaaagcccaccctcctcccttcttcaccagctccttccaccaaggtaattcatggggcttaaaggagaaagaaaatgtggtatatgttgccctatccaagctgtcagtcagtctgccactacacaaatggccacctgtacactccagggttcaccctgccttcagagggatgcttgtgagagacacaacaatactgctccaggtagcaagaggagaccaccttaaactcccgacaatttcacctccattgccccttctcccccctcccccgccccccaggggaattggaaacctagacttgagagcaatgaactgtagagacaggctgggcacataggaacactgctctttcacctgcccgcagttctcaggacagcaattattgttattattattattattattattattattattattatcttatgttcctttccatgtccctcctggaaatctcaagaagcactttctggaacgttttaatgtcagtcgtacatttagaagtaggggttgaggggattaacggaaaggctaatgactgtctcaaaagcacatgcggttgctagggaactcatgctcgtccctgctctctaatcaccagtgcgttccagggaaatcaaactgctcggggtgttattaaaatgaacggcatttggttgaaggcttctttgcttatgttgtagcatcctggattgttatcgattgcctcacacccacataccttgttttcctaatttgatttctgtatttgcgtcactgccagggacactcagactagaccagtcaggttcacttcctgtttctcagaactggtttatatttggtctctgtgctctagctggtaagacattatcacgctgatcctcttggaaaggaatctttgctttccgttgacaacaaattatcccaattaaatgctaattctcgtggaaaacgtcattgtaggagggttaaggcactactgggatactttattagccatttgagaaagccattcttaacatgtaaagcaagaaaaacccatcccccctcctgcccccccccaaaagaaacttcattccccagctttggaactaaaacaaactcaagaagagaaaatatttaaatatgatgtttccaaaatgaagcatacagaagtacacattgaagctggaggaatcatttgactaaataaggcgtagaattgaattcattccaggcccaggaaggacaaataagcgtgggttggcattgtggcccggagagtacaaagtgtgactgagaggctactttacaaataggaaatcccatcaccttgtgaactaaatgtctcctttactgattcccctatgtccctgataaggcagccttgctttttatatttttgcttcgagttccttcctctttataacaagaatatcaccaaggcaatagcagaaagataagactatgtaaataagtaggttctgatggagataatttgtttgatgaaaaataaagcacacatggcattgaagaaagattggtttccacttcggtgcacagaggtgagcttagggcagccatcttgggtctttgcatgtccgtatcccaatggaagcttctagagatctcaatgttgatttcaattttaatttttagctgttagatttttttttaaatgtacattggtgttgtgcctacatgcctgtctgtgtgaaaagacatgtatatctgcataagggtgtcagatcccctggaactagagttacagacaggtgtgagttgccatgtgggctctgggaattaaatccgggtcctttggaagaacagccagtgttcttagccactgaactttctctccagcccctagcctttaatgcctagctataaagattgggaatttggggtgtggggtgctcatgtaaaaggtgatttattgttaatacattgagttttaatgtcagttgccacataagtaagatctaccttgtttcctatgcatttcttctctcttcgtcttgtagtggtatagaagcaacagactgaaaggtgcaagagtttgtgagactaaagacctcagttaactccagatgcaattaacccctaatgcctccatcatcaaagtggagggatgatggaggaaggatattcaaaaacagttatccattggatcctgatgaagccaaacatctatctgtgcacgctttaattagcaacagatagaaacacacccagttgtaatgtagaacccctcaaattcaacacattaaaaagaatagtgtggagaaatatgagatttgtgctggaaagaaaagtcctgactttgaaacccaactctgttactcaattcattattgagtgcttgctgtggccctagaaatacaaggatcaataaaacacggctaagatggcctgcaggatcttctaccgtgaggaggcacatgaaaacacagtcagtcatacagtagtgagatgacatatacaggggaactcaaaggaggtgcttagctacagaagtgagcaaaccaaccagaaaaatataataaagggagggatattccaggcccaccccactcaaagcactgtatgtcaagaatttaagatttaaaaagcacattcacggagctgagcctagaggatggtgtccagcaagtaaaagatgctccacaaatatttacatcacatgaatgcatagcagaagtctggaaagataagcaggcttctgtgtagtgaaaggctttgtctttcaaagacgtttgggattactctaaagccagtagaaagctgttggttaatatatattgcgtatttatgtgtacccgagtgtatggatgtacaccacttgaatgtaggagccagaggagatcaggagatggtgttaggtatccatggagctgaagttacaggcagttgtgagccaccgtgtgggtactgggaaccaaacttgggttaatttaagttaattcattttaaggaacactctgacataatcacatggccactttagaaagtggcatactttgatagtgacactgtaagccaggggattcgttaaaagtttgtctcggaatcacaagaaaaaaagggggagggagaacctcttaaacgaaggcagcaagaaaggaaatagagagagagaaaggattcaataagtaaggcaagtgattctgattattgattgtctctgcatgattgagagatggtgggagaattatgatttaggtaaacaggatgacaggatggcaggatagtaggagtatcagtcaccaagagagagaccttaggaagaaaagtaggccacagagagcaggaccttagcttaattttaaacctactgaggtgaagtgcctgtgggatatcagagcgaagctgggtgctgcttaccagaggaagctgagactcaggagacatctgtgttagcatcatcagagtaagtgagagtccatagttgttcatggaatcccccaaaagagagggtgtagaggacaagaagagtcatagcaacaccattgaaaaaggcaaggaagggcaggtgcagggacagaatagaaggtagaagcaacaggagctgcgggtgttagatgattgtgtagctgctttgggaggaccagagagctggagataaacgaggactgaaaagcccttggatttagcaacagaagtcatttgtgtatttggcaaaaagcatgttggtaaatggtgaagagtcactagtgaaggatggaggagacatgagaacagaggaagtagctagaggaagttctctcagataggaagcactaaagggtacgccgagagcgagatgaaggtattaagaagagagtgtttgaattcatgggctgtaaggctaaggatatagactaaaaaaaagaaaaagaaagaaaggaaggatgaaggaaggagggagggaaggaggagagagagatggagggagggagagggagggagggacagggagggagagggagggagggagggggagaaagagagagagaaagagaaaaaggagaaagaagagagcactctggattcttctaggcttcttcaaattaactatcatcataccaccaattacttgagtggaaaaataatatgaagattgtcttggttcttctgtttttgtaacttgagcatccatctcttgaggacttcaaggcagctctacctccaaaacatttctcaaacatactctttctgtctcctttgctactaacttaatccaaaccagcatcctttctctatgctcatactgtggctttctttaaataataataataataataataataataataataaaatgacacatgtctcatttatgtgttcttgaattggtctcaaagttgtgatcctcctgtctcagcctcctgagtgttgagattatgtgtatgtgccatcctccccggctctaaagcagtggttctcaaccttcttaatgttgtgactctttaatacagttcttcatggggtgatgacccccccaaccataagattattttcattgctacttcataactttacttttgctactgttacgaatcgtaatgcaaatatctggtatctctgaaggtcttaggcaacacccatgaaagggccatccagcatccaaagaggtcacagcccacagattgagaaccacggttctaatggcgttttcttgtagccatgattgttctttccagcacacctagaccagtgattcaaaccaggcatcttgagacataaaccatagcatgacatatggttctctccttaaaatccttccatatcatctacttgtacttggaatacagtccaagatccttttctggcatcccatgtcctgtgtggcatcctagaccagttctcacagctcaatgtcccttcactttctcatcatgttccaatcccaccaagttctgaatgttttcttttcctgagatactcttctgatgcttctggttttctttgaacatcatcttctcctccttcctccatctgaagtatcctctcctatccctcttctaatctccaagcgcagtttttcacaataatattatgaaagccacactaccatttgctttatttcgtatagttgagaacttctaaactgaaaactcagtgaaaattcttgccacatagttggagcttaacactgtccactgggtgtttatagagaggtaagggagtagcagattaataaaaattagagagaccagaaaccaccttccagaggcaggtattagggcacacacctctgatcctaccattcaggaagatgattcatggagatcatgagttcagggccaatctgggctatatagtgagacccttgtctcaaaaagaaaaagaaaaacaagtcagctgcaaatgtgttgaggaatgagccattgatggtgatgtgctaggcttgtagggtttcagaagtagaagagtttacagctctgctaccctgggcattgacattctctgaacctcacattatagttagaaatactctgtacttcagtgggctgttaggggaatgaagccagaaggcataggtagacgataaagagagcttgtcatgctcttttaggaagtcaggagttctaagggccaatctataacctccaaatgtgagtcccctgtcatataactcttgatacttacttattattaggacaagaaagtgagaagccattgagaaaagtcagtgattaaagtcacttccttccaagccttgtgacctgagtttgattcatggtacccatacagcagactcctaaaagtgccacagcataagtttggtcccctccccgacaaacacacaaataactaagtgtaataaaaagatgacaaaattgcgacttaaaaaaaaaaaaaaaagatctacagccacagaactgtttatgactgaacctagaagttagttacttcagatgagatcagtaaccaacccaaagctctaaaggtgggcgaagtatatgacagacagattgaaaccaaacaaatacaaaaaactaaattatattagaatgtccccttgctttctcaacacaggaagcatgcccattgaaaatgcagtgagataaatttttttggtatctggtggtctgggcagatggtaaagcagccatgttctcagtaagtagaagggcaatgacctctgtggaggacatcctggcagtgtttatcactttttgaacatacaaaatctttgacctcacaagtctacttctatatctttacccaaaatagattcacaaacatattgaaagatgactcttccaagacctttactaaggcattatttatagtcattaaacactgaaaaagccatcaatagagaagagaagtggttacatacagatcagagtggtggtaggagggaaaggtgggcagctgttaaagttggtgcaacactcctgacaaggatcagcctcagcctggagaggggtcctgagagaaggggtgtttagaacggcaaaacaaacgactaggagtcaatcatgggtataagctgatggtctgagttctgcttgagacagctttctccagatatctccacatagctcatccagatagctcagctctcctagaacaaggcccagtgtttcatttacatatcaattcagtcatttaggccgggtcccttgtatttatccctctaatcagcattccgtgaccccagctccctgattcttagaaaatgacagcgagaatttttttttaacattgcaaatgaatttagagacctgcctgcctttgtaagcacagacaatatgtttaactggatggaatctcacactgaaattactattcccaccatacctagacctagacctaaacttgccctgtcccaggctgaccttgaactcgggaatcttcctgcctctgtatctgcttgcctttgaatctttctgacgagctggcttagagtgcagctgcctctgttcttttggttctgagaagctccttacacaattcatagtgcatccttgtattttgcatagttgagaaattatatacttttgaactcatgttttcagagtttgtttctacagccttaagggctctcctgaagggcatagtgttctaccattgtgctgagacattagacacacagtcacatcctggactcttgctgtctctaataatcatggagtcagtgaccttggcagagaggacattccctaataaccttggcagggaaaatagttcctaaaggaagaatatgaagatgcacacacacacacacacacacacacacacacacacacacaaacaagcttcacacccagcaactgttaacactcatggaggaccacaccctgccggctctcttccaggagcaggatacatgtcacactgtcccttccaagtggcctttcagtacatagcacactcccagacatacccatgggaactgagcttctcaatacattactaagtaataaaacaaaaaattagataaagaacaacacatatatcttgctgccatttttttgaatgggagatttttttttttttttggtctagaatgtattgtagggtgaacaggacaagagcacatgtgaagaggctggtctaaaggatgtttcaaagacatgtgtgagaaaggatggctgccaagtgaggagggtggcatgaaggagccaagaaataactaaggcccacagagctgtttcaaatactttaatgacaggcaggacatggtgagtgacacaaatggagacactgtcactgatacaatggacttgaagatgtttctgctaccttagaagataatagatgtgtgatcagatgtgtgaccagagtctcagtgactaagatggggaatcttgcaacagccataggattgaggagacaattagaagctctgtcccagtgacgatgtctaccatagacctgaagataggagtctgaagctcagaaaagctacagaagtttcatttgtgaacttaggagatcatttgtggtgggcaaaaataagatgaaataaaataaaattaaaatatgttcaatatagaggttgggtagaaaagaaaattggcaatggagacataaagagaactcagagaagtggaactaagggacaaaaggggcactgggctcagccctgtcaagaaagattagcacagctcagcagtcttcctcccgagtcctaatgtctttaagagttgggatttttttaaagacatttttgtatgtccagtgtctcacacataataaatagccagcaaatttctgttgaattgggaaagtgacagaaatacacagacagacaaagactgtagaatttctgtgtggatctcagaagattaatcaatgcaggctaaggatgaaggtgaggagtagaacttatctactatgtagatggccctggctctacctcccagcaccacaaaataaataagtaagtaaacagataaataagactcatttgaggttcaccacaaggaaccttacttaggaaatagataatcctgtgttctttgttttactcgagagctaacaggcagattaattgctcacggaaccacactcctttctagcaagtgcctcctcagaactgcgacaaatatttcctcgtgctgggccacctaagttacttttgtgtttctttatgtcctagaggataataagaatagtttatttcaccctatccagagtcagtgtctctcagcaaatccattttggggtaactacattagccactcttagattcccagccttaaattcctacagaaagaaagatgactctaggcaggaagatggtgaccctcctagatgcatgcccagtgtctcattctgccactggaccatgtaaccaccaacagaagagcaagatagtttcattctgagaatgtgggaatcactgacagaagatcacgctggcaacagaggtatactcagttctgagagcagttgtctgggatgtgtggacagaacactgggttcaaaccttaatatcacacaacaacaactgcaaaaccaaaacgacgttgaatgcactgttaaggcctgcactagggaggtggagacaatcagatgcccagtgaacactgggccagctgaggctgcataagaactagggggggggggagaggggagagaacataattacataattgattggaaactttgaacatggagctggagaagtggcacttgctccttactgcagagccaaagaactccattttgaatcacagtgcccacatcaaacagctcataaccacctatggctccatcaccagggtatctggcaccctcttctagcatctaagagtactggaacacatgaggtgtgtgtgtgtgtgtgtgtgtgtgtgtgtgtgtgtgtgtgtgtagataggtaggtaggtagatagatagatagatagatagatagatagatagagagatagatagagagatagatagatagacagataaatagatatattagtaaaagtgaaacaaatctaaagaaaactttagaaactaaaataatagcagtagctttaacaatattgaaaggcttatgacatcctaacattattatgatcagtgattagcaaacgttgcctacaaaagatgagatagaaaatattttaggcttctctgcctctgtcccaaatcctcaatgttgtcactacagtgtgaaagcagccatcaaaatacatcaatgaagctgagtgcagaggacacacctgcagtcccagccccaggcactcagaaggcagaagaagggaggaaatctcgggttcaaggccaaactaggttatatagcaagatggctggaagaaggaaggaagggagagtaaaaaggggatattgaataagtatggctatgtttcgatgagactacttatggataacaaaatttagatttcataaagttctcccttgtcacttgatttcaaccctcttttaatattttttccaaccattttttatgtgaaaacaattctcagtttataagccacacagagagagtgtgggctgcagatgggctgcacaaggaggggtttttcaacctctggtttagataactgtgaaatgaacatcttgccatgagaaaaactgttcacatctgggcttccaaagacagaaatttgcttcgtttccatatttttcacctttcttttcctgtctccattctcttggacatatccatctgttgatctgtcccctaggacagttgccttcgtgtgactcacttcttccttgtaatgtacctgtccgtaactgttgcaacactttagccagcaatggacccatatgtgataatggtcccataatatcataatggggttgaaaaagtcttgttacttagtgatagcgtagctttcagagtgctggagcaggaggcattatcaacatgggtagggtgatgctggtgcctgtaagtctgtacctctggtcatataaaagtgtagcaaacagtaacatgagggaataacctgatgttattataaaggaccatagtatgggcttatgtgcttattatactatactttctgttactttattattttagagcatattccaaccaataaatatgatgtctgtaagacagtgtgccgtgttatagcagcagcaatctcataactttttttaaagaatgatttaatataagtttttatttattatggtcctgtgaacaatatactgtcttatatgcatgttagtatgtataagacaggcatagtatattatatgttgtatatataatgtataatacaacatatatcatgtagccaggtgaatagtaatctatacagtgtaggcttctatgaatactctcagtttaccaaacaacaaaatcacttgaggacatttcttgaatcatgtcttcatcattaagtgactcttaaatgtgttttatacaataaagaattcttcctagttggctttataaatacataaaactgagataaaacataaatactaatgaatctagttatttttctattactctgatgagataccctgaccaaggcagcttatggaagaaattgtttattgcgggtttatgattccatacggtccatgaccgtccctgttgggagcttggcagcagacaggcaggcacggagccagagcagtagctgaaaacttgggtcacaatcaggaggcaaagagagagagagagatcatactaggaaaggctcaaatcttttgaaacctcaaggccttcacttggtgacacacttctaacaaggccacacctccttgtcctttccacacaattataccaactggggagtcaacattcaaatatatgatcctatggcagtcattctcctccacagcaccatagtgtgtttgtgagtgtgtctgtgtagctgtgtgagagtgtccctgtgtgtgtaggtatgtccatatgtgtgcctgtgcttacagagttatttcttaggagccttccaaggtaggtcttcgggtccaggggatgggggtgggcatggttgttgtttttgcatttctggctttgtttttttgttggtggtggtagtgatttgtttgtttgtttgtttgtttgtttgtttgtttgttttgagaccaggtctctttggtaccttgggctcacaaaccagttctacaaatccgtctttcacaccttcccaatggtgggataagaaacttgtggggccacacatagattgttttatgggtgttaggggtcatactcaggtccccatgcttgtatgacaacaagcaaaaagcatttcaccagctatgcccaactcccacaaatcatatgtgtgttgatttttgttggtgttatcattagggcttatttgtttgtttggttggttagttggttttgttgtttcttaagacagggtctcactgtttagctctggttagcctgaaattcactgtatagaccaggctgacctagcactcaagaaatctctctgtctctgcctcccaagtgctgggatgaacggtatgtgccagcacactaggcccactaatgattgtcataattcttttatcagatgttaaacatttgcttttacatagtcctgtcctgggtgtcatggagataaaagagggttggacatggctaggcaggtatgtagctatttagaaaatcaagtggctggaaaaaaaaatcagtgaatattgcctgggtttgtttctgtataaatgcaaaagcagtatctttagaagcaactgaaggcagcccgggggaggggggggggtgttgaggtgtaagctcttttgcatcccagctgtgtgaccttgggctgattatataaaccatatgaatttcattttccttaattcaaagtggggataataataactgcctacgaaggaggttggggattaaataagggggtatatataaatcacctactccttgggacacagggaacaactggtacgtttcagcagttgttgctgtggagcaacataaaggtatacagcttcttcgcacacgagaggcacagtcaggcagggcagagtaacctagaagtcagagtcacagaccatgtctagaaacccacaagcctcataaggaacatttgggcgaaaataaaagcagaagcgatattgtcaccggagcattccggtaaggcagctggccagttgtccatagcaaccagctgctgagttgcctatgaagctccgcctacctaagggcctagcttcacagcatccctcaccgcagcacttaaatgccaatcgtaactgggttgaaaaatacatgattctcccttccaaacagacacctaaaggttgcatatattatggtccctactaattctgagcttcggccacacaagctctgtccctccctctgcctttgggcgttgtgtgtcgaacgccagtcttccgccagtggcctgcttctctgagcactagcctgtttcaccatggctgaatgtcttgttgatctcagctctgtctagctgccatgcacaggcatctgtattctactgctgacaccagatgtgttctcccccgtgaggcacattgcaggtgccctcatgagagacctgctagaataaggctgatctccttcatgataaaagcttcctgcgtttttatcgtggtgtgagacaacaggcctttcacggcccagctttcctgttccaggctggcctctgtattcactagcaatgccatatggagcactcctactccagctttggttcctaccctctctccattggctatgtattatcaatttctagcgtgtcttgtgagccttcgatggcaacatcaataatgttttcccaatacagatgaccaaattagtggcacagggacataacatagggagtaatggcaaacttcaatttatatagaatcaactgacaatatcgttctgctgaggagcaagcattaaataaagttggcacaacttgaattccaactaattccttattgaagagctgctattccatgcttaattcctaccagccaagaagaatgtgttggtgaaacagaagtgacaaacaggtactgctgcaccctggaaatggaaatagccagagaaggcagctctgcactcagagccagcctggacgggaataagaaagcatgcgcgcgcatgcgcagaacctctgcctggccaagaactaagaaggaaagccttagaggggtaaaaaagtctgcagaaatacacttctgtacaattcataatgtcggtaatgaaaaggagattgttaaaaacaaaaatcggtgtggttacttgttcaagaaacagtccaatcagctcctgtttgtttgtttgtttctttctttctttctttctttctttctttctttctttctttccttccttccttccttccttccttccttccttccttccttctatctttctttctttctttctttttgtttgttttctgagacagggtttctctatgtatccctggctgtcctggaactcactctgtagaccaggctggcctcgaactcagaaatccacctgcctctgcttcccaagtgctgggatcaaaggcgtgtgctaccactgcccagccagctcctggttttaacgaaggaaaaaggcagagaggagggagtgcgacaaatttgcttaatgtggaacaggctgcatcctgagacctcaggcaggagtaagggatagagctcagttggtagagtgcttgcctagcaaacatgaagggaagcctttggttcagtctggtgatgcttgcctgtcaccccagcactctggggaggcagacaggaggacctgaagttactcttcagctatgtaacaagcttgaggccagactgggattcatgagaccctgtttcagaaaataaaaaataaaaaaataagaacaaaattaaaagattcccccccccaaagatctctgatcccctccgtagatgcctgaagccacagagactaagaaactctatgtgtcctgtggtccttttcctatgcatgcatatgataaagtttaattcataaattagggacagtagccgagatggcagtgtattagaagagatgttatttaaaacctatacgttgtctattttaggaatgttctagttgacgttttgggataacggttggaagcataactgagaccacagcggggagaatagatgaatggactcactgtataaatgggccatctcccatttatacgcagggctcagacctgtacgagcagtactgggaaggctaaggtccacaggcagctggagtctgggaaagcgctgaagacaatgaatgggtttttttttttgtttgtttgtttgtttggcggagccagacccactgtcttgtgcgtgctggtgagtgtcctgaccctgagctgcttgctttcccagctcattcgctttgtttatgtccatggtaaagaataatggcggagtcatactgctgaatggggcaggctaatggcgctgaatgaaaattggctcattcactggtagcttttcctaggtcctacagcatagctcctttccctcacacattctccttcctagtcccatccttcgccacctcttcctcctcctccccggggtctcatgctgggcaggggggatgactttgaacacatggctccacctatgtctgcacccccaggtcttggaattacaggcgtgaagaagcactgtagtgagctgtttggcttcattgtggtttgtgaggtttttgttttagactcttgagacagggtcacactatatagcctaggctagcctcaaactcaaggcaacccttccatctcagcctccccagtcctaggattataggcctggcatttggtgctagggattagactcagacacttattcatagtaatcatcttctttatcacgaacctatgtctttgtgatatatatatatatatatatgtatatatatatatatatatatatactcacacacacatgcatgtgcccatgtgtctgtttatatggagagcagatgtcaacattgagcgacatataccttactttttgagaccaggtctcttccttgcctagagctcaggtatttggtgaggctggctagccaagtaccagggagccacatgtctctttatccccagttctgaggttacaagcacttgacactgtgtctggctttttaaagacataggttctggccctttctccctctctccccttcccctctcccccttcacatgttcctggttagcctcttctctttcactctttttctctctctgaccttctctgtcccccctctctgtacctctattcccttctcaacactcttaaccatgcccccaaataaactattctatactaggaaagaaaaaggcataggttctgggaatcaaactcagttcttcatgctaggatgacaagcactttaccaagactccccagtcctctctattgctcaactctgattttactgtgtatagatgtgtctaatgtgagagtattttctaaggaagctcaccatcactagctgcctcacagcctagtgcagactggctctagaagagaggaggtttgaagtcttgcacatctaggtctgttgggatcaatagcttctgccagagaagggacccacttttgtgtcctgaaagtggtagctctgccagtggccatgccagaatgttggaaagagtcagacaggaactgggaggccatgttaggaagtaaatcgtcctgtgaaggatgaagagatagtcacatgagcaccattgatgagaaagcattgaaacagagcaaatagtagagacatgactgaagccagaaagcaggctctggtcaaaaattcccaaggcctccatgtctttaaaaaaaaaaaaaaggaaaaaaatcttaagacaatgacaagagaccattgtgagctgagtctctctctctctctctctctctctctctctctctctctctctcacacacacacacacacagtctctctcattctctctcttataatactctctctccctacctacttctgtccctcccccaccccctctgtgtgtgtgtgtgtgtgtgtgtgtgagagagagagagagagagagagagagagagagagagagagatagcaagagtgagtggagggggaatgtgttttggaaaggtcaacatggagcatgaggggacattatctcagatggggtcagatagtggcatgccctcagcaggacattttgaactattcccagcacactggagtttgtgtcactgtgccctgccacggaacataatcaactgggtgattgacttagcgccttgctgctccagggtccaacttgcttagctttgaccccatggaaaggcttctctggggaagtcgttagagctttggaaacacaaaacagaaaaagacattgcagagtggtcaagtgaaattctggtcagtacgtgcctatggcagtcagagtggtctaaaggtcggcaggagccagaaacagcatcagaataaaggactggtttggaacatttgttgtctagtccatctttggaacctaggataggagaggaaaacagacgttttgaccttgatcatggaaaaacttgttccagccacaaacaatcagacctttagaagccatgatgtacccaagtgattcattcgtaagcaacatgaccttctggggagaggaccacatcttttctgccttcaattccagtgtctgcatctgcaacattaatggaaacaaacacatctctgaatggcagagcacttcattttctattgcagacaatgatccggatgtaaggatacagccttagtcatccttttaagtgtgccccatcccactccagctgcctcttccttgccgccccttggagctctctttccaccttcttgcccagtggatacagccagccagtcagtgaagagcatcccttaataaaggattcaagtatggacacgtgacctaagttcctcgaccaaagagaaggtcaggacttgagctaagatggctgactggattgggatgctctcctggaattgaacgcagcagtatgaaactgagagtttgttggcaaggttgtgagaccatgagggaaagactgcagaatggaactgtcccctggacctaaaatgacaggggagttatcaggtcctgtccataccttccctggtagaatgtgtggtttacatgtataaagtggtggcttcaatacacagtgcttgttaaccaaccagtcagtcaataagtagtaagagccaggtgctttgtgcctcttaatgcatcagcacgaaccttaaactgatataactgcacggatgaagccccagagaaatgactaggctcattctctagagtgagtataaagaagtatatgaattctagggtgcaatggagcatcgtgtgtttaaaaccttacttagcatatacagtaagacacagtggcccaaacctgtaatcctagcacctggggaactgaggccagatgatcataagttcaaggccagcctgagttacacagctagaccctacctgggggttaaaaaaaagaagacccaataacagcaacaatgagaaccctcttaatatatgtgaaccatttaatggttaacatgggattttcatttctcaagcctttctccaaagaaaataatcagacatgctcataaaatttaacgtggaatatttggtgatgcattctctataatatttggaaataacctaagcatctagaaggagccattgtatgaattgtgagagactctgtgacagaatgtaggcacaaaataggaagcagctttcagaaggtgtcatgacatcacaaaatgttgtttggttgcatcaaagcatctatctatctatctatctatctatctatctatcagtctatcaatcagcagggtctttctatgtagttctgacggtcctggaactcactatatagaccagtctggccttgaacttatagagatccacttgcctcctcccaagtgttgtgtgacaccagtctagcctggcttggttacttatttttaaaagtgttttctcaaggggagctagagggggagaacagactgcagagttatacagtacaatatatgtagagagataataccttggtagtggaaatgagttcattttcttcgtgatttctgtacattctaaactgccttggtattttagatctacatgcaagctcttataatgaaagaaagaaaaagattcatgaaaaagaaacttactatgaaatgggaacccatgatgaatgaagggtaaatttaaatgagatttaaatttcaatttaaatgaaagattagaatttaaatgaaactcaaagcttctgatccatacatgctacaaaaagagtttccagctatgggcgtgctgttcagaattgcttaggagggaagtgccacgtgcctgggattacgcaactttgctgaaagaaagaaagaaagaaagaaagaaagaaagaaagaaagaaaggaaggaaggaaggaaggaagaaagaaagaaagaaagaaagaaagaaagaaagaaagaaagaagggagggagggagggagagagagagaaagagagagagaaagaaagaaagaaagaaagaaagaaagaaagaaagaaagaaagagagtaagaaagaaattcctggtttttatggtttttttttttcatttgtttttagtcagagtcgtgtcacttagcccaggctggcctcagacttgagatacttctgtctctcaattctcaatcactaactttgcaggcatgttccatcaggtcctgccaactttgcccatcatttaaaaaaaaaatagtgaattccagaccccactgactgataagctaaccacttaggaaaagaaaggcggcatctacatgagccagcagggggttcattgaagttaagtgcttgtaaagaacgctgatttcctcatcccacgtgcctcaaccctaacctcaaagtcctccgccagacctccgtggtgggtagtacagtgttcccctagggcggaagctggaagccttagatgtcaagtgcttggcacgtgatctttcctccactcacctccggtccctccattccctccttcccttcctcctctctcccccctctctcccgctcagtagttgaggttactaggtgggaagagctgaggcttatgtgtcataccaggcattgtagagagattttaaatgggatcttaatagatagtatggtacggtattatgccatagcattagatgaaatgattacacacaaaaattgcagaataataaaacctggtttactgggaggtttcgaattggttatgataacaattgcgcttaccgtacgcattgcgcttaccgtacgccaagttctatgctataatgctttccatccgttatgttccccagtgcggggagaagtagctgttatccccattttacaggtgataaaaccaaagctgggagtggcatgtgcccgtgctcctcgttatgtattagtaagcatgggagttgagacggagtcacagacaatctgagcgtggaacccgtagtggaatcttacatcagtatttcttcatttggtctatggctccagtaatggctcaattcatttcttttactaaaagaaaggtttatttatctgagaaacaactcaaaatggcacaagagatgggaagagaaagagagcaataaacccagagtactgatcatttccacacagaaccaccctgctctgttagcacttcagaactgctctatagtatagacaagtagacaagataggatatctccctcaccaccaccccactcctcctgccccacccccacctcctgctctcagatgacttgggatcaaaaaaaaaaaaaaaaaaaaaaaaaaaaaaaaaaaaccaaaaaccaaaaacaaaaaaccactgtgctacttaacatagccaaaatacaaatgtagactcccaaacccttgttgctttaactactagctaaataaatgtttggtagtagtttatttaaatacaagatttcgggggtggggagtaaatgttaaatgtgtaagtgtaagatctggttggtttgtcaacacatatagtgcagatagatctgttgctgggtttgatggtgcacaaatgtagactcccaaacccttgttgctttaactactagctaaataaatgtttggtagtagtttatttaaatacaagatttcgggggtggggagtaaatgttaaatgtgtaagtgtaagatctggttggtttgtcaacacatatagtgcagatagatctgttgctgggtttgatggtgcacgccgagacaggaagacttgggtggaggctggcatgggcaacagggtgaaatgttggctcaaacataaaccggacctcaagatatgagttgcctatgtggcaccacaagccagcagtggctgtcagaacatccctgtcggttttcgttactatgacaagaaaaactatgttctggacagaggagatacccgcttaggtgtggacactgcttataccagctgtggacagttgcaccagagtgccaagctttcaaaactcctttgacacataaggctatgaatatctagagggaaacagccagcaggcaaacatatatattaaactggattatttcatagaagtagagtaactgggagaacctggttttggggggggggagctaaaaaccctcagctagagagaacagtgctatatggaagaatttttttataatgcaaatggggtgaaaggagagacatctgtctttggaaaaaggcagatgtgagatggcaaatgaaaacccaaaatattattgcactttgcatattgtttaggggacataagtgctaagcctgagtagcgggcactcaagaaatatactgaactggcttgcaaaaactcaaggttgtctcgggaccagaggctaggctcctgtctttacaaacgtggccggctcctggatttgaagcttgtgaaacctccagattctggggttacagcacacacagctgccatgcctgcttatgcatgttacagctctccatcactgaagctatgtatctccagcccctcatcctgaggtctaatgacaaagcctactgcactcctcatcctgccccagggagggctgttgaccccaccccaaggaaggtcacttactgtagaccccattggtccctttcccatccatctctctaagagctccttttcagactcctcttttggctctttctttaaccactggctgcatccttttcttcagggttctgactcatttgtgcgacatctccaggctatctcacaggctatgtgacacacctgatctcttacattcctgcagttctctgcccttgttttcagatttcttccttcaccgctgccggcatcatgcagtccctccaagttccatgtgctactagtggtacttggcacttgctccccttcccaagtttagcttttttaaaaaaaatgtatttatttttattttatatgcattggtgtcttgcttgcatgtatgtctgtgtgagggtgccagatcttggagttacagacagtgtgagctgccttgtgggtgctgggaattgagccagggtcctctggaagggcagtcggtgctcttaacccctgagccatcatctctccagccccaggttgagctttgttaatgttgttgacggccagcacgggctcccttacagtcaaacctctgtctgatcagtgtatgtgccctgggtgctgcttctggatctcctttggctctgtggccccatggcccccctctgctgctgtggccattcagactctagttccttccatcctggcctctagttggctttcctggttcccccttctcctaactctggctctcccttcacttcctcacagggttttcaatatggacaatcactgttctgtattcaggaactcttgatactttcttactgtcctcagtgtaaatgaaagtttcttagctatgaatcaaatttcttcccagcataggcacagactaccccacctctgctcactcacccacatcagccttcctcctcctgcatagacactgttcttgttcatattcctttgtgcttttccttgtcttgttcccttgaccaaaaaaaaaaaaaaatgttttggaagatccaacctgccccgctcagtgtcccacccaaactttggttgaccaggagaaaaagccttctttggcttccaggcagtgagttcaggtaatggcatgttctgagctattgtgcagctattggtttctttgattatatacttttttcataggtaggatcagacccatgcttcaatactaggtgagagctttgccacttaggcaacatctccaacccctgatatttatttaaagcaatatcaccaggtatggtgactcatgaatataatttctagaggctgatacaggagaatttccataagtttgaggcttgccagtgctacatagtgagttacaagctggctttggctatagagtgagtgaggccttttctcaaaaaaggaaaccaagatgaggacagggggagagaagaagaagaggaagaagaggaagagatggaagagagagggacaaagtaacttagagtaagatcttatggcaaaaggaaggaaggaaggaagagaaagagagagaaacagaaccaaggaaggaaccacaatgtcttgtctcaaaaataaagaaaactaaaagagagaaagaggaaggacagaaggaagggaggaagggagggagggagggagggagggaaaaaagaagcaaacatgcagtgaaccatgtggccgttgtacagggaccagcccaacatggcttccaacacagagaccagaaggacccaataagagaccgaagacacgactgataatacagaaaggagggtgatgctgtgtgcaaggcagatacaagatggtttttccataagaggaagtgatcatggcaaccatgaccttctctgaccttctctcttccaagaggctgttgggaaggtgggatgacctaggattgaccttggacttgacatcacagaagccatttcaaccttcacaggtacagtgctctgtaatcatctttgtggtgtgtgtttagcagagtgatggggacagacagagagtgcatttggttggctttaagagagaaaacaaatgcttcctaaatgactgaaggttgggcaaaggaaaggctgctttataagttggtcaggtgctgatacatcagtgaagtactttgagacaaggatgtgactcaacatggaaacctttccttgaataataatggaatctggagttggagctcagggccttagctcctgaaggctctgtatgacttctttgctgactatacccttttctcccctggccagttcatgtaggcattctcctgtatggctgcttagggaagagctatcataacaagtatacagcatcgggttttcagaaaccatttctaatccttcttgccagtatgtggggttgctggtaaggcctaccagactggccccatccttttggggacagggcatcactaagtatgaatcttcccaaagaggtgaacaggagcctgacttatgcaactgagtgtatttgaacgtgctagactttgaaacatttcaatgtaaaagaattaatttaataatggggtggtgttaagccaccacctagatttgataaatggtgagattcagcttaatggctattccctagattttggctgttaggaaatcgggagaacacaaacctagaagagcctggattgaagaacacttcaattttcttcaattcagattttcttttttcctttttttgtatgatatcccatatgtagtctaagtacccagagggaccatggtacagatttagaatatgttctaggtagacatctgtgaattagacatttccctttatagaatcatttgtgggtttgtctagggtctgtgcagtgaccagctgcagaaactcttgatacacaatctctctagttctccagctgcatttgttgtctgtctttacacatcatgttccctgtactaggaacaacctctgcctctttctagaatgatcagctctgagagaagcctagctttacccactctgcctgccagagctccagtctgtgcccccgaaaccacggttccagttccattcccagcgcagttgtagaatattcccgcacactcaatggcttatatgtgttttgaagtttatgatcttatacccgtttttatcctttgcccttagaatagtgtttatatgcttcgagcaatcaagtttgttgagtgaatacatggatgctcaagagtgtgacagaataagtgtgcaagtgagtgagaacgtgaaagagtgtgacagaataagtgtgtaagtgagtgagaatgtgaaagagtgtgacataataagtgtgcaagtgagtgagagcgtgaaagagtgtgaaattagtacctcccaaatgaaaactaataatattaggtaacaccagatggaatggtgcctcagatctgaggaacccagaagtactttggtctacgttatttaagcaatgtgtttttcactttagaatttaagaatgaaatgagcttcgctaaacatgctgatttaaggcaatgaaaacaggaagagtgaagcagccaggacccctttgaaaggaagtgccattgaaccagtcctgtcggttaccccctttccccaccgggtttccttcacccccagtctgtaaaacgctaatagcccctgttagtgtttacattataaaagcattgtcggggtgctttagagagtctagatggctatagtgtcttcttggaagataagcattatacacaaatgaggtattattatttagttttcccttttcaggcctattaaatgagaattagatgaaaactctgctgtaagcaatagccagcaggtaaatgattattgactcgagtaaaatgagattaaaaaagaaaatctctagctgtaactgagcagcgcagcctgtctgtgcactggctggtgggtgtactgtttgatggatgtttctctcttgtctgcactctgatcaggaactgaggacagggaagccctttggttcaggcctcccgtgtgtcagagaaccctagatcacctggaagaattatgctttggaagtaacgttcccactagtgaagttatttagctagttttcttgtagattttggtcctcagtgaactattaaccctgcttctcctttgggaacttggggagactagctgatccttgtgggggtctctggctgctagtactggtacctgtgtgcatggggaatcagttccagaccacagctttcctgtggccttagaattcaggatcctggtagcaggagaggggcttatggaaattctgcttgtggattatgaatgtcagagactttgcttgatactgtcgagggcgggtcggtgagaagagacacctactgtgcaagcctgctggcctgagtccggttcctgggacctccctgggactcaggtggaagtagaaaagagacctcatatcatggaagcccgagaaagcaaacagccagagaagatgcagagtgactgagctggtggagaagtacacatctgtgtagcacgctgcgtggcctcagcgtgtgtgtgtgtgtgtttgtgtgtgtatgcaagcttgtacacatgtgtgagagagagacagagagagagacagagagacagagtcagagagagatagacagagagaaaatgaatgaatgaatgaatgaatgaatgaatctttggttcctcctcttgcaatgcttcctacctgactgcctttgccaaaccctcccttgtgtccatccctttggacttgtctcaccttcactccccaggaccaaccttcagtagagcttgctgttgtggtcatctgttttccacctgacccatttatcctggcttctggattttgctttcagagaggctccccacttgcatagctgcctggccagctgtggggccagctgcctgttccagattccaaggtgaccaaagctctcctcctcctctgactgcccccatgacattagcaatgaagataagggagagaaagtgagggtaggaagtgggtctggacaggcagtggtggtgcacggctttaagcccagcacttcggaggcagaggcaggcggatttctgagttcgaggccagcctggtctacagagcaagttccaggacagccaaggctacacagagaaacctggtctcgaaaaaccaaaaaaaaaaaaaaaaaaaaaaaggagtgggtctgttccccttgagatcttttcagtgatgggctgtgcagtaactcagacttgccttcagccatcacagtgggccttggtctagcagggctgtgtggacctttgaagcccaggaggggaagatacaaggcaggttcggtttcagctttagccaatccagcgctagttggtaaactacttttccatcttctagctatgtttcccccaaaccttgttgtcaatcagctgcactgtggtcaaggaggtagggacccctttaagatcttctgtatagtttctacactcataggaaggaagtctaaggacatgctatgtcttcttccaccttcagagcaaactgtttaaaatggttggctgtgcacattggttctgtttacatctcagttcacagggagccgatgcccaactggtcatgaatccctagtgcagctgtggactccttggtcttttatctttgatatgtaagcagtgtttgcctttattgaccccaacctacttgtaatgtgtgttaccttcgacatctctcaccctgactctatggatgcgccttcatattgttttaggagattctttctctggccaggctttgatattcctctagggttttcaacaaatctttttctttttcctaacacaccttcccagactctcattcaccactctgaatccatttctgctgtgttatgttagtttgcttctctgtgactatgataacacactgacaagagtaacttggggaggaagggtttatttcctcttacaaatcacagtccatcatcaaaggaagccaaggaacagggaggcaagatctgaagaagagaccacagagaaattctgcttgctgggttgcttcctctggcttactgagctgcctcttgtatatagtaaaggcccatctgcctaaggaaagcactgcccattgtggactggaccctgcttcatcaattagcaatcaaggaactgacctgacgatgtgcccaagggccaattcgacggaagtcattcttcagttaagattcccttttctgcatgcagtacgactaagtgttttgtcaagttacaaaaattaaccagcaaagttgtgttgatgatttctaaagcgatttcatcctgcttctagatccagctgcctacctctctgctcgaacgtggccaaggcttaaatgtgtctctgcctcccctgcagcttctccatctcgtcttcatattttttgttgtgttaatgaatgacatctgatccaccctgcatatatcccaaatcaatccccagtcttggcatcagccttggtgaaaggccacactttcagtagattctgtgtcccctagcagatgctgtgtaagcttctgtttcatttgggcctctttgctccgccagcctcacctctcactgatctggatggtgttctctgtcttggttacatggaagaacttcgagatgcagacactcagcctgcaaccattaccatgacttccccagggtgtaccttccatgctccctacctgaaaaatacttcccaccgccatggataggactgactcctgcacatcacaaactgcccactcctcttcataaagtcctgacaatcacctctgcctttactgcttttatcttgccctttcctgaaggactatatttagtgtatctacctttatattcttagtagcaaagaaagtatttggtaaaaactagttcgtcaagaaagaaagaaagaatgaatgaatgaatgaatgaatgaatggctgtaaatagcagaagtgggctgggaagattgctgagttaggaaagtgcttgctctgccagtataagaactggacttttattcccaatccccatatggaaagctaagggcagcagtgggctcctgtaatcccaccacagtcgaggcagagataagaggatccctggggcttggtggtgccgcgacgacatagatgataatgatgatgacagcaattacggaagaagcttgatgtcaacctctggtctccatgcacatgtgcatgtgcacctaccacatatccacaaagacaggcaggaacatgtaaagaaatgcacacacatacacacaaacacacacaaaatgagaaggaggaggaggaaaaagaaatatcatggggtattattgtgagaatatataacaaaagttctcatcaaaagaatacaattagtattttacaacgcaaaaatatatgaaatcccattcacatcaaaagttacttccaagttgtcccctgtggtcttcttttccaaagctcattgcccagactttgagccattttctgggctcaccctaatatccaccccttgactctctgtaagtgactgaactcgtgactggctccgtgttgagaacgtgggggatcagaataaggtgagttgttgcctcaaagcttgtctctatcatttcgtttgtaaccattcactgcatgtcttgagcaaaactctgaaaattctctcaagtgaccgcaccagcaggtgtgtctggcctcccggtgacttgacttgttcctacactgtttgtgtagtctacgagtgccaggaagcaggagcctttcttgggaggccaattttcctttttttgtttcaagacaaattaaattcttcatcttcgctatattgacttctttaaaaatgtgatttctcatagagaaaaagaattttgaggaatcagaaagactcgctgctcatggtggggcacttcttgggccaaatgtgtgccaaaaattagggacaggagtagtgttgtcacagacagctgtgcaccagacatctggttcccatacagcccctcctacatccccaattccaagcttccccagccccgtacttgctgcgaccaaatacctgaggaaaagtcgaggaagggaagttagggtacaagccatcatggcagggaaggcaaatcagtagtcggactgtgaagcagctggtcacattatgtccccagtcaccagagagagagtgatgaaggccagtgggcagctacagctcctttttattcggttcaggatcccattccatggaatggtcccatctgaagtcaaaatacatcttccatgttcagttaacctctctggaaacacagtcataagatgcagcccagaggcctgtttccatggtgattctaaatccaatcaagatgactgaagattaactgccctgctggccttctagaatgtacacttcagggcgggcagagagcttgtttggtttagtgctacaggctcagtacttgaaacagtatatggaagacactcacccaaaaatttgttgattgaatgatgttattaaaggttctttgggatttttttttgttctgtttttaaggtgctgaaatgtgcatgggtctctggggctccaatacaggtctggcccatgtccctgtcccacccaccttgacatttttattgatgactaagatgataacgttgatggcatgctaagcagatttccagatgacacacaagtagagggttagtaacttaatggatacagtcagagtcccctctaccctagtgctgatgggatgcagtggtgagtcacctgacaatatgaagttaatgggtacaaatatcaagtcctcaaagatctccgaatccaattaaacaggtacagagtgggcgcgagatgacttgcaagcacacacacacgtcaggaagatttagagcctcctgtggcttgtgagtggtgagtcaacaccgtatgatgtccctttcgaaaaaaatcaatctcctgtattaatagcaatagaacattggagagtggagctggctctccagtgctcactggggagcagaccacattcgctctgttttatgaattctgggctcagacagagatattgagagacaggagattatctaagaagaaaacagaatggtaaaggttctggtgaacaccattattcagatacagagaggatcaaaggccgtgatgagtgtgtgtgtgtgtgtgtgtgtgtgtgtgtgtgtgtcacaagcagtttagatagttgtcttctaaattctgaactttaagagaagattaaatttcttctgtgtcattttcttctgtgtcatctaaatgtctgacggagtgccagttactagatgtaagcaagtgcatttcagtaccttggggattgatcacaaactatattcgcttagccatcaaatagacaactgcaggaaggaacacattccttggctttggtaggtgctccataaattctttcttatctgaaaagaagaaagaaaccacataagcctttgatgcatctgaaatggcatcgtagtaggttctacaggaaggaaaacacgttctttctgggtggttctctggtggcaagagacaaacgtaatgatccctagtaaaggactggcgaattgttgctcaattattttgacaataaccatttaagaaagtacttgttgagtatctattctgggttaggtgcagccactatgttggggatgtagaggtagtttggagagaaagctgttagtatggggtgagggtgatgtagagatggacagacaggtaagtagatcctcaaggtactgtaacaggtgctttgtgggtagtggcagaggcagtggtggtgtgcctgtgtgttcttgacagcattgacatttaacaaagaagaagaccgaggcacgagcttgagataaattgcttagagtaacatagcttcaaggtggaaaactggggttcgtgtctgtgcgatggacattagcagatgtgcttcttgctacactgagttatcttcactaacacatcccaccaccaccaccaccaccaccaccaccaccaccaccaccaccaccaagagctagagcccacacaactggactctgagtccaagttgctttctttcacataaccctgttccttggcagatgttgcatccatatgggaagaaatggtcacataggtacaaaagtggttatgtagatcttgtatcccaggtgattgggggaacctcatggtgaaagctatgatgtgctttgacatggtcaccaacatggtttagacctgtggttctcaatctttctcattctgcaaccctttaatatggttccacatgttgtgatgacccccccaatcatgtaattattttcattattactacgtaagtgtaatttgtctactgttatgaattataatgtaaatatgtaatatacaaggtatcttatattttacccctgtgaaagggtcattcaacttcccagaggggtcaagacccaggttgagaaccactggtttagactttctgtgctttaggggtgcgggacttttaacagcagtgaaaaacagtttatccatggagctggagtctaggtagcaggggatatgacttgcagttcctagcaactggccatcaacccttcccctgaagccctttgaaatacaatttaaattcttttctaggaagaagagaataaaatataaagttttacaaataaaactagttacattgaataccccatacatgagcagaggaggaatagaacacctaattgcttaaattttccaagccttcttacactggaaaatagttccacccaatatgcctgtgcctcctaattgagttgggctggagctgtggcaaatctgactgagaatgggttattaaatgactgaagtaggtgaccccttcgtcgataattaccatttatgctgatgcaggcttgacctatgtgatcaaagcgattgtgttggtaagctacccatctcctgtaatttttggagatttggtaatttcgaaatgggctgcaggctgggatttctgcggtctgcggtggagctgctaaaggtcagtgtagtcttccctcccgggggtgggggtgggggtggggcttggagtctgattgcctccaatgttttagctcctcctttccaggtgggaggggcttggggtctgattgcctccagtgcttaggttcctgtcgtccagtgtgtagggacctagtagattcagacggtttttagccttcggtggatatctgtcttcttggcttccagtccctggaaacatttgttcagctagtggtggcagagtttcctcatgctttattttcgttgctcctatttctttcatttgagcctgctttcgaggtgttgcttaacctgtgtttgtgtctgcagaaatcctcctgttagaactcccatgtaaccttatagcagcgctcagctatgtgatgcacatcttcttaggatgccgtgtaacgttagcagcaagaacagggatctgtgtgggagggcggacttaaatgtctcattggatttaacgtttagcatttaaaggatttttttttaattacaaaggatccatggttttataaatatttttttccattttatcactcagtcagtaaaacttggaaaattattctcttgcatattccattctttaaacctgaaggtaaattgctttaacgagaacacattccaaacaaatactttttcataaagctaagagtaaatgaacagagcgggctctcctggcatttagatgtatgtctaattagaacttccagcatttcaaacctataatttgccaaagttgaggtttctaattccaaatgtttagcccactgggttggaacaagtgacccttgctggaaagatgtcaagattcaactttctttggttgacttctactttgtcatcaaaatgttgtcatcaaaagtctgtctattcccagacttaagccacacgagctccctttaattttattaacatccaggcagaaagggaacggctgtttcttccctcctcagtgatgcctaattctggggtctgtttacagagggagtctcctcctcagccggctccatcttcacactagtcaatgtcaacattttgtacatcttccaaggggtggaggagtcttaggtagaaatcagccatacagttgatttgatacactgcctagctcaaggttaagtcttagatactctagacagtggcagacattgccagttgcctttgtttataacttgaaactgatcttgtaagatttagaataactagattattatgtgaccttgaacaagcaatttaatttgattttttttgattgcttgtgatgctgggattaaactcaggacattgtgtgtggtaggcaagcattttatctctgaactgtatctccagccctttagcctattttctgatttttaaaaaatatttttaattttaattttagttacaagtatatgcatgcgtccgttcaggttaatacagtcgcccgagttggccagaagagggaggtggagcccttggagctaggattacaagtggttatgagctgcctgatgtgggtgctgggaactaaactctggtcactacaagatcaatatgtgctcttaatgtctgagcctaaccttttttataaaacaatcatttcacatggttattgtgcttattattaaatggttaggattatatgttaaaatgcctagcaaagaaagcctggagcataggtctaagcacagagagaataagccaggggagcccagacaggcaggtgagtctgcatcaacattatctatctgcctctagatacttgttgggcagaaaggtccactctcagaggcatggctacatctgcctctgacttcattctcaagtgcacacgcaaacactattcttcagtaatcatcagcctatatcattccttacatatttcataattagttatttaggagaaaatgagcaaaaaagcagagggaaaaaattagacgaataagatgcctatttcaaaataatttccaaatagctgtccatgtttagaatgtttagaaaatataaccgcatgcataattataaaatatgtttgtttttataaagctatctggttttacatttttttttattgatcttagagggctgattttaatggccttatcaaatgactaacaatgtggtctactgtggactcccgatacactaaaaatatccattaacggcctctgatttcatcgcttctactgtccttgcctgtgtttcttaatgtgattcaatgcgataacagtttgccctcactgggtatcggatggataacaggaaagaaaggccttgcccctcaggtctgaaagaaggactctcccaagctgtcagaatccagcttggtggtaaaatgcatgaactttcactaagaaacctttccctccgtccgatatctgactgaaatctgaggagcaggattccagtgcagaggtgactttggaggagaaaggtgggtgccaaatggatctgttgtttttatgttatataacaaggagaagaggaaaaaaaaaacccatctagctgtttactctcagaccgtacctctgagatgatcctgttacagcaaaggacagagactaaccctagattttacgttagaactatattttcataaatggtcatctggagccactgaaaactatatacagttagatgctgtgctccattatctataaagagtcgaggtcactgttcaccctaaccattgcatcagaagcaaactctagctgaactatataagtgatattgttaattaaaacaattttaaaataaaaatgtcagtattatcaagaatatgtgagagctgagggttggctcaggggtagagcgtgtgtgcggcttccatgagatttttaggttcaacctccagcagcacaggaagaaaaaagataaaagaaaaaccccgtgcattgtaagagagatattgagtctacagttgaaaaacgacaagaaaatacgatcgccaaatccccacaattttataacacacgcgttgtcaacattaacatttcttcatcgtttcctaaaaaaaaaaaaaaaaaaaaaaaaaaaaagtcctcactctgttatctagagtggcctagatctcactgcaatcctcctgcctcagcctcctgagtcatataattacaggtgtgagccaccatgcttggcttgcttttcattttaatgggtatttatacatacacacaaatagactcatacacacatatcacacactccacaatactcactacacatatgtgctcacactttattatagaaaatgtaaaaacataaaccagcgttggtagagagcataatgaaccatggtacctgttaacccatggcagggatgtcagtctcctctactcccctgattatcattgtatctctggtgcaggggaatcaaagccaaggcctcaatcatgcttggccagcattctgactctgacatgaatttccagcactattctggttattttgaagctaaccccaggtgttgtgccattttatccataaataatccaatacggatctttaaaaggtagagactttataaaacataatcactattgagcttaagtgagtagttctttaaaagtgtacaatattcattgttctaattgtctcggtagtgtttgaatttgtgtcaagacacaaagaaggtgcacaaattgagactggttcatacgtttctttggctttctttgtgtgtgagtgtggggtgagcaaagaaccctgggcctcccatcaggaaataagggagtgtgcttgcatgtgagcatacacacacacacacacacacacacacacacacacacacactacacacacatacaccacacacatacaccacacacacacatacacacacacaaacacactacacatacacactacacatacacacacatgcacacacacataaacatacacaccactcacacacaaacaccacacacacaaacatacaccacatacacacacacacacacacacacacacacacacacacaccacagaaagagagacacagagagagagagactagaaagaacagctgaacaggatgcagtatatccacacaatggaattcactgaagctgtaaatggtaacggagatctttagatatacacattgtagaataatttccagggtgcattatgagtaaaacaacagagggatgccaggcatggagtcacacatctgtagctactcaagaaactggggtaggaaattactttgagatctggagttggagaccaacttcaagaacacaatgagatcatatctcagaacaacaacattaatttgatgatctatcccaactgactttatgcaaaggactaactaactgcaaaaaaagctcttgatagagcttggcaatcacaatgttgctggcggttgttaatgttgctgttgtgagtaacgggatgtacaccaaccaagcggtctctgtcactagagagaaatatttcaattctgccctgcttgctttttcttgagacagggttctcactataaggagatgtgataactattcttggttgtcaacttgactacatctgtaattaaccaagaggctgggtacacctgggaagaattttttttcttaagtcatttgaagagggaagactcacttttaaactagatcttctgaagtgggaagatcgccctttaatcgggccacacctagtgcttgcagcctatataaaggacatggacaacagaagcttgctctctgcctgcttgctctcactgacaaatccattccttcactggcattagagcctacttcctttgggatcctggtgtatactgaagaccagctgaggcatccaaccggggggctgaaaaactactggggatttctggaccttccactggtagacagccattgttggactagttggatcacagtgtttaagccattctagtacatcctccctccctccctccctccctccctccctccctccctccctccctccctccctccctccatctctcccccctcccgtgtgtgtgtgtgtgtgtgtgtgtgtgtgtgtgtgtgtgtgtgtgtgtgtgtacgtacagattctatacgttcttttcctctagagaaccctaactaatgctggggaaggtaccatagttgtagcatagaggagattaggtgaaacgtcacaaccctgatttgaattaatgctgctgagatacagtggtgacatatctgtctatgagatatcccggctcctgcgttcactgacaagacccagatgctaaaccagtagcaacaagcccctttgctgtctatacttcgatccagttgtgatctagaaacgagtctgcatattcatgaaatacacatgtggggctgggcggtggtggcgcacgcctttaaccccagcactcaggaggcagaggcaggtggatttctgagttcaagggcagcctggtctacagagtaagttccaggacatccagagctatgtagagaaaccctgtctggaaagaaaaaaaaagaaagaaagaaaaacacatgttgtgaatatatccctataaacacatatttagtgtgtgtttaacattaacatcaatcacttaactattctttttctggtgatttagagggcttctgattctttctcataggtatagtgtatgtgttcatgtgtctgtacatgtggaggtagaggttcatgtcaagtggcttccttattttttaaatttacatatatgtgtatgcacacatgcaggtttccatggagactgagagttgtcagatcccctggggctggagttagaggcaacagtaagccacactacgtgggtgctgtccaggaaattgagctctcatcctctgcaagagcagcaaatgctcttatgtgctgagccatctctccagccttcaccttacattttcagggaaaacagtttccaaaacagggtttgtctaagtagccttggctgtctcagaactctctttgttgaccaggatggccttgaacagagattctcctgactctgcctcctgagtactgggatgaaaggtgtgcacgactaccacttggccctccacttgcctttttaagacagggtatcttactgaatctgaagatctgtgatttgtctaaactggctggccagcaagtcgcaggtgtgctctgtccccaactcctcagtgccaggactataggaacccactactgtgcccggctttttacaggatcgctggggttccagactcaggtcctcgtgcttgcacggccagcgctttcccagctgagccagctctccaggttcagtttctaatcctttttgagacagggtctcactgtgttatcctggctgttctgaaaccttctatggagaccagcctgaccttgcactcacagagatccctctccctctctctctctgcctcccacatcctgggattaaagacatatgccgtcatattcagctccagttctttaaagttgtatataatgctgcctcaaagtatcatcaccacccccacccccaccatcaggacagcatcttgtgtactccaggctagcattctgtgtagccagtgatgactttgaatttctgttcctcctgcctccactcctacagccccgggattatagatgtgtgctactacacctgctttatgcaatgctaaggactgaacccaaggctttgtgcctgctaggcaaatattctaccaactgagctacatctctagccctgtatctggccttagtacatatttctttaagggtagtgacctaacgccatgggaggagcacttttaagctcctcttagtattgtcaaacagcccttcataaaggtcataccaggtcatacgtggcatgtggcagaatggaagagaggcaggactcactgttcatattggtagaggactcactgttcatattggtagatatattttagacttgtacactgatctgtctctgctcatctgatacattagctagaacaaccactgtcctcctttggctgtcctttgtcttatagagaaaccttaacagaattataaatgcagtctggaaatttttttactgatggaacagtctcttatttacattgtgagctatgtttcaacaaagattagaaggaccatatcaaatttaatatattacttataattaatgcctcaaatgcttgtatatgtaactgccatgcagggaataaggtaccaatttgtatagcttttggtaactttggtagctacctgggggatttctcaagtttttaattacagcttttccattacagactcactatacgtgaaacgttttcccggatatagtataggagttaatgaaccatgtcaacattactttatacctacatttccctacaagggttatgaaagctcagaaaagtggctgagagacagaatcacctcctgttggagttgagagattttaaagttcatctgacttcacccctccattttatactcgggaaaactaaggcaaagggcagttatgtaactttattaaaggcggacagcctcttggagacaaaagcccaagtctgattcagcgcggtgctctttcctcacagcctctcagattgagcaaaactccaaagaaaatcagtgttggggaattggaattcagggcgtctcctttcaaaaatccagggtgtcattttttttttcattaagaacttaaaaggaaatggaggagtaaccgcagtagaaacccaagtgaaagaagacgtgttatatctggggtactaggtattaagaatggggcttctaacactgggggttacagcagtccaaatacacagcgtctgaaggccttggctgtgtgcctgtggctgtcataaagcctgtggctttgtctcattgtgctcaaaccaaaatcttcggcacagggagtttctgtggcttgccctggaagcctgcttattgctgtttgtttgctctcggcccctttccctacagaaccaaagttcttgaaatatctattcatttggactggggagatggctcaggaggtaaagccttgaccacacaagtgtaaggacctgagtttgaatccccagagaccctgtcaattctgcatgtggtcatgtgtgtctgtagtcccagaattcctatggtgagacaggcggtagcaacaggagaattcccagaatctcgttggccagttagatggacaaatgcagaggtaaacaataagagagacctttcgactaacaagataaaaggtgagggccgatgcttgagtttgtcctctacgtgtatgcctcggcgctacccacatcacccacatatgtgtacacacacacacacacacacacacacacacacatgttcaaagaatctttgaagtagttttcagttctttgtctgtcatgagcgtttgatttgtttttcattcctcatctgtaacatggataagataatacctacctcaaagggtggttggcgttacgagcatgtaagataaaggtgttggttgttagcagcatatctggcccagagtaaatagttggtaactgtcaccttcagggtctttgtcatcatcagcagggttattaatgtcctcatcaccaagtcgccattagtccctctgttcctccatattgacctcttttcttaatgcgaaactcctggacggggtgacacatttcccaaggggctggtgagtcaccagttgtttttctctggacaacattagacagaggcctattacaaggcagaagtgggaaacatagatgagaggtaggcagcccccagacatgggttagagcctccaaactaggcagggcgagtttagagaacagctctttgaagtcagtgtgctggtctatggggctttattaggactccagagggctgtgtggaaaactggagaattagaaaagccattatctgctgcctttgtgtcctgcccaaggactcccaagccctgtagccacctgattatctggactgcagtcgtacaagcaagcgacatccttccatagacggtctgtttactgtgcctggaaacaggcctcgtgccatggaaaagtacctcgctgtacccgtaagttcccgacacatattgcgcaacccgaaagatcttattaaaatttcttgacctggctgggatgtagcttggtagtagagcattaaccgagtctggcttcgaccatggcttcatccttcaacaccagaaaaaaataaaaatgtgttcctgtgcacactctgccttcagcctgtgtctgagagtcgtttctgactaggcctttcacagagtccttgcctgtcgctgctgtgaaggctacctctccctttacactaggtacggccatgctctttcatctctcggcatcatggggaagcatgaggtcccatatcaaacaacacgaaggggaccatgtgagggaggagcatctcctaccaggctctccggatcccctcttatgtctgcccattcagaaaacagcacggcctgtctcctccatctcaggcaccattctgggttcgtttgatgaaaagaggtcactcaggtacttgtctcctaggaggagctgatggccaagggcaagggccaggagcaggtggccacagtgcactctggaaagtgctacaagcaggaagaaggaaagccagggtcaccaagtcacagttggtcgaaacaccgagggaagaactggaaaggtgttctgaggaaagcaagctctccctggtgtgggctgtggaggcggggcttacgtgttcacttgtccttatttataaaacgctgagaaagtgcttcccatggcaggcacccatatgagaggattacagtaaacctcaccccagtattcacaagcccagacctccccaaccccagacaggctttctcagtgtagccctggctgtcctggaactctctctgtaggccaggctggccttgaactcaaagttcctactgcctctgcctcctgggtgttgggattaaagctatgtaccaccactgcccagcaaccctcgtgtgtgtgtgtgtgtgtgtgtgtgtgtgtgtgtgtgtgtttgagacagtgtctctgggtagccctggctatcctagaagtctctctgtagaccaagctggctttggactcagagatccacctgcctctgcttcccaagtgcttgaactaagtccttcttgaaatgggaaactgaggcatagaagagagagagagaagtccacaaaactagagattagtaaaatctggaccttaacctgtgtgcctccctctggagtcttaggctcagcagctgtatccctgctgccccatcatagggcaaggaagtacacagacatgtggaggctgacacctcagggggtaaccgaaccacagcagagttgtgcacagaggagtggcaggtaccctggctaagaaattctgccccatcccaaacatggctatccgtgcatctctttgtgccttgtctgtaggtttgtgtctactcaatcgtagtcatgcttgattctaaactttcaaacagttctcatttgtgggaaacgggacaggttcactatgaagtatgctgtagttcaagatgatatcttatcaaataatgttttgatcatgagtaatcgcttctatttttaaagactcacaaagacttgtctattctagggccctggcagtactcgagtgtgtgattctgcttcctgtgacaagttaacctttgggttgagcaattcattggtttttagtttattcccacggtagtgccaccgttgccaggatctaattccagaacacttgtaccacaagaaagaaactcctaggacatctgtctggatgggcactgtgaagacctcatgtaactggcgacccacagtctgacctctgcctggcttctttcagttagcatacttttcaagatccactcacgatgtggcatacattcatcctttatcccttcctgcagctggatactgttccatggtgagagcctaccacagttgacgtacccatgcctcagatggtttggctgttcaacttcttgtctattgtgaataatggacaatattgtggtatataccaataggtggtttgtaccttgtgtgtgtgtgctgtgtgtatgagtttacatattttatgattctcctgagaatatatatactttgtgaaaagtattgtaattaacttgtggttgtttgggttttttgttttgttttgttttgttttttgagacaatgtctcatgtagcccaggttggccttgaacttgatatatagccaaagtgacttcgaacatcttgtctcccttcctctgcctcctgagtactggggtttcaaacattagcttcataagccagctttgatcagcgtgtattactttagtgcctcattatttggaaagtggaaaatacaagaccaaatatccagtaacgatctgttgtatgaagtggaaggattctaaagtgggctcattcttagggcttcatgtggcagtaccctgaacattgctggtgcttgtgggggcattttcttgattagtgattgatagaggagggcccagcccactgctggtggtaccacaccaaggcaggtcattctggaggaagttatctctaaggtaaatgagggctcaaagttgagtagccagcctttccaaggagttcctggaacatcatggacagtctacagaagctctgagattatagagttccctgagacgaattaatattgatgcttatttttgtgtccattacgtgcctagtacaaagccagatgcctcatggtttttccctagacccactctctgacaatcttatctggtcatcaagggcttgaaacgtggtacgagagtggagagacgctgtgtagggctggaaggaggctcagctggtagagtgcttgcctagtgtacataaacccctgagttcattcctcagcagcacataaaacaggcataatagcacatgcctgtgattccaggacttgtagagtagagacaggaggatcaggagtctgaggtcatcttcaaagactcaaaggtttaaaataccttagtactgtggacgtgctaagtaaactgtagtatgaaaattaactatacctgtttgctttctacttttcttagccagctactcgaaaattttaaatcatatatgctctcattgtggcttatgtcctatttgtattggacagcccctgttctagattattcctcacagtaatttgatcagctggacggcattatcatttctacattctcagtgaggaagtcgaggcttagagagcttaagtaaattgcctgtgatcacacagctgtggcttaagcacaaatctgtctccaagcctcaattcttacccattcttctataccctctccccgcaacactctggtccagagaggcagctatgatctttcgctatggcagaatactgtttccgtgtctccttagaaagcatgaaaaaaggtctggttctgcaggggcgcactgaggaattattacaggaatgtttcttaaatacaaactatttgtaaagcttgaagtcccccacccaggagaggagttaggaaatggcttctatgcttcttcttcttttttttttttcaatttttttattagatagtttcttcatatacatttcaaatgctaccccctttcctaatttcctctccgaaaatcccctatgtcctcctccctccccctgctccccaacccacccactcctgcttcctggccctggcattctcctatactagggcatagaatcttcgaaaggccaagggcctctcctcctattgatggcgaactagaccatcttctgctacatatgcacaagctctgggggtactgattagttcatattgttgttcctcctatagggctgcaaaccccttcagctctttgggtactttctctagctccttcattggggaccctgtgttccatccaatagatgactgtgagcatccacttctgtatttgccaggcaccggcatagcctcgcaggagacagctatatcagggtcctgtcagcaaaatcttgttggcatatgcaatagtgtctgggtttggtggttgtttataggatggatccccgggtgggcagtctctggatgatcctttccttcagtctcagctctgaactttgtctctgtaactccttccatgggtattttgttcccccttctaagaaggaacgaagaaacaagctggagtagccattctaatatccaataaaatcgacattcattaaagaaactgagcttcctttttaagccctgttcctgtcagtctcttctgctgggctgctctcaggaagatgtaggaaagtgagaagccacgcccctacttcaccttcccacccaccccacctctagcagcaaagtctatggctttcatttaaattcatgaacaccttggagggagggacgggactccacccctcggtttcaggggacacacagagagattgtgaggggaggcaaaaccattcctgccacaacccctgcgccacgccacgccacgccacgccacaccacaccacaccacaccacaccacgcccactcccttcatcctgtccctggagtacgggttcactgttagccaaaccttcctcttcccaagaggcgtgcatctcagtgctcactccggaagtctcctgtctcggtcattaaggctagctattaccagttcttaaatgtcgcaacttcatttttttttaattctcattttacacgtacttgaatatgacatgttttgtgagtgtaatttacttatttaattttcagtctcaaagagaaagcccagcctagcgctcactggcccttcagcttcgttgacctggtttggaagtctggggatgtctggggtaactgggaatgagacttggccacagagcctcgtccccaagtcatagtcttagggactagaagcattactgggagctattaaaaaagagaaggaaaactcaaaacaaatttatttcttctcttttctttatttccttggactgcaggtttataccaagacacatgtcaacttaatggctataaagctcaacccaaacaccaaactctaagaagctaaaatgtttcagggagtggcatactggccctgttgttattgttcactgtttacgttttaattcagttcaaatccttagtcagatgttcacattggcttcaactgctacatggaaagcagattccagcctttggttcatttaattattttttctttttgcctagtcattctgacttaaaatcccgcagctctctcagatgcagctcagctgacagtgaccggaacaagaagtcagaaagagagaaggctattgggaaaggtgtgcagagcccggaatcagatgacctgagttcaagctctaatgacttagcaacaaaaccccaaggaatccatctacactggctgggcacctactgtgttcaaggggttggaagtagaccccgccaaagctgcaaagattttaaagggaaccccccccccacactcctaccatcaccatattggctgtgaatttgagcacccacttgcttaaaaaaatacaatctctagataactggaaaaatgaacatacatacaagtctggcagtagctgggaagagaggcattctcagcctgcctaggtcttgctcacagccatgtcacagtttatacagaatatgaagcataggccagaatgtctgcctgtgggaagccatctttctcccagcattctaaagcatagggtttttctagtggaatcctacttcctgttacaatgtcattgagaaggaaagaaatcacctttgcagcttagcatggcaccagacagacatgtgagtgataaaggaattagggagggaagcagtaagtcagccacaattctagccagagagtgagatggctttgacaaggaactgctggggtggtcctggcctcctgggcagggtggggctgggatggctcagaacagaaggtaccaggaaggagagataaagcaggcaaaggggcatgggaggagagtgcagagctggtttgggaaacttgttagacaggaaggcagcgtgcttctggccaacaatgggcagcaagttctgaccagtagattagaactgtggtaaggctcaggtttcatttggaagaatctgaaccttcctggtggtggagaacacggaaacagcagagatgcagaacagccctggtttggattatttttattatttatttatttatttatttatcaatcaacttggcacaagctacagttgtcaggaaagagggaacctgaattgagaaaaacgcctccatcagattggcctgtaggcaagtctgtggaggcattttctccatcaatgattgatatgggaaggcctagcccatcacgggtggtatcagccctaggcaggtagttctggagcgtacatgaaaccggctgaccatgtcatggagagcagaccagtacgcatgcgtcctccatgggctttgcttcagttcctgcttccaggtctctgccttgagttctttgttgtctctggatgatgagctgtgagctttaacctaaagtaaaccctttcctctcctagttgtttttggtcaatgccttatcactacaataaaatagaaagtaaggtgtgccctaagaggaaccaatgtgtggaggacagtggcttatcagccccaggtggcctggttgggaggggaaagactatgggaaatagtgtaggaaactgttcaaatacaattggagttgtaggaatgacagagaaaggaaggaatgacttggaggaaacattgatagccactggtgtgagatcgtagaaggttctgagcatccatcgagtcagagaggacagagatgctgagaaggtgggaggcttgcccgggaagatgctgactctgggggtgaatgttggctagtcggtttctatacagctgggtaacagaaccgtataaaatgcgaaccagttttgacttcagcctcctaaagacactacctgagctttacaatgccttcttctcatcttgctctgttcagagcaatctttacagtgttttattatgccttccctgtcttagctgacccttttcctccgtccccacatgagccttggcgacactggtccagcactaagcatctgcttagggctccagtgctgttgctttacctaaaaccatctctcctcagttctcagtaccttactctttcctcccgtcaactctcattagttgtttcttcttcttcttcttcttcttcttcttcttcttcttcttcttcttcttcttcttcttcttcttcttcttcttcttcttcttcttcttcttcttcctcttcctcctcctcctcttcctcctcttcctcctctccctcctctccctcctctccctccttctccttctcttccttcttctcctcctcctcctcttccttcttcttcctccttcaccttttctcctcctcctcttcctcctcctcctctttttcctcctcctcctcttccttcttcttctttttcttctccttctcctcctccttctcctcctcctcctcctcctcctcctcctccttctccttctccttctccttctccttcttcttaatattattttgcattctggggcattgaaccccgagtcttggctatgcaagtcaagctctttgccactaaactatatacccagtcttcttctattctttctttctttctttctttctttctttctttctttctttctttctttcctcttctttttaaatcttgagacgaggcctttctaagttttccaggctattcttgaacttgtgatcctcctgcctcagcttcccttatagctaggattacaggtatgtgtcagaatgcacagttaagtgcctcccaaccctttctggaaaacccttcccattcatcttctataaaacaataatactggctctcttgctgtttgtgcttccctcacttgcctaccagcagacacacttaaagtttattatcacagtctggaaattgaatatatatatatatatatatatatatatatatatatatgtgtgtgtgtgtgtgtgtgtatatatatgtatatatatacatatatatatacatatataatgaaatatatatagtgaaataatcgagtgctttcaagagtgcagcagggttgctgctctgacacaccagtcttggaactggacttgataaacaatttggcagcaaatgtgaagaagtataaaatgttcatgtccttcaactttttatgttttagaaaaagtcagttctaagaaaatagtctcagatgtggaaaaatatgcaggaaatgtatattgatatcatatttataatgtcatgaatttggagaggttcgagatgtcaatcaatatgagataattaaataaaatcaattagttttcctttgctacatatgtgtgtgtgtatacaattggcttgttgaaaggatggctatgaaggatggctaaaaactagacaactgcttccctaacaatgctacattttaaaaatggggtccacagttgaatagatatccttaaatatacatagaaaaatatttgtattcaaatatttgtatacaaaaatacacatacaaaaaagttgtatagttgtccttaaacgtgtattaaaaatatgaagaaagctggggaaattgcttagtcggtaaagtgtttgccttttaagtatggggatcagggtttgattccccagaagtcccataaataaagcatcatgtggtggtatgtccttataattctagttttggggacacagacaggaagatcactagggcttgctggtcagctagtcaagtctcattggtgacctctaacccagagagaagtcctgtttcaaaggcaataggaagttggtacctgaagaactgaaccagagattgccctctgcccccatatgtatgaaatgtgtgtgcgcacacatacacacacacagacacatgcacaatgggatggtttgagtggggatggtccccaaaggctcatgtatgggatgcttggtactctgctggggaactgtttagaaaggattaggtgatgttgcctttttggaggtgtgttgctgggggtgggctttgaagtttcccagttagctctgtctgcctcatgattggtgtctcaggattactctccagcatcatgcctgcctgcttacttctatgttccccaccacgatggacacggactaaactagtcttctgaaactgtagtctcaaaacatttcattttatcagttgccttaagaccatgacgacagtagaaaagtaactaagacacatgatgaaaaaatttaaccaaatgttgacattaaatgcatggctaattggcttatggtttttcctaagccttgggttttctgaatttcagttctatcctaaatgaagaaaggtattagagttcttttaaagccagccatttaaaaaggctctgtctatagcatcaatggtcaattgtgttaggtggctggccctgaagactatcagtgccccaagactcagtatctcttcatcccagactgcttctctttctcttcctgcacgatgctggtggtgtccttcttaccctgaaggtcaccaccactgtgcaatgaaggcaaaaagcaaacaggttactccttggaccttgacacatataagctaagtccccaccttaatcactcttttcatttgtcctcagtttagcttctcctaccctcagtcaagttagtagacaatatagtatgtgttttagcatgactaaagaactttagtgatttttatcttatttgttgagatgggaatctctcatgtagcccagattatccttgcacttgctagtagctgaagatgaccttgacctgctggtcctcttgtttcttcctcccagatattgggactgcagcatgtaccctcatgcccgatttacacagtaccggagatggaacccaggggtttatgcatgctaggcaagcactctaccaactgagcacatcgccagacctgtttttattttattaggaacaaaacagatttatggagtacattgcaaggggccatagactgggtagtaacaagattgttgtttctagcctaaagtgatttgaaaaagaaagaaagagaaaaaaagggaaacaaacccagccgttacccactgagcccctggtaaactcttggcctgtatttcctctttttatccttactaaccagttacacatgttacacattgggaagattagaggggttaaataattcacctaaattcaccttcacaggaatctatcaaaatgaaacttagaccctcatatctctcatctccaggtctgcacccttacctgctaccttggtaggcagtcatcagctattaagattggctgggtaaacttattttatagacattgcccagatgaacaaagatgtaagtcaccctaaaactcacagccaattgatgacaagggcaaggtctatgtatcccaactaccttctcagtacttcagatcttcttgatggatatccagtgtctcaacaactggagaggccacggaatggatggggttctttctccaaagcactgtcagactcttttcaacatgtgtgtgagagtgtgggtgctcacataccatgctctctgaactgaagcaggaggacagctttggacagttcattcttgcctctcaccttactgaggtgcctcctctcagctggtggcatactctaacctgcctggcccttgagagcttgtagtaattttgctgtctctgccttccccctcagtgttagagtgctggattacagacgtgtatcactacgtccagcttttcatttttcagatatgggtcccagggataggatttgggtcttaagtacttttgcaggttgggctagcaataaaatactctaagtattttaactatgttggttatctgcactatcccaggctcttgctgacaaactagacttaatttcatctgctttgattaatgatctcattctagggatttagaagttctcctctggtggaaaaaagaaagatccaacttttaaaaaatgaaataaaattcttagttgttaaatattaagtgaggtctttaaaaatggctatttggactttaagaattgagtctattaataggagacatgtacgttatcaaaaggaatgttcccacaagttatgactaatattctttcagaggaaatcactaacaaaaagagattttccatataacaagccatttatttcaagcagcaaagtttaataaagatctgaaataaatcggttgtaacaggaattgaatagaatttctcagaaaacatcattcataatgtccaccagtccaacagctcaccagtgttctgtgtgcctcccgtggctaaaaggtcgggcaaaaaaaccatgttagttcctggcacaggtgtgagccaccaaaacacgaccttcctcgttaacaaacattttttgacagtttcctgtgatccagactttgctatatactgtgcatgccctgatgtaagtaaattacactaaaaactgaagcttgtctaaatgactgaggcatctggttaaggagatggaccaggtgatacaattcttgcctcacttggagtttgagcccaagaacccgtggctcaaaccaagagcatagcagtgtggagttataatcccagagtgaggatgtggagataggaggaggttcagtggagctcaggggccagacagcttagtgaagtctgacccagtgagagaccctgtcacaaagaagaaagtgaatggtgtctgagaaaggacagctgaggttgacctctgacctccacacacatgcgcagaggaaagagaaagaaacaggcacacaccgtttaagaaactagtgaagaaacactcctaaagccaacacaaagtctgttttattggaggtttcttctttcctgtcatgccgggagggtgacattttgtacagaagcggcaagttcaactctcctcttggtgtgaaaggaaagatgaaaggctgtttgtgaattgctgcggttgttgttaggcaacggttaattccactggagaattggttctgcgaaaggtggaattttagaaacctacaaggtcggaggcagtgtgttttcctggatagtttgaacttccttcaaggctcgctcttctcaccgagcctgtaaaccttgagggtggccgggctgacagcttagcccgcggagctgtccgtggtctgagaggtcagagggaaacattgcatgtgggtctctgactttcctgggggctgctgtgctgctgtctgatctgtaggactccgcccaccactcagaacagattgaagagttccagacaagccccttaaaatgggccagcattttacctctacatttgagcccagttttcctgccttagatcaggaaacaggagcctgaactgatttttaaaagttgaataatgaagacttggtttttaaagaatgacagtccataatatgtcatttcttcttgtcttggattgattgacaaatcacattcttgaaagtttgcttctaattatggcacattacaaacacgatatacgttgtgctttgtacatatacacagatgtgttcatacaacagacacaatgggacaaaaatctgtggatcccttgggatggtaagtatctggcagacaagagtatcctatgtgaggggacaatctatgcgactgacccttaggcatggtgactcatcctcaggtgctggattctaggtgaggtagcttcgttcttgactaagaatgaagaagggcacatcagacagtcctgacgccaagtgatgcttagtaagacaaagactttaactcctgaaatgatcctgtaaccaggaatgctatttaaaatatacaggaatgtatgtatagcatatgtctatatgtatgtgtatgtgtatgtgtatgtatatgtatatgacagcaggaggtacttgttacttttcacttctccaggcattataatgtcatttaatcctcagtttccccctcagtccacatttcctgccacaacatcccaaggtgtctgttgtagagtggtagatgaaaaaaaaaatctttgagatagggtctcaactatgtatttctagttggcctggaacttgctgtatagaccaagcttgccttgaattcacagaaatctttgcctctgcctctctgcctctgcctctgcctctgcctctgcctctgcctctgcctctgcctctgcctctgcctctgcctctgcctctgcctctgcctcctctgccaattaaaggcattcaccccctcacttggctgaggggtgaaattcttcatggacagagctgagttttcttgcttggtgacaggaaaacaaataggaacaagaaaaatgaggaatttttcaaaaccacatgggaagagattcctgattccttcagttccatattcctttcttctgtattctttatcatcagttaaaaggcctttcttccccctcttcccgcaacaaacaaggacaacaggaagtatgtggcccctctgtgttaagagaaggcagagatgcaaggtgactctgcaccctacctgatttgacacatgtaggcctgccctcataaaacatttataaccacacacttacatactcaaagacaaagcaaatatgcatacatagttatggtgatatatacctggaatcctagcatttgggaagtagagccaggaggagtttgagtttaaagctgggttacatagcaccagcctatctcagaagtaaaaaaacaaaaatgagcatcattttcacctactactcatgatgatcttgacaagaaatgagaattcaatccatcaacactagtacgagccaagttgagtaaaatagatagtgctcatcagtagggctatagagagcagaattatgaattattattattatgaattatgccttcagaataatttgtctcacgtgggcctggcctccatctctcttctcactcttatttaacccgtgtctcctctccatcctgcccccctccctggtaaatgacaccgtgtaaattctaaagggtgtgcatgaacatctactgctctacttgccaggtgtgtgtgtgtgtgtgtgtgtgtgtgtgtgtgtgtgtgtgtgtgtagaagggtgcatggggggcaagaaggagagttgccccacctgtgtgtaaaagaggaagactgggaaaagcttttccttgagtctgatgctctcctactatgtgaccctttctgtaattgacaaaagcttaatcaaacactagggggggaaatcccctagttttttgggttttttttttgtttgtttgtttttgtttttttatctttttcttccttgccttcttccctcttcatgtatcctcaccatgcctgcctgccttccttttttcattttcttttctttctttcctccttttttttgaaaaaaagacaaaatcttgctatgcactcctagctaaccttgaacttgaactggcagcaatcctactgcctcagccacccaactgctgggattacagatgtgacttggaaaaggatctctataagtgcagaaactattgtgtgtttgcaataccattttttaaaaaatttagatgagatacctggagatcatatgaacaacaatcaagaatggctcaataggaaacattttggacccctccccccaaaaaagcccaacaaccctttgcttttagctcatctatttatatatccacatgcttgagatcgaacatacaactttatgcaaaacacaggcttcctgtgaggatgctgctctagctccaggtccccagaagcaacaaaacaaataccccattcattgctcgatgacatcagccagctcctgcctggtgacctaaaatgagttgagggacctactgtcttcatttgtgcttgccttctgagttctccagaaaaaacttattttttaaatataattaatatttttgttaatctggtcaaggaattatatacttattataacacaatgtttataatttaatcatataaaataaatgattaagatatactgtgaatgtataggattcttaatagattcacattatcataaaatacaggatttatttatgtcatttttacctcgtctttacctattgttgtttatcattgttggtggtcatcacattggtttttgagatggggtctcactgcattgccctgtctaaccttgaactcctgaactcacgcaatcctcctgagtcccaactccccggggactgtcagtgtgttccagcatacccagcttcatttacctatttttaagtgttgtaaatgcttcaaaacttaaactttgtaatacaaatgttgcatgatcttctctcgggagaatttccttagcttttctccttctaaccaccaggcaactgagaaagctggtccagtgtctgagatgatggtcgctggtattaaacatttcaatgtgagaagggctataaagacttcttgtcctcccagccttctttacgacagttttgtctattgtctccctcatattcacttgccagcaataagcagaaatatagctggggctgtgttaaaaaaaaaattcattggtcacattcattcctcttcaccagggtttcctcagcagtgccccggagcagggaccgcgccagccagcagaaacagctagttgttgtctgcagtgaagaataattggaagcatggtgcctgtttcttttcctgtgagtaacaatccagccatttaacattctttctcggtgctcttgaactctgtggtagagcctgtgttcccggctcagttggggccaatccgagaaatgccgaccttcctgcctgctgctggcccattcagtgtggagcagggacagcatctgatggcctggctcttcgatacagagctagtgacaggccacactagcatcaggctgggaaatgctaatctgggggaaatcgtgataaaatttatgacagttatatgttaataattcccctcaatcgcagaaaggttggacaactttgcactttcttctgctccttgtaccacgacattctttcatcttttctggctaaagtatattgattttgtaaacactccataaaatgtcgcctattctcttctcatatgtaagaatatggtttttatgctatttgttaatcaagaacatatatttgcctctgtgtagataatgagctttggagtctctagtcctggtcatctttgcgtgtttttcctgtccttttctagagagttccgataggaggacatccaagcctactatcgagattgtttgccccgtcacgtactccttggctttgtttgcagtacaatcagcttacaatttttaaacaacttttctatttttgtatttattccatgggaattaggctcccatgcctataaaataaccagagaatggttggttaataaatagaaatgcctttttcttaaacgtgaagatatttggagagagggagtctggggctggtgtactggctctgctatcgtcgtctgagatgcagtagtctgtcttccccgacggagatttggttgtcgtctgtgttcccatcctgccgtttttatcaagtcatagctgtgacatggcgcacgcagctgcagctctcactcttgtattccagacaggaagtggagaaagaggactatcaactggagaagcttccagttcaattctccctcagcagggccccatccactacatccctgacctcaaattgaagcaaactggaggactgagttgtagttcaggggtggggtgtttgccagcattcacaacccctcagttcagtcctcagcactgcaaaggaaaataggaaagggcaatggaggaaccattactcttaaatccaagcacattgccacgtcatattaaagttcggtgtaacaccagcaagttctgctaggagcctccatcatagcatagttcctagtccgtgcatgtggccttgcacctgaccccaatgctgccacccccacttttggattgggttggcatacatctccccagtcatctatttcctatctcttgtcactttcttgagataatttccttatacatatattaatttttattttagctcagtcttacagatcttttgaaagggaaactcatgccaaggtgtatttatttatgttccttccatcttaggtttattcatttttagatattattgtttctctttttccttcttgagatcagttaacgttgatatttgttttcccaggtattgtctttaaaaaagaaagtttcccattaacgtattttttgtcgttgttgttttaatttggtttgtttttgtcttgataagcaatctaaccatgaacctttgtctcagagatttgccatcagtttgctgagggacaaatgtaattttagtttttcagctgtgacatgtaaggtcaccaagggatttgatagttagggcagtacattgccctcatttctttcaatgacttttaaaacagctatgaatacccctgcctgccccacactcttctacagagctgagaggaactgcccttaaagcctacgttcctttccaggtctatctaatggaggaagaagttatacttccatcccagaattccaaagtccacctagaaccattgtctgtaatcccagaactctgtatgctgaggtagaagaactgagttcaaggccagtttgggctcttatgtgagacctttctttaaaacaaaacaaaaaacaaacaaagcgcccatctgggagtgaattataagaagtatgtatttattatctttgttcctgcctttctctactgagaaacaaatcatccgtaatggtggaaccatgggtgggacacattgtggcttgctctctgtatcagcttttcttgtagccatgacaaaaatactggagaaaagcaacctgcctcaggagagctttcatttggcttaaggtttcagtccatcacagcggggcaagcatgggagaagagttcacagaggtgggagtgtgatcacttttgcatagtgacagcaaaagacaggcagagagggggataggcatggcaccatcgacgagctgtcaccctcagaggcccatttctagttgcctagttgtcctctcactagaccctgtgtgtgtgtgtgtgtgtgtgtatgtgagtgtgtgtgtgtgtgtgtgtgtgtgtgtgtgtgtgtgtgtgtgtatgagagagagagagagagagagagagagagagaagccttgactagactaactgatttggaactcactgtgtagaccaggctagcctcaaactcagaaaaatccatctgcctcccaagtgctgggattaaaggcatatgccaccatgctaggctgtggttttcattttgtgtttgtttttaatgtgtgagtgtgtgtgagtgtgtgtgtgtgtgtgtgtgtgtgtgtgtgtgtgtgtgtgtgtgtatcagaagacacacgaacactcgcccaaatgcctgtgggcatgtggagatcagaagacaaatagtgggaatcgggtcagttctggtgtttggctgggtgagtcccagggatggaacttgggttgtcgagcttggtaacaggcacctttgcctgttgagccatccagttggtcttgcatttgttctttgagggactgaaaaccttccatgaaaggcttgtgtagcagtcagtttgggctctttcagagacttgcatgtgaaatgcagctttacgttactcagtgagatcacttctctttttctttgagttctacatttctatgagtgtgtcgcttgggaaggaaggcttttctctcctgtctggttcccagtcacaccttccacttcatgccacagcagcacacttgttcccagcagcaatcaaggatcctaaaattaaactaaagacttcaagtggtaccggttagataggaaagctgatgatttcttaccacagggacaaaataaaaggagagttttattaaagccgtacaactttaacccaacttttctcttctaatttatttttcttaaattattttagatatcctataagtatgatttcactggaagattgtacagactttgacaagtctttggaatgatagctctctatggcaaaatgtactccgagaaaatatttagtattatatatgaaataagtaaataatctgtgtatacaagaaacttttcaccttgaaatacatgggttatcatatctgttcctggtggaccctaaccctaaccctttattattgagattgcagtgtgacagccccaccccacctccacagtttttgccactccccattgtatcattgggtaagagagggaccaaaaaccattccattgctgagaacgacagccttcctaacaccaccaacaccactgccatgtatgataaagaaaataatcaataaatcagcacattttaaagccaccatgtctcctcttaggtatttttcttctggactgactgtgaaaggaacttgacttcctaccagactttgggagacatgggaaagtttgagactagaaagaaaagtgtctgttgaaaacagaattaattaggcaaaaataaagctgtataaacttgctatcaggtttgaacataaaactgtatttctatatagcatatagctgctaataatatctgctgtaactgaagctctaggagctgagaatgtatgcttagtgaatgtaaggccccagcttcctttctggtactaaagacaaaggacgggtggtgtgtatgcccctaatccagcaccctagaggcagagaagggcagatcaatggaagtttagaaacagcctggaccacctaagaagttccagctagccagagctacgtggtaagactgtctcaactgtaaactggctttctgttgacagttgttgaatgttcaatgatgagtttggaagttttgtttgtttatttactatttttcctatcttcaggagtatttaacagacaactgctttagattgatgaattcctccctaaagggggttttataaataaatttatcagtattattcaaaactggcccgagttcaatatgttaacagcacacttcaaacctgtacacaaatctaatggctcatgctttggttgaattgaagagagtagactcctatagtttcataagtagcgtttgaaaataaacattgagctatttctgtgagaaatgtagttcttaagccaagtcagtggttctgtagccgtctagtttttgaccattttataaaatctagataatctttcgtgttacttggtttgagaacgagatggggaaccaggtgtaaactcatccctggaatacaaaacttatttatttccttgtgtctctttccgttttggttttgtttacttgtttttctagttaagagagcaagaatccaaaatctacacttagcattttctaaaatcacttaagaacgatccatgtttgagagatttctaatgtatcctatagaactctgttataaacaagcatgctgtctttgctaagaataaatacagaacaaggactataaataaatggtgtgttctaagaggtcgaattgtagtgtcgcctctgtgaaatttctcacattctctgctggcccgggcttagggagcggtgatacgggcttaggacttctgtatccacagagtgtgccttgacacaaaaatatgcataatccctccgtagggtacaattttcacaggttgatagcagcacaagaaagcttctgaaatagaagtggggtctgaacgtatttgtccccacgagtcctgggtgattgacatgctagtgtgcttggtgacttttgggggttgggttgcttagattacaatcaaattttaaggtgaccatggggtgaaacacacactatcaggaagacatgaagcggctttactactcaaataaaattaaattccaggaaataaaatccttaaaggggctggttgaagagaagagagaagacaataccttatcattaaaaatcgatcagatacttactaagtgcgtctctgaggattccttacgtttcagccactggcagttcttggattacacaatactttcacatgcattatcttatttgatcttctcaacaagtagggaggccagagagggatctaaggatgaggaaatggcatctcagacttaagtgctcctgaagacggccacggagcacgggcaggtgttaggggggttcctccaaatactttgtcctctgtccctctgacctccaccaagtactgtgccatattgtctgaacagaggactccaaaggagaaagattatgttctcaaccctcagggagtttatggtcagttgagaaaatagatttgctaagcagaagactttaaattgttaatctgcaatctggataaaataggctgtaaacacagttgagctattttaatgggaaggtaaaatgctataaactctaccctgtgccctgaaaatgaatacagatcaaatggatgtttctaaagttttccagccaggccatcattgtctttgggagaaatcctcagcaggaggcaagccttgggctggtacatgggagcatgaagatacttggtgttcggagatcttactggcttctgttgtgtttcgtactaataactagaagcctatgggaggtcctcttggccactgttcggccctttaaaccattagagaggctccagttttaaggggaagattacctgcaggggtttccaaccattacctgcaggggtttccaacctcttgacattgcaacatcaacatcagcatctacaatgttgtaggccacatctgtagctgtcttggatgcatataacctatgtttgccaagctcctgattgtcccagaagcaaaattccatgctgcgtctctgttgttgtcttttcagcagcacaggcctgtgctgagatgagacagctgtggtccaatcacagtgtgtccctgcttttgtctgtctcactgcgaggtacagtgtctgggaggccccgtggggacttgccaacgcttcagcgagcagctggccatggtgattttacaaaaagtgcctagccaggttcagcagcctcttagacagttccaagatcgtcttccagatgctcgttggtaaagaatccgatggaataggcctgcctagggattatgccataaggttttgtctgctgtcagggaggtcttaaacaaaccaccctctcccgttgcagcatgtgggctgttaggcatcatgctgagtaaacatgttaacaggaaaaccattggaggtcccatcagagcaacccacctctctacactgagcaccttcgagcccacgtgacacgagcctgttgacgattaagcccgagtatgcagccatgcccgttggaccactcttagcctcagagtttcattctttgacttcctctttgaggatggaaatggatttctgctgagtcactgcagccttcctttcctcctgtggttgtaaacacagcctctggaactggctctatcgcacactagctgtgcaaccttgggaaagttaccagagaattcttgacgccttccgttcctgatatgtggcacctataacagctacctcagaaagttactgcccggttttggccccggggagagctgtgaacactgtgtgagatgtgttctgggctgtgttattgtttgctctttgctgctgttcctcttgctgcctgttccgagtctgttccgggtaccgcaagaatgagaagataaagtaggtgccctcagtgggtatacagtatatatgataaatcaccgtgcatcttctttgctcaacaggtgggaggaagtcacagcatctacttctgaatctgtgcttgccttgaggaaaaacggcatggcacaggaatgtggacgctttcaaccagaggattctgtacgacggtgtcggcacacagtaagtgccgagcaccatagaaacggtttttccgctttaattgttaggctggcagaatgagtgctgagaccgagcatgtggccggaggttgagggcgaggaggtggtggtgctcctggggacgtcttccaagaggcagtatccttgagctcggctctgatcagtgagtaggcgttagccagtaagagaagagggctaagagtgttccaggcagaaggaacattgtgtgcagagttagggaggcgtgaaacagcacaatacactcggggaactccaagcaggcagaagtacgagtggcgccccatccttactgagacatacagcgtgcgtttgttaaattagtattagagattggaggctgggaaatgtaacgttgcttgatcattcgggcctgtagcattaaggaggaacaaccattgaggaggaagtggctaagaggcttttaattgttccctgtatacgtgctcagtgctgtcttggatctgcatcaaccactcctttttttttttaaccccctttcctttttttttaattttattttttatttatttatctttttgctttttttttttttccaaaattgagataaattttcatgtagcccaggctggtctcatatttcctgtgtaaccaaagatacccttgacttctgtcttccctgcttttacctccaaagtgctgagattacaggcctatgccagcatgcccagttttatgcggtcatggggttctagtcttggcctttgtgcaaactagggcaagcgttctatccactaaaccgtatcctcagccccttcttatcctcttctacgggaagtaaacccttttcctccagaatgacagagatgaatccgaatggagaagctggggtcccagaattggtaccaacacttctatgggtaacacattgctttagatcagaggtcagcaaaccctgtcctaaaggtcggccccagtgcagtgccctggcctaggagtccatctactaggacagttcatccctctgtacacattcgctcatcctcctacaggttggcctatgctcggccagtaacagcaggttcaagagagacactggaggtaggcccttgaggctcggcttggactcagcacagttacttctggtccattctgatagccagagccagagagaggcacaaagccaacctggattggaagggtccagcatgcagccccagttcttgatcagagctgctgcaaagcgactctgcagacagcagggagactggagggacagaacctggccgtgtttgaaatcccaagcaatcgatcatactctggagcagcacgcatcccaaccacagatttttttttttaaatgtcgtctctgggtctcacggggaaagatgtattcatcatacctgtctgttcagcccccacccacagctatgagtcatcactctcttcaactgaagggaccattatcctctagcacatgacagacacagagggggaggagaatggggctccttggtgaggcccagacccacattcctgcccctacctgatgaatttcactagggaaccaggctcgattttaacccattaaagacataaagcaaattgttatcccagatgaaaccagtggctgaactgaacatcctttgggactaatgtctaaacagacctacacaaaatactcttgctcatcactccgtgccccacttaaatgcaggtggcattaaaattggtcactgatgtctctctgtctagatgggactgaaccaacagatatgggacagctcctttactcactagctgttggctggtaccccacccccaccccattattgctctctctctctctctctctctctctctgtctctctctctgtctgtctgtctcatgtgtccagtgtgtgtgtgtgtgtgtgtgtgtgtgtgttgtgtgtgtgtgatgtttctatttcttggggtacatgtgcgtgtgtgaggaggtcagaggtaaaacatggaatgtcttccacaaccactctccatgccgttttgttttgttttgttttgttgtttttctttgtttttgttttgtttttgtttttgtttttggagacaagttgtctctgatcctggaattcatcagtttggctagactggctgaccagtgagcccagggctccccccatctctgcctccctgccactggggttaaagatgcatgccatcatgcctgactttacaagggtacctggcatccaatcccaggtccagatgcctgcacagcaagcattccaccaactgagccacctccctaacccatgctcctgctcagcttgtcaagatagggtctcaccctctagacctgattggtcccgaacttgtggcagtgttgaatttatagtcaggggccgctgtgtgatttttttttaaagtttcttgccagaaattcatcactgttatcaaacttgtttcaataaagagtgtttagtataaagaacaaggatgtcaaaaacccttcattgcagtcctttccctggtgccaggggatggcagagcacagaactcatagataacacttgtttgttaagaacttcctgaaaggtgacaaacagaaaccaaactttcagtcagacaaaaaccacatggcttaggtttgagaatattccttctgttccaaagccactcaggggtccttcggcgtctgcaggaagctgacgccctgacaccaacttccatggagttgctgctgttgagacttctgtaggaacagcattcgtgggtggaaggaacatgccagatctcagggaactattagatgcctgttgactcaggcggcaggaccagctgtgaacaggaatgtatttttacgtagctgcagtggaaaggaacaggcctgttgaaattattgccgaggtggggacagaacctgctgggatatttgtggaaggtttggtttatgggggatgaggagatagagctgtctcaggaggtacagcttgaagattctaaattcagaattaatgctgggcataatggcacatgcctttaatcccagcatttgggaggtgaaggaaaggggatcaggaggtcaagaccagccttggctacatgagacacacacacacacacacacacacacacacacacacacacacagagagagagagagagagagagagagagagagagagagagagagagagagagagattttgattgattttcttggataggtcacatgattgaatgatatagctaccaggtaaagtcctttcaaaattagaccccaacaaagatttctttctctcatgtttctgtatctcccacccaccttaggaatgtcttttaaaaacacaaatcctgccagccagctgcccctggaaagaagtcaagtgggatgacttcctgttcagggggagggagcagggggtgtcacctctgctgcctctcctctcctctcctctcctcccagctcttaggcagcgcgcaaagatcttccttcctgcctgcagaggaagcccatcgtgttctcttagccctaccttggcattccttgatgtctttagagaagcagatgaccccggctgagccagacagtcagcagaacagcagctctcgatgctgcgtttggaaatttccattctttgcttgcagctctgaaaaaaaaaaaatctaaagagcccagtagctgggaaatttccacaatggaaaattttaacatattctttagctctaaactgtgcaggtttatagacattatttttttttctttctggtaatttccttctttaacaacaatttatgaacatggtaccactggagctgagggaacaggagggcagggtgacctagggggtgggcatagcttgcttagcaggaggctgcactatataacggtgtgaccgctcagagcaccaccatcctgaggcccgctgggtgggaactcatccaagtcgagctcacttgcccgggagcactgcagggaaatctgtgtagagccttgaaatggaaaatgcacggatacaacttgggagcctgacatggtgagtcacgttgccagcaaaagcaaccctgagcagatgatgatccctaagaccgctgcttcctgaacctgaacttaagctgtaggctctgatgcagtcagttgagggtgggagctaggctgcattaccaacggatgctgaccatccaggtgatgctgatgctgcccttcctgaggaccacggtgtgcggcatagcaagaccttcgtcagcatgcagccagtgccctgctggctgaacactgccagagggtggctggaggtgagctcaggtgacaaagttgaggtctcagaatggaactcaaagtcctctggagagatgctccatgtcaatctggataaagaggctcctttagaatggagggggtgcacagcattgccagaggcttggcttggagaatgcctgcaatcaggacctttccagagaaactcatgtgtaactggtgatggttccttagctaagcctggttcctgaatggttgtccagcactgagtgaatgaccagtgaaccagttcccaacactgactgtgacccgagaagagtcctgagaggcagtttctgccgctcatgttcactgttattgaaataaacttttaaagggacttggagattttcttaacagctatctcacctgctggatagaggaaaggagagggagagaggcagaggggagaggaagacaagaaaaagaggaggtagcactattagtctaggatgcttccacctcgtgatctgtagtgtgtctgctccatgcattttttaaagcaacacttgacctagttctgactttctattcagttggacttggggtagtttattagtccatacacagaggacggagcggagggaaaaccaaaggagatggcagtcatgcaaatgtagtagttgcgagacagacttgatcacatggactattatctctgtcctgctatgctagcacccacatggtagtttaaaatacccgtgactttcagggttgcgtagggatttgaacatctgcaggttggttggtagcgtcttcttgagatacttcctccctgacgagaggtgtgattcaacagggagaggacaccctctgggctctgtagaggagagctgattggtttcctttagcgtgatgtttgatgagtcattcttcacctaggagttctcttaggatctgcagtcaatcagacaatttgcttgatccatttaaagtcacattattattattattgctattattatcattaattactcaaaggagtgcttttgttttatgcttcaggtgaaattcacataacaaaatccactattttaaaggcagcaatacagaaacctgtagtgtctttgtgacattgcacaacttccccttgtatccagttcccaaacatttttatcactcccacagggaagcctcgcatccattaagttgttactgcttgatgctggctccctccttccggaacctggtcaccgccaatttactttctctgtggttcccggtctgggtattttacataagtgaattccaaccatgtgtggccatttgctaagtcacatctccttaagaataaacattatggttctagggaaacctaacattactgagtgcttacagcacaaggcgtgcgacccttacaagtagactccatatacagataagaacatggagattcggagaattgcccgagacccataccttctggccgagcaacgaagaggcttccatagccaggcccaccttcactagggcatttcccactcactgtggctctggctcagcatcctctgtcaccttgcagacagatgcgtagatactccttctcaagtttaacaacttcacagagccctgactcgaattccgaatgcagcgttagttgcttccagctgctttttttcttttagcggtaagtccaggcaaactcctttgaagagctcattaaaactgctaaaataaagtcttagaaacaggtgcattcattagcagaaaatgcagacgattatgttaatatcacattcaggtgacaaatttaaaggcctcagactcatgaaggataaaaggaccccccccccccacccaggctagagttaacttcttttgtggggttttgttctggatagcacatgactgactacagctgtccaaagtgggaaacctgcagtgttagttcacaaaaataaagctgatctgtgatatcatgctcctctttatgatttcttggatctctagttatgaaaagaaagctgagggattgtctacaaccttacggtcggatctagcttgccattggtaacttattgcccaccaggcccaaagatgattgattcggatatgtcgacaggcagggcattgcttagtttggctgcatacacagaccctggttctctgcactggaggagtaaatcagtgtaggcaatgattttcagtttggaccaaaaaattatttttactgtgctctttttttaatttaaaaaatattgagcctgcaataagattgtgtaaagtctttgttttgagatgtgcacattttttgtatttcccagattttctacagtgaattttcaattttgaaataaaaatattcatttgcttatagttttttcaaagtatttaaaaattacaagggaataacttaactttcttccattaattaaatatccctgtaaaatctgaataatgtttaattgcctgggatatgaaacctagacaagaaatacccccaatttcttaccttttccaactctaggatatttgtggtcattttggttttccattggtaaagaaaagagacaaatatggctaggcatcaagtcatttaataaaaaaattaattgtgcaatatattattggacattttttcaggtaagtatacatacacaggaagggatgcacctgccactcagaaaggggaaaacggggagactcttataggacccatatactttatttttaaaattttaagttatacacttggggaaggctttgactagctacttttttctccaaaatggtatgcttaaaatgactatttcttattgcacaacatgaatactgaaggcgcaacacatttacacagcatgtttacagattgtgtgtgtgtgacacacacacgtgcacatgcgtgtttgtgttcacgagtgcatgcacacactaattggatgaacagtgataagctgagcaatggctcctgagtaggataatcctgtctttgccttctgtcatcttcaagtcttcttttctcttcccctgtacatttccgccttcgctctctcttcatccctgctttgagatgggttgggtgaaggcacacagtatgtttggtacagtactagtgttctcgtatacagaataagctctagcaatcagtagatacctgaaaccatagatagtgtcaaggtccataatgtaattccttttccattataactttctgtatgcttactgcatgcaatagccataacttttgcagcttgggactgactgcaaagtaggacacagttttctgtcttcttttttttcctaccattttataggtaaaagatttgggtgttttgttttgttttgtttttttctgtaggtctcagaatcctcagtgtcttctttttttctttccttagcaagttaagaaagttcacctcttcgcttaaaggaaaccctttatggcttctctgttgtcaccaccatcatgtctttaagccattagtaagtcacataggggctacttgaaggaatcactgtgatctcatggcaagtaaacaaggtagccaagatggctgctgagtggctcatgggccacttacaatggggatacactgggcaaagggataatacatatctcaggagggaacggcatgaactttcatcctagttcccagaatgacatgcaattttaaatttataaatctttcatttttagaactttccatttcatattttaagccgaaggattgctgaaacctaaggcaagaggatacagttgtatacatgcaggcatacacactctcccagttaggactgctctcatggaaagccttgctcccagctgccaccctcattgtgattccctgggacttcactgatgcagctccttcgctgctggacagctccgcatcgcctacaagtacttttccacccacctttccttcgttcaattctctgagctggcactgtcacagaagcctccgattctacacaaaatgaggctggtggccagcagaggctcctgtccttccagggtgaagcatcagcaccgtaaggagagcaggctgagcccagaatctgaagaaaaacacaagaggtgaacccaactgtccttctcaccgatgtctgtcttctagaacttaccagctagtcacgccgctcgactgtgacatctcttcccatcacaaacactcgtcttattctcattctcacttcatttaggtggatcatcagagcacacatagtactataaattaagtgagaaatgggggaggagaaagaggaggaggaggaggaggagggggaagggaaggaaaaggaagaaggggaggagggagaggaggaagaagagtctgttactactcaggatccagtcttaaagaagtataacccttagggtccttgaagaaagtaaggaaactgagtcatttggcttaaggacactttcattggtccatacaataatggccaacttgtgagctatgcatacaaacctcagtagcctcctattgtccagaggtcttcctggatcatcctcttattcctctaacacactgtgccacacaagaaaccctgagattatttcatgtggggaccaggtcttaaacgatagcccaatgtttacaagtactgcttgagttgagccatgtgtctcccagtctccttaatactaaatccttctgttagaagaaagtagaaggtccagcagtatttcggaaccactcattctggacacaaagaatgcagatagcagaagaaattcatctcggaggtcaagtgccctgagaaaacagccagacgccccaccctttaccccaccctgtaaaatgagccaagatgaccaaagtagcgatgggcttttgagaagcaaatttgggtgatgagttaagaagagaaaagactgaactgagatgttggctaagtaagtagaaccgagaggattttaggtggttattatttaaggacttgtaaagaaattcatacgttagagagcacaaagaaaataagaaacccctctctattccatcacctaaagggagccactgtgtgcaggtccagaggcagatcaccttatctcaagctacttcctgccctccagaacagctattccttgcccacctctggcagaactaatatcctgtgacctagtagatagaacctgctgggacctgttaattttgcaggccattacctcccaccaacctcaaagctaggaatgtcatcagagagctcccgagcacatgaaagccgtcccttctctgactgtacccatgcctctggtctgcccaccaatgtatttaaacttgccttgatttatgactttctgcaaaactatcaaaactccatgaaactgtttccacaatggaacatggaatttgaggtaacctatgtctgtttcccaggctgttgttattcaaaatggctccagaataaaccctctaattcccattttttttaaacagataacctttgtgagtgctaggggaacaccatttctgcatcatgtcagatgtagaaataaaagcttattttttaatttacttggttttttattgtgcattgagtgtgtgtgtgtgtgtgtgtctgtgtgtgtgtgcaggacacacatgcccagtgctagggtggaggtcagagttcagtctttgggattcagttttcctgtcttgttggttggagggcttgaactgtggtcatcaggagtgagcagcaagcactcctactctctaaaccattttgtcagcccattcattgactgactgactgactgactgacacaagatcttgctaggtagccatgctagcctagaattcactaagtagccagattgctcctacctcagtcacctgagtgctagggtagtttagaattgtagaaagtgacatgcagttgggctgttatgtttggctttagatagtcctgtgaggaaacccaaaccctgacttctaaaatcctcacctgtaaatctacgatggggaggcagttaattaggaccctctgttgataagcagccatagcactgaatgcaataagcactaaggatatttgaattttcttctgtatacacatattctaatcctcagtcagctcctctattctaaagcataccgcgacaaggaaggagtgtttccctaatgtcttctgtttagaaatcaactttagactgaggcctttgaccatattagataatgagagccgctatctagcttttgcatattggttgggccactctggctagttggacatctcctttgactggtcactgcctagctacagcagttagaaggaaatccgaaaaggtctcttttttattgtaaataaaaggaggcaacaatgatgatccatttaagcaagttttggtgtgtgtgtgtgtgtgtgtgtgtgtgtgtgtgtgtggctctctaacttttgggacatgctatcccattgaacctggagctcacttggactggctggccagaaagtctccatctccccggccctgggagtacaggcacacactgccacaccgcttggtgtggtgctggggagctgaactccagccctcatggctgccagctgaaccacctcccagtcacagtactctaacagagagtactaggtgttttcccaagtccggttctactgagtatcacatttctgcagtgctgctccgaaacttgggctttgtcaacgctaggcaaactctcctggtgagctaccccagcccaacctgtactcttaaatttctaaacttattggcgtttaaaatgtgcatcgttttaaaaatcccatttatttattaggggccctccccctccataagcttgtttttgttgtgtagagctgaaatgattttactaatttattcctttatgagaagcaaagagaccactctgtctctgctcctgggtatgccttactaaatccacattaggcagaaatttgactggaaaattcccaagctttgcttcttcatcttacaaaacccaagaaccccgtggcctctgtgctctgtgttatagtcagagagcattgctgtagcccaaagggtagctttcgccaggtatgagtgtggcggctctccagtcacatttaatgagcagacacagtcacaggccacttcctggcttactcatcacttgcacacaggtcacagaggccgaagaagaaagccaatcactcccaggtaacccacagagcatggcaaaggtaattgcttcatcgaaattatagatttttgaataacaatggctgtttatttcactgacatcaaattgttagaccacctcacccattttcctgaaaaagatgtattaattttagtaaatcatgtttttcgctgatgtttagtactcgcaatatagtttcatttttaatcccaagctgaaagtgatttataacgcttctcttatcagtgatatttgtgttgtagtttgaatctgaacacctcaccccaacacacacacacatacacacacacacacacacacacacacacacacacacaccaggttcaccatgtgcttgtctcttagctggtggcactattaaagttgtagaatctttaggaaagaggcctagctcctggaagtaggccttttgtggtgagcctttgaaaattacagcctggaccctggttttagcatggtctctgtttcccggcccccggatatgaattatctcctccaggcgctcctgtcgccacaaacccaactcttcttctacaccttccattccacagtagcctgaagtcctccaaaaccatgagccaaactaaatctctttatggcagtcatggcagcgcaagtctgtaatccagcacttgggaggttgagggaggagagctgccatgtgtcaccggccagcctgggccacatagttccagacaaaactgggctacagtgtgagactttgtggcaataagccagaaatgagcctggtgtggtgtgtatgtctttaatcccagtactcaggaggcagaggcagggagatctctctgagtttgaggctagcctgatctacaaagtgagttccaggacagccaaattacacagagaaaatttgtcttaaaaaaataaaacaaaacagcaaaaacaaaaacaaaacagaaccaaaatgatttaagtttaatttaaaaaggagaggctggagagatgactcagcagttaagagcactgtttgcttttccaaggacccgggttcagttctcagagcctatgtgttgctttgcaatcacctgcatgcctactcccagggcatctgactcctgtatgtgatgcttagatacacatgcaggaaaaacacacacacatacatgtaaatacacagaatgggagaaaaataataatttgagaaagaggtgaagcagagggggaatggaagaggggggagaacagaaagaagggagagaggacagagggaagaaatgaaggaaagagtccttgttcctttaggtcgactctgtcctacgtgtccttatgtgaagctacgtaaacagaatgagtatactcggtccatacaacctttgccttgctctgttcctgtgcgtaggagcaggagtcacgtcatatataaagtgttaaggcccccacttcaaaatcctactccctcgttctcttaaattcatcaagtgatggtcccaccttttcaaacctttttcttgagtttctataatttcacatcatgcacccccaatcccacccatgcccttgtcccttcctgtccactgcctttgcagcagctcacaaagaataaaaataaaatataaaaacaaaacaataccaaagaagaacatctcatcgtggaagctatggtatgtcacaaggtatcacccagtatacccttttgtctacacttttttacttgcaaatgttcattgccatgagtcattggtctggttcagggcctctggcatctgctacaattctgtattttcaccgggccgcctctcaaatgtgctgtcgttgccctgtgtcagggagatcctgcagctttggatctgcagggctggctccttcactcactccagcagttacagatggtgtaggtgttggggtgggctggctcaaagccctggatctgggcctgggtagtagctgagctgggcagcccaccagttctgtacccacaccaccagggtgagtgagctctccagcctgtccccagctagttcacccaatgttgcagatggcaaggggcagggacagcacttctactctcctgacctctgggccagctctcctgcctgcctcaggtaggaaggggtgagagtgggggaggggaaggacctttctcccccacccatggcaccacatgggagacgaggtacagggccagcgttcccatgcccttaccggtaatctcaatatcagtactttaagaaacagactaatttgaagcatgggacattctgaatactaacctaaaaacacctttatggcatgcatttccatcctacaatgaggaatttccacgatgccaccaccaggattgttttaacaaagattcttctttcaactgtaggcaaatgagtgttgctaagttgtgcgtctatggtcagttcattttcactgaattaacatttagtttggtgacaacatctagaaaaattttgttcctctgtgtccttaacccctctcatgctggcaattaaatctgaaggaggccggatgaaggctctgccccatccacatcccaaatttcatctttttcacagctcagcctaaattaccactcattttgcctgttgactccttaactcttgctttattcagcacccatgtgttcaaaagacacacaacagatgttgtgggttctagttataaattcaaagtcaccggggttttagggtgaaagtcatttaccatgtgattccccacccaccagccaatcaatccattaaactggcagtcaataagtccactattctagctaatgcagctcgtacagggtttcttggcctcgcaatattgactttaggactggctaattctctgttgttgggagtctgtgttttgctttattgcatggttggcttcatcctataggtgccaatagcactgacccccttccagttctgataatcaaacatgtctccagctgttaccagagttctccaagggagggagaggcttggggcacccctctcccacccacccaagaaccaggatacacatcatgcctttttactaggttgtgaagatttggagggcacggacccagtctgattcatccctctatcaccccttctccatcatctaaatttagtttctggcacagaaatgcttcttgaatgttctgaaaagaacaaaatatctccagggttcctctactgtcgtcagcggtgccacgagctcagaacagaaatcaggcaacctggatgagtcacgtaacattttgtgtgtttgtgtgtgcacaagtaacgtgggcacgtacatgcagaggccagagaacaagcacaggaatgattataacctcaggctctgcccaacctgatttatttatctgcttaatggtttatcccattaaaaagtgtttgttttgagatagggtttctcactggtctgaaacctaccgagtatggtaggctggtgccagcgagctctgtggatccacatgctgtcacgtccagcttccccagaccttaaaacttgagttctggggagcctaatgcttttgaggcttgtgctttatcaaatgagatacctttccagcctcctttctgatacttttttactatttaactaatctgtgtattgtagacctgcttacgtgcctgtgtttgtaaaaggctcacctatgtttgaatcgttttatgtgtaatgttactttatctagcggtgacaccaaccgttctggccatcacaatttatagtggaagtactcaagtcctagagacatattcttgggcaggagtgggtggctcctttcagtcatattgtcttcttgattaaaaagcagctcatagactgtctttattaatgtgaaatctaaagtttgtattgcttctcatcatatgagaggtgggatgtctcgggggctgtccagtgatctaagtaatgatgactctacacgtacgttcctggaaattgccagaaggttttaaaggggggaagggaaaaaagagtgagaaaaatttccctgtggggaaaacaaaaatatttttgtgctgtggaagtttctcaggaaaggagtggtggccagaaagtagcggtatctgagctatggggatttccacatttgggaaaacgtggtcataattaatgacttaggagagccaagaaagtgagccatgttggaaaaatagcatcttcaatggccaagtcattgtcaactagtggggccagaaaaataggattgttttagagggaaatctgtatttgtgggcgggtggttgcctgtaaatccttcctcttgtgggtccagtaaggactcccttcccttgctgtgagcttccgggccggacgctggcttcttgtctttagttttgaacaggatgcttggatctagccagcaggattgtttttgttctaatagagatgatgatcgggatctcttgagtgagcatagggaatgggattgcctactccgggcacagccatcattaattgaatgttccacatcccaggcctcatgctgagaacattaaaaacttaccctgacttggcgcaagtaaacttcaacttggggaatttcactcacttgtctagggtcctagacatgctggtttcaccctccaaactttcagccagctcttcctgtttgggatgctcactcctgaatcagagtgctctcacgctggggacaacctcttgcttctttaactgccgccattttctcttcctcaaatagctttgtttaaactgcatctgctcttgaattgagctcatcagagtgtccatggttacctctcattttctgcaggagaaagcagggcgggcaggtccagtccactctctcctccatctagttagggaggagtgtatgtgacctgctttgagccctttctttcatctcaggaatcagtgttattaaaacgtgtatgattcccccttgcctcctctctcaagatttttctcaagatcagaaatagcttgccagatttcagcagaattttccaaggagaaggtcatttttcaggaggggaaatacagcttaagaagaaaagagaaatctctgaatttgaacagtagatgtaagatctggtacggcatcaataaattcggcagactgttttgtgaattagaaacactgcaggtcagatcatgtcctccctgaagcagccgttccatgctcccgacccttgtgagatggcttctaaagttagttctgtcctacgactgcaagaggtatgacaaagcaaacgtaacgaggcttcttgattgaacttctgtgggtgttgcatctggtaagaacaccacagcattcagcaacaacttggtacatttctttttgctacaatgtgcctattagagcttaacattggtttggaatgtttcttaggaatagcccaggtagtgctgtctttatttcaggctggggcacctgagcttttttgttatctactgctgtaggacaaatttctacaggtttgagagactgaaagaaccccccaggtatttagtatgtctcactattctgtagatcttaggaggcaaagtgactttggctgggttcttgatttcaggtcctgaaggtaaaaaaacaagatatcaattagccttggctttcatctggatgccctggggatgaaaagctgcttgtaacgtgagctgcttctagaatctagagactctggcattcctgcttccttgattgctccatctttatggccagcaagcatcctcatgtctttcccccatctagaatcttctcagcttcctcttctgccagctgaggaaaatagtccctttaaagtactcacttggttacttcaggcccacatggaaaatactccatggaaaatggaaggaaattcagttgggaaattcagcagtacctactatggcagccatcatcacatttctacctactgtagtgaaatagttatccggttaacttgagatagaggctggaaacaggctcttgatagggcctagtcaaagaacttaacttgagaattttaatttcattcctttccttgtttaattttaaaatatacacatacgtaggtcttatttttaaattcctatgtatttggcctattttgaaacacactatgcttcaagggctcctggatttctaagaggtagagactagggctaggtttggagtggggtttctagagtgtagagaacagtgtgttggcaggtaaggaaggggcaggggctaagagttgaatgaacccagagcaatagtttattcctatttttaacagattcactggagatcttggaagatggtgatccctttgctattctcatgatgttgtttgttgtttatggtactaggaattgaacccagagccttgcacatacacaatcctatcactggaacccagctccagaccctttactatgttctatgaacaatcctagaagttcagacataaatggattttgtgtgagtgagcatgtgcacacattcgtgtgatttatgagtgatacttggtgatatatttttttctaagtatgtgtgcattttggtgtctgagtaagctttactcaaatgttgtgcccctagtgtgggtgtgagcatcacccattttaatttcctcgtgttgttgcctgcgggtaaactagaggtctgctgtcctgcctgggttgtgggccctgttgtctgctaatctaaatgtctgagcccacagtaggccatcttagaaagagaaagccaggaaaaggctgagatcacagagcgacagaagaagtgccatattcattctgttggtctcgtcaacaaagaactggaagaactagacaatgacattttttaatattttgattaaggaagtaggggataggactagagagatggttcagtgattaggagcactgactgctcttccagaggtcctaagttcaattcccagcaaccacatggtggctcacaaccatctgtaatgggatctgatgccctagtctggcatgtaggtgtacatgcagatagaatacttatatacataaaataaataaatcaatcttaaataatttaaagaaacaacaagaagatatcctctagaggtagaggagaaatattttttaaaagggtaagaggagatagctttggcctttggaaagaacatatgtaaaagtatgaaatgtaaggaaaagggatcatttgggagtctgaatgtttccatcgtccctcaaggacatttaggcttccttcttcttcttgaaatcatggccaaaaatacagggaaagaggacatttcccagatgtgtttccccacttctcccaggcagtcagaaaatgtcgagaaaatcagccatcatgctctcagacagagagaaagctcacctgccatagaagatgtgaaataacagcaccgagggagcaacatctccgactacaagccatgtgcacccctccggggggaaggggcggggggtggggggcagacagagtgcaggatcagtgtggcagttaatggtgtttgttgtgatctcttagagcaagacacattttgtgtcttttaacggtgctgtttttttccataatggaacacttcaaggatgctgataatatattacaggtgttatttttactcccagagtttgcactttaaaatctatccattcattcattcactcactcactcactcagaaatacctgtgagaccctagcatgtttcatcatttaggtaccaggaacagagcagcaaacaccacagataatgtccctactcactggaagcatatgtgtgtgtgtgtgtgtgtgtgtgtatggagatatatatatggggttagaaagcacagggagccttactgttcattacacgtacatgaggagacatgttctacatccatttatattggcgtagaggtgtacacagcatagaggcggacagggtttatgtggcttacaattcatgcccatcattttggggaagtcaagacaggaactcaagcagttgatcacactcacagtgagagctaacagagtaagcgcatccttgggaatggataggtcataccacaccacacttgctgagcttccagaggacctgggtttggttcccagtacccaaatctggcagctcacaattacctgtaactccagctgcagagactccgaagccttcttctgtgagaaaggctcagagcctgttgtgtcctccacagtagctatccctccctcccttcccttctcccttctcactgacgagccttggactgcttagaaagacaagacatggagccccaagtgatgactcacgatgctatctatgattcagtcataaaatcccatttccttttgatagatgctcaatttccccatttccctttgcagctaagggagtcttattcctagctaatgagatctgagtgaaaacctttggggatacatgtaactgtctggagttccaccccaatagttgggactgtggtagacatcctcattgtaagacaaaaggcatgaagatttaaagaccagcatgctaagaatggcaaggtagaaaggatgcccgggtcctaattagtctggttgagtggttgaagcaataccattaatcgtctattgatctatagtcttacataaccccaggctagcctcggacttgctatgtgcttgaagattgacgatgaaggaaatctatggatccttctgcctttacctctggtgctaggattacatgcactgccatgtttctggtcatatgcagtgctgtggactgaagccaggggtttgtgcatgtgagacaaactcagctacattccacccaaacatcttttttatgaaaaataacttaaagcttagcctccctctcagttcattattttatcggatacaagaagtttaaagaaacaaacaagaattgtcctttgaccatgtcagttttgagatgctctttagatatttatgtggaagtaactgcctggtgccttacggtctacaacagaatgagagttctggacactttaaatctagagaaagagacatgtagcgtatgactcaaatactacaacaatcctgtagatgtcaaggtgagtatattgcagtggctgtggagtcctcaagttagaagctggacattggtgcatgcaacttactcttggggactagagagatggctcagtgcttcagagcacaaatggctcttacagaagccccaagttcagttcaaaactgaatgagtcagctcacaactacctataacatcatctccgagtttccctagacacctgtaatcacctacacatacatacacacacacatacacatacacacaggtacacacacacacaggtacacatgcacaaacattcatacacataattaaggaaaactgaatcacataaaaactgactctcctagtacagtcagcttagcaaggctgaagttaaaacagaaaacccaggcaggctgctgtggtagagaatcagaaaggcccctggtttccagcaaccttctctctcctcggtgggaagactgccctagagaacttctttctgttaggctgctttctcacccgtgtggcacagcatttgggtatggctgcctctctctcccgttacataacaaacagcctagtgaaaattcctcaccagcttaccaaggagcctaaagtacgccaaattgagcttttagcacagtttcttgttgctgataaaaatcagcgtccatagtccaatttcatctgcctccattaaagctcttacccaggactgcagtctcagttctggtcattatgtccactgacgctcacagttccccgacctgggccccgccccagacactttccctgtattctggatttgtttgactccatctacagaaaataatgtgtggactgttgcaggattttgtttgatgggggtgatttcacccccacactaggttttcagaaatagctattgattgtgtgtgtgtgtgtgtgtgtgtgtgtgtgtgtgtacaagtaaccagatctttaaaaatggctttacagagtaaatatctttgtgctctgcccatcctgtgagcctgttctcctcaggtccactggcttggcatcttctgcgtgcttattcttccccttatcactgaggtgagggatgggccctcagcctttcactttgcctttccctgtttatcccaaccagctctcgtatttgttaagcaatgttttggatctgcattaattttaattccctgaggagcactgtgttcccaaacattgtattctgcactctcatgctcagatcactttgtgtgatgccagacacctcctgggatcccaggaaatgttctttctttcttttcttttcttttttttttttttttaataagatgggcaattagtctaggatgcccataaaatatgtttcctggttgagttcctcttgcctttcatttagacccagtgacttaggacaagcattacctaatagactctgagccttccggaggacttgctagtctctatgcatttctgcagaaacagagatgaatattgacggtcttccaggaaagaaacagtgagaaacatcggaacaaagacgctcacggctgtaaatgtgagacgctgggaagatgacagacgccttactgtgtaggcctcggtgcactcactgtgggaagctgtcctttaaccacagagaagggccttccagacagacatctgtctgctactggcatttgctgtaggtagaagggacttctgtccaaatattcaagccagttgtgtgcacattacccctctctcagcttcccagttctgtctagacacttccacatcttcctacaaagctaagttgagcttgcttctgaattctgccagggcagaataggaccatggacagtggtccagctgtcaagccccagtctgcagcaaagtcagttttctgcaagccaaggaaccctgggagaggggttttgctgtgctttgtggggagcttacatctctttcttggactgcctgtgcaatgacaggttcttccagaagcccagactccctaccgcagctttcagctcccgagacacacacacacacacacacacacacacacacacacacacacacaaccaaaatctcatttttgcaaatgtagctcctaaaacgtttaaatatatcttcattatgaaacatttcaaacaaacagaaaatgctttatcagacatctgcacttaaaacacccacccgaacagatcttcatatttgaattgcttgcgggtctgttgcaaaaaaaaagtctgtaagtattgctgaaggtcctttctaccttaacgtctttccttctcccttcactccccaaaagtaacttttattttgaagttgttataagccatgccactgctgtgtgcatttatactttcattataaattaaatatattaataagcaatatatagcattgctttgtttgtggagcattaaaatatgtcatcaccatgtgttttttttttttgttcatcattagtttttggatttcatattgcaaccccaaaaataaactcaatttttacaactgctgtaaactcgtgcctccttttactatctgcaagttactctccattctctttctttaagggcttgtgtgttatttttagtttgctatttgctctagcaaacaatgctgcaattaacatttgcatgccagtctcccaggcacgtgatgatgcacgtgaagttttccaggccagagttgctgcactctgaagttacatttgggggtggggtggggtgtgattctttgttgggagggaactgtcaatcagcatccttcacctcttcccactagatccccgaggcaccactgcttcctgtgtgtgacaataagagttgtctttaggcattggcaggtgtttcctgggatgcagagccaccctttgctgagtttcactaagacagacagtggactagctggttggggcttctccatctcgcattgattttttatgtacattttgattttggcttcccaggagtttggtatctctctatattttcagaattaaaactttgtcaccagtttagagatgcagagtggtgactttgctttaagttttgctttaccatagcttctgttgctactgcctgtttccttgtgtgcttggtctttaggtttcctcttctggaatttgtctattgaaatcttattgaaaaatttctatctaggagatcagtataggttttaaaactatagcacttgggatgagtttacatccaggaaattatctccgaagttgaacgtatttactttgttaacgacatcctttcattttgaattgtcgaactacaataacactgtctttcatgttttatacttttgtgctttatttaattttcccatccaagtgtgtaaagataatctacatgttttacaaggaatatagaactttacttttcacatttaaatatttcagtcatcaagctgttatggagtaagagtatacacatatacaattatttcaacacatacatattcaacagtttatttttccaaatctgactttttgtgccatctcagactttaaaatttgatattaggtagagcagtgtccaggcttttttttcttcagttgcttggctctgatgatgggctatctggccaactaacaacatctcttcctctgaccaactgagagcatctctttcctttccaactgggaatctccattgtctttgggcatctcccaccccccccccccactcacaatgtgtagtctacattcattccattggaatgggtataggcatggatttaatatctttccaatgagagctacatggaattatgttgaagggtggggggcataagtaagattcttcttagtttaaaattacatatgaaagagatttacctgggctggagtgatggctcagcagttaggagcaccgactgctcttccaaaggtacacatggtggctcacaaccatccataatgagatctaatgccctcttttgggtgtctgaagatagctacagtatatttacatataataaataaatcttaaaaaaaaaaacaagaaagaaagagatttacccttcctatctttgtgtaaaaaaatgaaggaaaataccacctcgattctgtggcagcatcgtcccagcaaaggagacacactggacacagtctcatgaagactggctggacaggaagatgaaaaggcctcaggtcctgatgtcattgtgtgacttcaggaaccaatattgcctctccagtgagctgaaatagtcgctttcttactgctgaagtcagatataaaacacttcatgatttatgtcctgttacttacagctacattttgaagttttgttttgaaattttgtttttaaattatattaagtgtgtgtgtgtgtgtgtgtgtgtgtgtgtgtgtgtgtgtgtgtgtgtgtggtataggtcagaatttttggaaaatgtttttcactttttactatgttggtcctacagatcactctcatgttgtcaggctttgtgacaagggccttaaccctctgagccatcttgtctactctgagattttagtttttgatgtgacttttctgattatttttccatgttcccaatcagattgggaaattttttttgagtatgcattaacagtttatgttagcttagggaaatctaattcctcacgatgatgaatattctaattcatgaatatctttaatatttaatgtttagtgtttctgtagaacctgttgactttggggagagggcccctgatattggatattgttatgtagcctaggttggcctcagattctcgattcttctgtctcagcttcctgagggttaggattacaggtgttcccagcctgcttgattttctgcatagacagttataatatccaaataaggagaattaatagttccttagccgtgctgggagagcagatagatgcaatcatggagatctgttgattataattttctgtcttgtgcattgcctaatgtaaggcttatcagcagacattgggcaacgttctgggctcttttaacaagatagtctctaggtataggtagggttctcggtctaacctgcagagttaagtgctgaaactgactccccccacccctcccattcccctctagtatcctctggtagctcaaaacaaccagggcactgtctttgcattgcatttctgacccatagaaaaattttacatattggaccagttttttattttttattttagtaactattatggtggggatatagttggtatgcatcctctaggggattgtgtgttgaaatttaatcctcattttgagatattaacagagtagaaaggtggtctaactaatgcatagaaatagagcctttgactgggattagatatggtcatcagtgtggagccctgtaactaataatgatggctttataatgagaaaactcaggacagacaaatggacggacacacacacacacacacacacacacacacttctcgtgtcctgctatgagacatcctgtgctactctgagagtctgacaggaagtaggttatcatcaggcacggggctcttcaagcttcagaagtacctgagccctaaactaaatgaactcttattctttacaaagtgacttggcctcatacacttttctatggtaaggcaaatacaatcgctgctgctttgtgttcggagttgagcaagtgcttctagggcttgggtacagcaatgctttcttgaacaaagatctagagtctaccatgcgttttgaagaggagtacagaggtggttttagccactgctgataccacagtaatgatcctcagatacgcagtgctgctgtggtagtttgaatgaggatgcccctccccccaataggctcttgtacttgatcatttagatctccagtttggtgacactgtctggagaggtggtgtggccttgctggagaaattacatcatcactgtggatgggctttgagaattcatagcctcaccctattttcagctctccctctccctctccctccccctccccctccccctccccatctcccttcccctccctccctctttcatgtgattgaaaagtgatccttccacttctgcctagccacggagagactcctagacctctggaacttgaagccaaaataaagctctttcttctttgagttacttacttatagccatgttattttatcacagcaacaggaaagaaactactacagcttctcagagttctcccagagtgttctgaacactgtagttggtattgtgtttgtcatctggctaatggagaacagtgataaatgctattttctatggttgagcaaaacttgcttttgtggtggagaatgaccaggcagagtgacagctctgtgagttcttccagacatggggttttggccttgttcatcctgtgccttgaagagaacaatgctttgtgaaaggttttaagctgagccaaccacatttcaagtttatgcctggctccgttcagccaagttcccatggaccaaggagacctcagatgagtgtcccccaggcctttgcagtaccacgccccgaggaacaaaagggagaagaaaggaataaggtagcaggcgcaggttttcagcaagggggggaaggaattgtcagtggcaactcatccagaacatgcattttgattgaggcctagatattttttgtacgactctccttatataaacttcgtatgtaaatataatcaaaatagcagtcattaacattgcaaaacttatttattaaaatatgtaaagcagacagctgcaacagtggtgactaagaagtataaaaatactctgtttaagaaacggtttttgaactcctactgtgtgctcacactgtacaggaagtaggtctacaaggatatgtaacacaggtctctgtgcgattaaaaactgagttggtgagctgaggaggtggctcatcagttaagagcactggctgctcttccagaggacctgggtttgattcccagcacccacatggctgcttgcaacctcctgtaaccccatttccaagggatctgatgtactcttctggacttttcaagccgtaggcatgtatgtgttacacaaacgtccatgcaggtgaaacacccacacacgtgaagtaataataataataattgaattgaacctataggtaatatcaaaaatacaataggatatactttttaaaagaatgtagcttaggggctacagagatggttcagttgtaagaacaggtgctgttcttgcagaggacctgagttcaccgcccagcacgcaggtcggactgctcactactgcttacgatgccaactctcttcggcagatctgggcactcacatgcacatgtgtgcactcactcacacttgcacaattaaaagtaaaataaaatcgttttcaaatgtggggttagtttagctgggcatggtggctcacatgaccatggccagagtgcctcaagatggggacttttggcaggtgatcaagatgaagtttctcacagtggagccccgtgactgaacagggtatggtggctttaaaagaagagaaagaccagaaaacacatatctatcttatctcttgtcatgaaatgttctgtgcaactttgcaagtgtagcagcaagaaggttatcatcagatgcaagatctttgactctcagagctataagctaaatgagtctcctttcttcataaagggacccaacctatgtattttgttatggcaatgcaaaataggctaatacagcagtcattgctttgtgcttagaacaagtgttctaagacttaggacatcaattagaaatatgaatttgctgggcagtggtggcgcatgcctttaattccagaacttgggaggcagaggcaggaggatttctgagtttgaggccagcctggtctacagaatgagtttcaggacagccagggctacacagagaaaccctgtctcgaacaaccaaaaaaaaaaaaaaaaaaaaaaaaaaaaaaaaaaaaaaaaaaaaaaagaaagaaagaaagaaagaaagaaaaagaaaagaaaagaaaagaaatatgaatttatgttgaagtaagagtattgtcagcctgaggccaacctaggctacatagtaagatctgatcaggaagaagaggagaaaacagagggaggaggaggaggagacagagaagaaggaagaggaagagaaggaggaggaggaagaggaagaggaggaggaggaggaggaggaggggacctgttaagagatgttgtatgcttgtgttcttagcagcattatgctgaatcattcaacttttaacagagaaggaaattcctatgtgttcggatatggatgaaccttgagaccctacgctgagtgaaacaagctaatcacaggaaacagaggttactgtatatgcttaacttatatgagtgcctaaaatagattcataaagctggaaagtgaatcttggttgccaagaccttggacatgagtgaaatgggaattatttaatagatactaaaaaatatatatggacttcctttaggtaggggactgtggtgttcggttttctagcatctaacagaagacctgatacacagtaggtacttgactaatatttttcctgcctttggcttctcctcccccatctaacatcccatgctgcaggacaagggccaagtgattctgggagccagttcagaaaacaaagactcttctctcctcagggcacagaggggaagaatttcaaatatttgtgatttgatatttgtcctggtcacagcaactctactttactcccagtgatgctcatctgagcccagttggcatttcagcgtcctaaagatagatcctgtttctacttcctaaagcaaaatagaatcgcagtggactttgtaagaaaatacagaagtggaagaaagactgcaagatgaaatcatgattaggctcctgggctctgcttgcagccccacacaggaggagggtgaggtaattagcgtgttcctgcagatcctcgcttgtctttgtcccaccactggctctgtctcattctcctgtgcttattttttcccccaacttggccaaaaatagacagacacaaaaaagtttccttgtacttcctttggcttttctactttttttcccctggtatgtttggtttcctctggtgtggtctttcttttttcttaccacctgctggcatcccctcctcactccccgtacccccaacatgactgtgatctgttttggaaccctggcttggtgcagggtgtccaggaggggcagcatttagtgatgtatgggtctctggacgtagaagaattccaaggagagaatcttatttccagtgcaggcatagagcagagcttcttgttctgggtcctgcttgagaatttgtcagaattcagaatggaacctctctgggggcaaaatgcatcagagatctttctctgtctcttcatgccgttgtgggaaccaacagaagaccatggccatcatagacccaaacagtgtccaggcatggctatttagtcatgttactttttaagatgctacattccctatcccttctagtttcattttggttgctgtgagaaataacctgacaaaaagcaacttaggggagaaagagtttggttttgctcaggatgccgggttataatacatcgtaacagggaagtcaaggtagcaggaacttaaaactgctagtcatatcacatccacagtcaaaagcagagaaataagtgcatgcatgattacatgcttgcttgtgatcagctcagttcctccacttttacacaggtcaagacctcctgcctaaggaatggtgctgcccatagtgggctgatactttccatatcaactaatttaattaagatcatccccccataaatatgcccatagaccaacccaacataatcaactcttcactaagattctcttcccagatgattctaggttgtgtcacattgacaaactcaaccatcacaccatccaaagctatgtagcaggcactctatgcattttaaatattattaatacatttaattctttagtaactcagagctcccatacaacatcgctgggaattgggaattactattatctgaatttttgtggataagaaactaaggtcttgggaagggggttcagttctacagtgaaaatcacgcaccttggttcctggatccacattttaaattttagtcagtctttgctgcctttgtctttttgaatagttccctagatttcctttggaagtttcatgtctggttttatgaaatgtctcccccaatatataatatctcgtgttgggcaacaagtagatccctctgagcctttcgggcggctcttggtatatccattggcagctgtaagaacaagactccaccctacagaagccatggaatctgacctttctttccaggaaccagatcatgagaaaatagtatctacatacaaacttagaagaactaaaatttcagcagtggtgttatcatccttgtaagaagtggctctacccccatgtgaacaaaggcagtcccctgagatctgtcaccagtcagcatgagtttgcaagcagccatccaggctcttgggaacaaaaaatcatgaattttttagatgattggctggagtcaagaaagtgtttcagagctgcaggacagaccttctggtgagggtagcaaactggtctggaaagaagcccatgaccttggactgtttaccctggaagaccataaccagggccttggacatcacaaggtgtttggctaattctctaactctacctgtgttcctctggctgggccccaaatggcttcccctggcgagaactgggagctgagaagaggatttacagaaagtcaggaagaccttgggctgttcctccctgcaattatgtagaatgtctcattgttatactgtctgcttcctactagtaattcccagggcctctgcccacccagagcttcttcctacagggctctggtgtgagaatgagcagaaagtgaatcctgctaagaaactagctgataacatctgagttcaggcttgtcttcttcatagagacggcaaaaccaagaaacttaaaaaccagaagcagcacgagcatcctaggaggagcatccggctctttgacgtgggagggatttgattagggcattagtgctttgggctgctgtaacagaacactgtagagtgggagactcatgatctacaaaatttatttctcatggttctggaggctggcaggttctctatctggtgagtttcagctttctggttcacagacatccatcttctttgttgaacccttacatagtgggaagagaaggcggcattctggggacatcttattaaaggtactaacttctttcctgagagtactggcctcataatgtagtaatattaatatgtaaagatcctacagctaatgccaccattttggtagtaagatttttcaaataaatgggggaggaagggactgtatttttttccatagttttagtttggtttttctggtttggggatggggtgggatacattttgctatgtacccttggctagcctggaacacactatatggaccagattgacctcaaactcatagagatctacctgactgtcccaagtgctgggattaaaggtataccttgctcctcaaattcttataatatatcacaaattggccctgattgatcagcccaccaaagacctggaattcagtataaaacatcaactttgaagctgtggctttgtgtctctgtacaggctcataggattcacccatatcaaaccagcagatgagttccctctaggcattagtggggcctccgtcaaattgagcataccctagaccactaactaggctgttcatcaaggctccctcccagaagagctttgccaggaaattttgcttgaccttttaggagaactatctcccctagctgccaaccgctgggcaaataaatgcactttgacccaggaaggaaacaagggtctttattaggtcttgaggccagagccctcatgaatgaggttagtatccttacccaaaaggcctccggagtggctcccaccctactccacccccatacacaccctgcctctcctctcaccaaatcagagctcagtaagaacatggctacctaggaaccagggaccaacccaaagcaccttgagatgggaatagatggactggtctccagaatcaggtgaacggggccattctcagcctaggcaaaaggaagatggcaggctcagggccatcgtgaataggcttttggaatcctgtctctagcctgccttgctgcctccacccccagttttctctgggccgcgtctgaggaccagtaagagtaaagtacctcttactttcagatctctgtggctcttcctggacccctgtctcaaaatactcctctcttcctcggactcagtgccagactgctggcatccgacttgtgtcctgtgcaggctgccatgtctggctttcctgggtttataattgcctctggttaaagtttaaatagatgggtttcagcccaagagaagaatgtaaacaagccgtttgtgccgggtcgggcagctgactctcagtgctcgggagttctgcacttgggaaattcactttgcttttccctagcccagggactgagcctctgccaccaccacaaggtttttcagagccctgagtgcctctccgaagccattgaagccatcgaggaggcttttagaggacccgcactttcccttttaactcaattaagccatcaggatcctgttcccactccagcgagtgcgtctggtaggaggaggtgagaacagggtagcagtcttctctgggctgaccgcccaacaggaaggagaggaagggactgtcatttcccagctggaattttttttttcctctgagaggaggagggattgaatttgttgccctagggtttttgttttgttttgttttgttttgttttttgttgttgttgtttgttttttggttttttggtgaatgacctccagttaggagaatggagccattcctggctgaggaagagggaaggtggttggacttggctgtctttcctcagaagtaagcagacttatgtgtctttgtcagggttttgtctgacttcctacatctttctgttttgtgagctttgtgttcaggagtcaggatggattcagcaatacttggggggggggtgctttaatcaaggatttaatgggatccttgacttctctactcaaaagcctcccagtaagtccccatttctacttcggacgcttctgcggaagcttctgtgatctggctccgcccctcgcacctcccccttcaccttcaactctcccagccctaagctgaactcggctgaactggtttgaacccttccaaccctgcagtataacactcccttctctgcagcgtcccagcacctgggcttgctcccgacacagctcagagctgcctccccgtgtcccctgggttccctgcaagctaagtggacccttcctccggtcctcttgaagcccttttccccaaaccctgtttcatggtgtccttcagccagcaaatatgtgtcgacttctcaaccttggtaagtcgtcctctgaatgaaggatcatttcccatccctcccacactgtccagtgtcagatgtgacccacagtgtccaaataatatccaatcttttaggggactggagatccaactcaggaccttacacatgctaagtatcacaccactgagctacactccttgaccaacattcagtctttgttttccagtcctgctaaaaagctgtctgtctcttaaaagctcttggagttgggctttggtgacacatgcttgtaacaaacaaacaaaaaatccagacaaataagcaaacaggaaatagctcttgggagtatcaaacagacaggttcaaatcttagttctgcgtcgttttggagcaggactccttcctaattctgattcttgcaacctctactttctccatgtggaaaaggaaagacaataaaaccatttatggtatccgtgcaaattaaactgggatctttccagtaaagaactgagccctttacgcagtgaggagctggcatcccaggcttgaagtcctgttgccccagagtccactgtaaaaggccggttacagctctaatgtactgccaacaggaaggcctggccaaagtgagcagtcccccagacccgtgggttggcaaactctgtaagcagtctgctagcctggacatctaggtctgtgtggagggtggtggccatctggtccagaattatgctatgaagatagtacatctccacagccatggtggcttgttacaagaagtaggtggacaaggcttggaagtaggacatgaaagacatctctatctaccatgacaggttcacacactccaagttttcaggctctgggacatgtgctcacctccagaaacccttcccacaaatccaccatgaggaccagggtttacctttgtaaagagagttaatgagattttaatgtgataaaaagcaagaagaggaggaggaggacaccgttccctctcacccttaccttctctttatactcagagaacttaaatattgaacattattctctgagatgtggatctcacccatcgatttaagggctatcagatgcatttccatttgctgaggcgaccttcctctgtacagctactgctgcttctgactggatcttgcaaggtttcaagagactcctctttttattttttattatttctctatctatctatttgtttgtttgtttgtctgaggcagggtctcacctgtgtagccttggctggcctgagcttgatattcagtccaggttgactttgaactcatagtgaactcacagcctgcctctgtttccccagtgctggggtcaaaggtgtgtaccatcatgcctgactactcttatgggtagcactggacttacttattagtcactagaagacatgggtgaggatgctcaggcaccagtcagctctatgtgttgctaatttgctcttacctttagcccctggtgtgagatcagctcctctctgtctatcttagaagggatgccaatgaggatacccctgtctctctccttcaccaaagtcagtcactttttctcatgagagggggacacagatcctgctcatgctttgagtacacgttgacactcactgtgtagcggctactaaggttaaagtggaaacagccaatgtctgtgcttctaaacatttcaatctaacaacttgttggcagaaggaagagaaaatgtctaagccaggactgcaggaggccgagtcagagacagtggtgtcttaggcaaagttccaaagaggggtgagctgagccttggggagccagtgcatgtctgtcaggagatagacaatagctctccaggtgaaggaacccaagtccagtttcttctgttcttctcctgacagacagcttgaagcctttatctctatcatctctaacctgtgtggccagcttcttcttggcccaagatccctaagtgtttatagctttcctagcacccactctgacattagaactgacattagaagccactgctttcttccacagagccaacaagcagctggagtggtgtgagtcccagggtgaggatggcagagtctaggctgtgtgtggtgtgtgtgtgtgtgtgtgtgtggtgtgtgtgtgtgtgtggtgtgtgtctgtgtgtgtgtctgtgtgtgagtgtgtgtgtgtctgtgtctgtgtgtgtttgagagcctatgagtgagtgtgcatttggatggcatactagatatttttgtgtagaggttgccacagagagcagaaatggagctacaaaaaacaaagtggcagctaggcacctcacaggcaaactgtttcgagaaggggagcctgaaacattccctggccaaaacaaaaacagggcaggaagttgcatcatgagaggaagactgccagggccatgctgaagagacacaaatgtcacaaaacaaaaataaaaagtgtgagtctgactttgccggggcacacactgttacaattctttcttctttatagtgacatgaaattactgaaatcatatttggccgagcaagcatgaagaccacagaaggacagagatgggagatcgtcattagtttaacagttacgtacacaatattttgtttgtttttgtatcagcaactgattacaacttagctctgtccctctatgtaaatgttttattctgcagaacttagaaatattaaaaacaggttatgaaattgcatcaccgaacctcattattagcacacactgagaagttctaacacacatatgctaactatagtaatgtgactgatgacatcagagcaagagagagaccccactcccacgtgtgtcactacattcatcattttggttcaagtaaaaatgttagtctctttactaaaaggaagtgaatagttaagtttccttctgattagattctggtaactgcacatgtgacaatgttctaggaattgactttaggtaagacagtcttgtaaaaggttgagatagcttttgaatatacttgatatctgggcctcagaaaagccttctgagtatgttacttcagaaatatagtcctacctattagcagtctgtcacgatcctagaaccggagtggcctctgatgattcgcccatttgccagggtctcaaagagttaaaaggatgttgagattttggcagcgaaaggaggtgagttaagtggactttggctacggtgcaaacagtacttccccgctggatacatttttagcctgtgctgtaggaccagcaggagtaactggagaggcgtttgggtggacagggtggagaggagccaagcaggcagaaaagagcggacagtgaggacgaaggcgagttctaagggacccttgttttctctgcatgtggagggtgttccattgatagctattaaaagaagaaatgcatggaatgaaaaagtatgtgtggatacccaacttggagcgtaacataacagggttatgtcaccttcactgtgacacgactttggcagtctgtaaagattcatggtttccagaagtgatacgtttgatggtgtttgtttggttggtttttatcttatgtatataagcgctttgcctgtgtgaatttacatacactatggatgtgtgtacctggtgccctcagaaaccagaagagggtgttgagcccctggaaatggagttatagactgttgtaagaccaagtaggtcctgggaactgaacctgtgttctctaaagagcagaacaagaaaaagaaaacaaacaaacaaacaagcaaaaatcactggctggagaaacggcagtggtttagcagtggttacctaagtgctgttcccgtcaaggaccctccccagcacccacaggatgcagcacaaccatctgcaacacccgcatcagaggctccactgcctcagtcctccacggcctcaagtgctctcttgtacagtgctcttgccccacatccatgaataacttaaactaataaactaaaaagtaaactaagttgctaaacgtttggtttagagtttgtttgtttgctaggatttttttttccaagattttttttttcataagtgtctggagaagaaattggttttctcaaaattattagttatttagaattataattgatacaaataagtgaatctaatgtctcttccattttaaaattactactgggggtagctactgagctgtaaagcacatttgacttttgcggactgagacgaaagcagcagagactcgagggaagatgacttaaacatcctggcacagacaacacaaccagaatgctaactttttatttcctaaagctactaccttccgtaacacatgtataaaggagcaaccataccagagaataatctcagagagaaaagggtgaagaggaaaggcacaggaaaaatccaagcctatttattgacttgtttcctcaagcacttacttattgtgaatgcatgaatgtccccacgccattgcttatgtatctccagaggccctccatctggatgtttacttggtccacagtatccatggatccttaatcctcggattcaaccaccaacaagatattggtggcggtggcatcagtggggggcggtggggaggtgttgcgtttatcctgaacattcatgaattattttctgagtatttctggaaagtctagcatcacaacagttatacgactttgatatgatgtgaggtattacagggtatctaaagaggattaaaatatgcaggaagatgtgcataggatgtgtgcacatagcatgccattctgcagaacagactcgagcagcatcatgttttggtctcccagggagactgtaactaaccccgtgtgggaactaggggccattgctgcagatctgaagccttgcttcccagaggctgaaggtgctccctggcccagcttatgttccaagaaacttatctttttctggtgatgtcccctaggaacaggaaaaggtgaactcagacatgctatgccccattttacattgcaaatctatagctcttcccttcagtgactagctgaccattcttaaatcttgctcttgtgtgctgaagagtgtagcatctctgtccccagagattacaaaggaactttgctctttgcccaaaatacctctctctcccaaagcagcttcccctcctctgagaaatgctgtcatgtcaggctgcactgcccttgaaccagacaactttctctgcttctttatttgtctaaataaagctaacctacatttgctgtctaattcattcagatgcttgctcgtgctatttaaagtacccctcaaggcccctgagaaaaaacaagatgctttatcgcctgtaaggaactttagctttgctggtcatctaagggattcaagaattttaagaatccattgagcctgttctgactgggacttgaagaacaaaggaacgcttcaggtttttggttccacacagatttcattgacttgtgcactgttgggatgagttgacagaaaaaggagttaaaatgtaagcttgtgtgtgtgtgtgtgtgtgtgtgtgtgtgtgtgcatgtgtccttgtctctaagtttcatgaactctaacttttctgaagatgaatctgtcatttttcattgtggtctctagtgactgattgggccattgtgggtttatttacccctttgggaacaactgtgaaaaatataaagacagctgtcatctcagtaaactgaatttgagtatttggtttgttgctacctctccttttggccttcatgggccatttcgttagagaatcctgtctcttccatgtcccagaaaagcaaacggtacagagatcattgcagaacagaattccactgtgaatttataaaggactgggctcagaggcctggcatttgctgtttgttccttcagatccagagtgtatgggatctgttggcttgccttgtgggagggcaagccggtaccgctccattgtcttaaccactagggccccgctgctaccttcagctcaagcttattatcagcatccacttattcagccaggatgctgtgacgtccattgcagagagtgagtcagaagccacaagctaacaggtctattcctttcctctgtcacctaggaaaccaactcatcatccacaggaaatgcaggccccgatggggaatgtgcccagatcaggttagaaagctggcaatgagcttttcaaaggaggtcaaataataatgtgcagaatcgtgttctgaggtgggaagtggacctagcctcagaagagtgggtgcggtggtggggagggctagccagcagaaacagccagcaagaaaaattaatcagctaaaagcaagcaagatgtctgctttataagaacatgtccaagggcaagagatatacagacatgatctcatgcccccagcaaacagcacttttgacccagtagttgagggtctttggaagtgggtatgcttatgccatgtgtaaaatgagaagaagaaattggtgatgcacccatctaagctttcagtagtttgaaatcccactatatgctcgttattccttgagtttcaaaagtgtgggcagtatattccccagaactacctttctaagagccacaccccagtttctcctgtgcttcatcactgttagcaggtgctgtgttcttcctgactttataccagtggtccattgtctctagtgtatacgtctgacagatcgcagtatccagacgtcagtgggtagcggtttaatacggctgaggctgagaaagcctacctttcgtttttcatgttgtttgccaaggttgttgtttctagggagatttacactcccattgctacaggggtgagagatcctacatgagagcctgtgcattctcccagaatctcctgttctgcacacaaaggatttctgagtgaaaaacaaacctcagtcatcatgtggcccagccatctcatttttcatacaagagaggtgaagtgactgcatagggaagtggtgtgtagattggtggcaggggacttcttcctgtggtagagagaagagatagcaagttagatggaaagctcagatgtatctccaggccacatagctgtatctagaattgttaaaatcagtgagctgctttgattaatgtatagagtcctagagagggacaggtggcccaccatgggagggtcagtccattccaagaggatgagaaccatgagtactggttgaacagggaacagtgacggccccgagtgtgtacaggggagtgcagagcagtgatcagagttccagtggtgacaatcttagaagagttgaagggcataagactacttaccctggagcccagagggatttttatgggagaggtaggaggaggcgttgtcaagtagttgaagagctatctaagacagcttagatttattccctgtgcctgaaaagacagtaagaaagtgatgtaagttagagggtggtagggtttagtgccatattaataatgttctaatatttcaagggacaacagaaaaaagcagtggggtcatagcaaactaactgacagggcagtaaagtaagccattgtccctgcaggatgtccgggactcactcattcttccaaaaggatttatagggtttactagacaccagctatttgccgcttgctctaggcactaaggatatgaacatgaatggtagtcacttcccacaaggagctcacagtccactgggggttcttgtgagatcccagatatctagactcctgagagactcacacagacagaaggatggattaaaggggctcagtgtttgctgtctgtgtcgatgacgacaatactggctgctgtagtctacctggaaagtgatctcatgactcaggaatacgggaaggttctcttatcatatagcatccaagagctgtactattctttctagcagcagttcaaagacagcaggctttctctctcgtgactcttccatccttcaaatgtgcaacctacagagccatttctagctgttaccaaactgctggcaagtgagagagaatgtggcgtattggggttatgattttgggctgaaccgagaagtggttctcatgtcctctgctcatatttatctgctgtaattcggtcatgtgtccacacccagcaaagaggaaaattagaacacagccttggttttgggagtcactcagtggttgaatgtgcacttaacgctctgagattgatcccgagcaacaacagcagcagcgccaacacacagggcaaggtaaggggcacaaaatactccccagaaaaagagaaagcaggttttgatgcctgaatgacaaatcctttacagtagccaattctgagattccctgactatggtgacataatgaacataagattaaggggaagggctgggttctccttttttttttttttttttttttttttgatttgttcattttctttatattatctttaggtaattttcttggttgactaaagcatgtcttatgtcttatgtctttgtggtatacaccatgttttggtatatgtatacattgtagaatggctaaatcaggttacttaacatatatatcccctcacgtaattatattttttcagtgatgggacaagattttataatgtccttatcaagggcaatgtcatcatgacctgtgtttaccctgtatctttccataggcggtcttcttctcaagatatattcagggacgttttgttttactttgatttatggcagtgtggattgaatatagggtctatatcaggctcctgtcagcaagcacttgttggcatccacaatagaactgaaggagcttgcagccccataggaggaaaaacaatatgaactaaccagtacccccagagctcccagggactaaactaccaaccagacccatggttccagcctcatatgtagcagaggatggccttgttgggcatcactgggaggagaggcccttcgtcctgagaaggctcggtgccccagtgtagaatgccaggacagggaagcaggagtgggtgggttggtgagcagggggaggggggattggagagggggttttcggaggggaaaccaggaaagaggataacatttaaaatgtaaataaagaaaatacctaatttaaagaaaaagaaaatagggtctagcacatactaaaaaaatattctaccatggagcatcattctcaaccctcaagatgtattagcaggttggaaaaagtgaggtgggaaatcaaacagacttcatgtatgaacagggaagtgctgtctgtttgtgtttgtttgcatataggaaacacgggaatgatatgcgagaaaccatggagaccagggtgagggcagagggagagttagagcatccctgagagtggagcctcgtgtattcatttaaatatcttctccttatctatttataaaaatgcataattaaaaatgcctcattctgttgcagaggagtgttccactgactgacctctttttgttttcaaatgaagaggagccaagaataggacagcttgggaaggtgagctgcgtatagctcgtcaggctgaggtaaaaatcatgttgaatgtggagccgttcttgttttaacaagtctgtacttggctgattagggctttcaatagaatgcaaaggacgtgagagcaacgacgagctggctttatgtgggatcgtctaaaaagtttctgagagcttttctgttaatcatctttgttgattttcataatggtcttgtcttacttagctttcctccactgtaacaaaatacctaagataattaacttatcaagagagaaggtttatcttggctttctgtcatagaagttccacttggcctcagtctttgagcctgtgcttagacggcactctgtggtagcagtgagagactgaggaaaacttccccctcatgtctaagaagcaaagagagaggggggtgaaagtcccatactcccttctgagggcagtccctcagtgatcccacaatgtcccactaccaccttattctagcacgaccttggaaccaattttttttaatttaactttttattgattctttgtgaatcacatcatgcacattagtcccactattctccccgttccctgtatttcctctctgcccttgcagcccccataaaatatacatagatagagaaataaataaataaataaataaataaataaataaaatctctttgtctaagttttaatatgtcacagtgtgtcacactgtataccctatgtccacacttcttttcttgtaaatgttcattgcaatgagtcatttgtctggttccaggactctggcttctgctaccctaccaatactggatcctcatgggactccttttgggtatcctgttgttgccctgtgtcatggagatcttgcagctttggatctgcaggattgaccttgggaccaatcttaacatttagatatttggaagccagtcagtatatgaactggagcaatccctaataattattaaaactaaaattaatcttttgtttggaaagatattttcaagggcatggtataaacttgtctataagtccatgctagacatattagccagtccagtccctttcatttctgggtagtctcatcactagaagaacagtgtggcaaagcttagtgcatcacagcatttcctcatatattttcccattaaatctttccatcggccatgcatgttaatcagggttggtattacctcagatttagagatgaaagacaatggtgaccactagaaacaaagtaagacccatgaaaaaccagggatgtaggacttttaatatagaaagcattcctacctatcactagttgaaacacagatattggtcaaggatataattttaaaatatatatatacaaaaagactgtagtggcaatccaataaatttttagaaacaattttttttttaacttttccgtgttttgagacaggatttctttatgttgccttggctgtcctggaactcactttgttgaccaggctggcctcaaactcagaaatccgcctgcctctaatataagtattcttctcagtccagaaaaagatgggtcagatgacacagtaagaaaatgggatgccaaactactgatttttttttaagagctggggggagagaaagcttagtctgtaaaggaggtcctgtctaaacttgatgcttatttatagtttaactcccatgtggaaaatccaggtacgaaggtgtgtacttgtaaacctagtgacagagaagcagagacttgagacatctgggccttgctggcctaactgtcaagtcccagaacacagtgagagaccctgtctcaaaactcaaggtagaacaactgaagaatagcacctgagactgtcctctggcttccacaaggacacacatgtacaaatacagacgcatgtacacatgcacacacctacacataaacacaaaattatgttcaggaactatgcaaagaagaaaaaaagcataagctagtaaaatatgcagaaatgtgtgtatgtgctttaaaaccagtgaactctgaaagactgttaataagcagagctgccaaaagtgatttaagtttgggaagctaagttggttccttcaaagctttaagcctaagctgttccctgtcttgccaatctattcaactgggtcacttcgttcaaaggagaccagttaatacggactgaaaattggagaaggcagccgttggtgagctttgccaaatgccttccgctttagcggttcacaggagacctggaaggctgtttgcatctaagtggccttgactctacagaaccatcccattcagcaaaggtttcaagtgtcttcgaacacgcctggcttctaaatgcttgtatggaattcagcccttacctgaatttgcatttggagtctatgtattccgtgttgtcactcatctcctaaggaggcattcaaatgagtttccctttttaagatttttttttctcttttttttcccagatgactgtttactgcacaggcccaccagcatatccaaaatgtcttcagtctctctgtctttcaggatgagcccaatactccctggtagagcctagcatggcagaggccttgggtttgatctccagtgtagacgaatgaaccatttcttcttacccacgtgcagctctgacgacttttctctttattttcatcagaataagcctgctatgatcagcacactcaacactctccagcacttccataattatcagacagatggggttataatgttataaaacagccagcattaaatacaggcaacatgatggtgacagaaaagtagttagccaaggctgaaattaacaacagccaaccaacactgttgctgtctgttggggccagggatgctgaaattctatggcttttttttttttctttttttgaaaggtgacaggttgccaagctgccaagaactcctgcctctgctcatactgctctgctgaagtacatttgcgacatcaaccatcaaattacatataaatatgtaatcaactaaagttatttatagctagctcagtgggtttacgttgacggaatgggctgaggctgccggtttgatcctttgccacttatttgacacatgaagaaaattcatcacctagtagtctgtccctacactcgaccaggtcacaaagctgtgatcttccagagacctggttctactgtgtaggtggacagtcatatcatttcaggtacaacctcatatggcaatgtaagtactaaccttcaaaacaataatcagccttggaatcttccatctcaaaacctcaattagccattcacaaaggagaagatgccttagtcatatgtttagaaccattttcaatatatttataagcacaggttggatcacagtgttctcaaatgtaaaacacttctttaaaaaaaaaaatcaaaagagcttcccccccccctgccccgccccgccccataatgtactagaaacctagagggtgggtcctggttctgctcactgcctgggacctgatgacaatccctgctgagtttgtgccctgagatttgcctgcaagcagttcactgttcctggaggatactacacggctctcagagcacagaaggctatagattcacaacccaacttctgggggtaagaagaagatggagaaggagaagaagaaggaagaggaggaagatgggaaaggaggaggacaagggggaggaggaggaggaggaagatgatgaaaaggagaaggatggggaggaaaagaaggaggggagaagggggaagaggaagagagggagaaggaagaggaggagaaggaggaggaggaggaggaggaggaggaggaggaggagaaggagaagaagaagaagaagaagaagaagaagaagaagaagaagaagaagaagaagaagaagaagaagaagaagaagcagccctatctccctctgtttgaggctctgctacccctccaaacccaaaccatcatgtatgtccctggcctcctagatctggcttgcagggctcctttgaggtctactccccactgcttctctctcccagtcgagccttgttcgccctgttcctctgagtcagcccgtgagtcatctcactcattagccgaacgaatgcctctctagcccctgaatctcttttgtttccttgcatctaactggttttctggcagcccccaaatccagaaacaaccttgaagctggagggtggcttgctaccaagatggtctgctcagtggagaggctgggagagggcaagttgaattaagatggaggtgctggtgtgtacactgtggcctcggggtgggggtggaggcaacttcagtgcccagaatccatgcctctgtccattcataggacggcacaagattactagatcttggtgtcccccacccctgctccccacttctttcttttttaaacagactctcattatgcagccctggcttgtccaggacttgctgtgtagatcaggctggcctcaaactcacaaagatttgcctgcctctgtctcccaagtactggtttgaagggagagcaaaccacacccagctacccttttccttctctttcttgtctttttgtcctctcctcccaaccctcacccctctctcacacacacacctttggatgataccaggagaaagcttatggactgtactagtgatagacaggcaaagagcagtaagtattcttagaccacatgttgttttttctccagttcctgcaggcgtatctttccgtcacagttctcttgatgttacatcccacgacgcttcccctcctgaagaggtggatgggaaaggatgtgtgagagatggggggtcatcctagttgaggcctcctgggtctatccagatgcccagtgaaaggatgctaataagaactctaaattcacttgttggagcagcggcaccatggcacctttattaattcattaatcttaaagccctttgtaaagtggagaacattcgacttggctgagtgtgacacttttcattaaatccagcaatttagtttcgaagggctccttggagaccacctgcgcattccatcccggcggcaatggcagagcacctgtgtagagtgagcctggcagaggctgccctaggactgcactgtaaagcctgtgcgtgcaatcactgtaagatctgtgcatgcagtcacccggggagctagctgagatgccggctccagttcaagaggccagatggaaggcagtctaatgctcatctgtaagttccctggaggtcccgctaccccaggggccacacatggaatataccaagactccagcggctctgcagaaagcagagcaaagcttgctcgttccttgagaaacaacctgcaggttagggacactgccctccacattcctcctcctcctcagatgacgacatttgtctaccaggcccagacaatgctggactgttccttctgaggctgccagctcttttctgtctccactctcagtcgggggtgttaacattgagagatttaggtttgggattagtgcaggaaaaaaaatggttccatagattttcagccttgactgtgaggtctcatttagctcacgttacccggaagcttagaacacatacgtaggcagaacttgaacaacaataaaccatttctttgattgttacagggagttctttgcttattatttggaaagtcaatcttttgcttattctttctactggatttttttgccttttaattattaacatatttaattattaacttaagatagccctttgttacaataatcaggagaaaaattccgcccctatatatatatttttttactttattaatctcagagtttagaaacttagcttgtaggcagacattaactttcaggttgatttattcaagcatggtgacacacacacacacacacacacacacacacacacacacatagctgctgtgctcaggaagctgagtcaagagagtgatgtgtcacctgaggctacccatggctatccagtgaattctaggcttgcctggactacagggcgagctcctgtctttaaaacgctttctctttgttgctaatctgagcaagccctgttgcagtacagtccatctctgtgaatagaaatattgaagatgactgcacatcttggggactgttaggcacgaagaggaagtacctgtgggccaacacaggccctgctaagtttgctcccagagcctatagtaatctagtagctttaccgagcctcatgcaaggcacaggtgacagcttttgacaaatgcacttagtttgcttctggaatataagcaaacacacatttattacattgatttggcacttgcagggactctctgtcgtgtccttggttctgatggttctgagaatcacagggtactgttggaggctgcctattaagagcttcctctgttagaggagcctatgatttgtgccagcctttggcctcctcctccacccctcactaagcctgccagtggatgtgatcttctcccactccccaactcctaagcagctaaatgtaaaaccccatagcactaaggcaagatgacggggcagctcctgctcctcctcattggctctcatctctgctcacacggacccactttttggttttttcccccctggatatgtacatgtgcacgtgtatgcatagatatgggtgtatgcacatgagaagggcagaggcctatgggaggccttcctctatcactccccacctacttttctcactgaatctgggactcgcccaatttggctagaccggctgaccagcaaaatccaggggtcctcctgtctcagcactctcgctgttttgatcgtaggcacacatcactgaacctagacttttatgtgtgtcctagggacccaaactcagactctggtgttaaaaggtaaacactacctatgggtccatctcctcaaccatttactctttattttgaaacaatatcactaagttgctaaagatagctttcaagtctctctctagcagaggctgactttgaactagccaccatcctgcctcagccttccaagtagctgggattccagacttgtcatcaggcctggctctgtcttatggtacgatctctaagagtagttgtgttatcattcagactgacaagtctttgattcaacttcaccaaatattttgtaccactcccccatctatgatgtttaacgcatttctgtcatctccactactgctgggggtgggggtagggaatatagtaaactttaatagtaaaatgaaaatatctaaagcttgtttgtttgtttgtttgtttgtttgtttttgcctctgatggggttgggggggttgatagaatcaaagtaagaaacatctaatggcaaaattgatcaattactcaggtagagatgcaccccacccttcctggtaccccgttatccttttttgcacacaaatctgccttctaggtcctgccattgagcggacataaaacgaacaagtcaatattatcgaatctcaggcctttgccaagcactgtgctaagtgccttcacatacattttctcatttaatggctccatgcttactgactacagtggggaaagtggagctgggcctttggttgttcccctcctccctgtctgagccagccttcagcacgcactgaaacaaaaatccattctttctgcagctcatcctcgtctacggccaaacgttggtttctcatttctagaagatgaaagatgtgatgactcaggaaaaagtgagtagatgggggcccaaggctatgcgctgcctcacgccacaccctgtgcccatgtgggtgggctcctgcctctagtgaaaggcctctctcaacttctggcttctctcctagatcaactatcatattctgtgggacaagggtccgcattcattcacccactccctttgattgatatctgaacatatgttatttatcactaccactaaccccaagcccctgacaaaataagacagaacaatcctgtctcctggagacattcgacatgtcttatccatccctgacacagctggctgctttctcctctgactgattcaaatcctggattcccctaggaaagcgttgcctgggtgaaattgtaccaccagcaagaaaggaatcttccaggaccgcaggggaaagtctacttccgtatctcagctcttaggaatggctctccaactgctggcatagccacatgggctcagccagggctgagttggtatagacctccctggtggcttacaaaaaaggaggcaaccaagagtaggcagagatgagcagagacagtgacccatatacagaagtatccccaaacacaatggccagcagcccgggttgcaataccttggcatgtgactaagttataactggactaggctgggtcctgagccaaagaagaccctgaggcaggacctgttcaccatcagagtgggtcacatttctattccagaggcttcacccattctttgttttgtgcagctggaatcttagtaactgtggtgggcattgagccttgccgtccacaagagaaaggtaagtaggagaatgtgggagagacaattaacaaacaaacaaacaaaccctagacattgtagagctgagagcatagtctcccaaaatgtgccagaagttgtacaaaagggtggtatggtggttactttggagaacacaatgtactacatctggaagggagtcttcatgagaggttccctagctcagtgtggtggttgggggcagaatgggacagaatgggaatgtccccccataggctcagatgtctgagcacgtgatctccagcctggtgctgtctgggaggttcaggagatgtggttttgtatgtcctagagtaggctttgagagtataatttactcatgtcacttccaagccgttctctctgcttacagcttgctgctcgagatgtgagtcttcagatgttcctgccgccatatctgacagctgctgccaagattccctggtgggatggactcttatacctcaacaaccagaagcccaagtaaactcttctataaattgaatgactcatgcttaaaaaaaaaaacaaaaaacaaactatcttta

SEQ ID NO: 416 - DNA, 63845 bp, Mus musculus
tgaagaatgaacttgggttcattctgggctgtctgtcacaggaagtaaaaaattggcattaagtttaattaatcagccttaagtaatttttcttgatgttgctagatggatggaaaggggactcttcatccacaggaggagactttcttggctgtgctggggaacacaaaaattaaagtctttatacataaaaatactttgtaaatacaccacaacattttctaggagttttttgttggacgatttttctatactatattaagaatatttaaacatatcttgaggtagttttttttttcaaatttatggaattctaaagatttttttttcattttacaaaaatttgctttgatttgagacctttttttatcagaacctaaaaaacctatacatttgcatatctaagaaaggaatgaattttaagcactacatacaggaagaaattttgcacctaatggataatagttaagtcagtataatttggttttagattttgaataactttgcattgtgcaactactggtgaggtggtgtgtgtgtttaagaccgaggaggggagtgactcatagttgagattttttaacctctaagttttaacattaaaataatggtttgagtggtatttctgaaaatgtcagtgaaatccactattttctatcaatctgctctcattcaggactgactcaaatccgccatagactgaggaactgtgaaacatcaacccaaagagaccgttaaaggagacacggcagtcggcaatcacatttggatccaagaatggacagagctactgcttctgcctaagatgacgcggcaccgctccccgcccccttcatagacacacaaagggctctcaagtacccgtgtcaactggtgttactgggacctggttcactacacaactctaacaccatttttattcagctgtagggaattgcaagtgagaattgggtataaaagcctttaaatataagtgtgactggcggggtgagatggtttcgtgggtaaaagggcttacccacaaacccgaagggcctgtgtttgcctcccggaacccaaaatggagggaaagagtggactcccaaaagttgtcttctgatcctgatatgtgctctctctctctctctcttatatacacacacacatacacatacaagcaagcaagagtgtgtgtgtacgcacacgcacacacaaacacacattttttaaaaattaaatagcaaataaatctgattgtgacaaaaaattccaagtatattactacagtaaatatactgtttaaaaatggaagctttgctactaaactaaaactggcctgtgtattatagtatagcacatatctttgtatgcagtaatcacggggcttttgctggggtaaaggcacttgccaccaaacctgtcaatcagagttggatcctcagactcccgtggtggagagaactgactcatgcaagttgtgctctgacctccacatgcatcccatggcacgtgtgcccatacccatacacagccatatacacaaacacaccaagaaaaattaaatacatctttaaaaaataaaatacaatgattgcaaaataagaatccatgatgcatgaatccatcatttaacaaaatatagaaagaaaaactgaaatgcaccccaaaataaaaactttagaaagcctaagaagaaattaaaaattttttaaatgtaaaaggaaattttaaattacaaaatgtaaaattaagactgtgggtagcacactcttctattaatccaagaaaaaattagcctgaaatcattttgtaaaaatagccatccatttaagaaaaaaaaaaaattcaaggcctttataaagaaaccttagttggggagctggtgagagggttcggcgggaaagggcacttgctaccaagcctgaagacctgagtttggtcctctgagctcgcataaaagggaaagaaaacagagctcatggagttgacctctgacctccatggtgccacagcaggtgtatacctcatacaacaaataaataaaatgtaaaataaaaaatattaaaaaaaaaaaagagccgtaattaaatgtgaagcaaaggcttggatgggagcgagtggggccgtgttcacgtgagacacttgcttcatatgaaatgccttctcacacatcaacgtgtttcctgtgctgatcaaaagcctcaggtgactgtctttataaatcaagctggttattaaattcttcagggtgctagaatatccaagagcagtttctgaagataaacagaggaggacaggccccgccacttccatcagccacaacaaaatgcaaaccacagaaatcattacgaccgacagacgtcttccggtccgggaattatgggagattgcctcttttcttatagcttttttaaaaaagtcattctctctcctcaaaaggggaacattcaaataaacgaggttacttgtaaaatgaggacatggagaaaaagaaactaaaggaaatgtcttgttttattttgcttagccagtgtttctcaacttgtgggtcatgaccccttgggcaaatttctatctccataaaatgtttacattgcaattcataacagtagcagaattgcagttatgaagtaacagagaaaataattccctgtgttaagtcaccacctcctgagacactgtctcaaagggttgcagccttaggaaggatgagaaccaagggcttagtcccagtgtaagaccaggagacccacacatggactctgggactctctggtcagtcactaaggtgaatttcctgtaaatcaccaagtgatgttctgcatcatctcaggatatattttcacacatagaaagatacatacacgaataggaataaatatagcatcaatagaattcagtttttcactgaaataaaatatcaccatagctgcattagttacaagtccaaatgaggcttactcgctaaaaatcttactttttcattccatttttttaatgttaaaactctctgtagctgagtgttgcagcacaggccttcaattccagtgctggggaggcagaggcagacggatctctgagtttgaggccagcctggtctatgaaataagttctaggacagtctggtctacacaaagaaaccctgtctcaaaaaaacaaaacaaaacatccaaccctttgtagctgttcattttcatggtgctgcggataagtcctgagcttcctgactatttggtaagtgccccaccactgaacacccccagcaccccaaatcctattgttaacgtatatgatacttaagtacagtgagatagtttgttttccagccttgtgctagggatcaacaggttcattgcaaaaagcccttcgctgtatcctcttgtccatgagagttgagacttctggcctgagtgccaggcagtgtccgttggtgaaggcactgaagggttggggagtgagtatgactttggagacacttccaagctctctggggagggatttttattactgagctctgtgagtatgactttggagacacttccaagctctctggggagggatttttattactgagctctgtgagcttggacacttctccctcgcttatgagatgaggttaccagatgtcccttagaagaaactagtaaatgtttaatggtaatgtgtcaagctggtttatttccttaaccgttgatttaaaaactgaaatgaagctgggtgtggtggcacatgctgtaatcacagcacttgggaggggaaggctagggcagcaggagttcaaggccggtgttggctgcataggaagccttacaggagaccttatctcaaaaagatagataggtagatagatagatagatagatagatagatagatagatagatagatagatagacagacagatagtctggtctacacacacacatatatatacatatgcatatgcatacacacactcacacacacacacacacacacatatatatatgtatatacccttgtctacacacacatacatattcatacacacacgtatatgtgtgtgtgtatatatatatatatatatatatatatatatgtatgtatgtatatatatgtgtgtgtgtgtatccttgtctacacatatataaacatatgcataggcatagacatatacacgatttttgagacagggtttctctgtgtagctctacctgtcctctgtagtccaggctagcttcaaactcagactgactcctcccgagatgaattctgggatgaatgtgccaccaacaaccagcaaaataactatataaaaactggaattaagtgaatttcagaatagtaacctgtgcgttttcaagttcctgttcactctccagctccacgtatttccttgttcctggtctgtaaagacaatgcagatggggcaggtcagtcccgggaggcaggagagttggctctgctatgctctgtgacatggagaggtgctcagctcgcaccggaagagctgaaacacaaaggaaaaagagacacagtctttgaccactgaatcaggtggactccgtagcaacctccaagtactcccacctcggctttcaccagagttggctctgcctgaaggtttatggttaagagaaaaagtaatgtaaatgagaggtagaagtaaaatataagaaccaaaagccaagccctgcttctcagctgagatgcccggagcgcccctgtggttcgcagtctcctgggcatcagctgggagtcaggaatgggggtacccggcccacttcccctcagactgtccacgtgccaggcaggaaggggaaggcagagcctaggaagggcggaacccggtttgacttagaatgagtgccgagagtatggagggactggaggaaagaaggccttccccaaggagatccttaatgaagagtggattcgtgcttgtttttacaagtttatctgatggtggattgaatgcgtacactttagtctgtgtgaaccagggatcaaatagcttttttccgggaagaaatgcccaggaagggaagctcattggctgaatgctccagagctatctagatacctcattagcatggagaagaactccaggtgtctatgctacgtgacccattgcccatggtcctcaacggggtgtcgtggttacatgttcttgagcaggtccacgtaaccactgctgctcgactcttgctgattccaagtctctgagactcccgcggtctgagctcagtatgccttccttaccagttctcctgtctggtgtcacggcccacttccccacacatttcctccacctcctcttcttgcataatggccattgcgaaaactcacctggatatatatacactaaatcaagaccaaaggtccttttgggcacagaaatgagacagtgtaggcaaggcagaaaccaaaacacccctactgaccctctttccccccaaatctacttggtgaccaagatcacatcactgccccgtccccagcccccacaacccgctccatgctttctacttcttctaggaacaattagcttttacacggactcacaggtgcccaagcttgctcattcccttcatggtccatattaccaccaagaccaggaactcgaaggctgaccgtctccagctcgcttccatgcccctgagtcttcatcacacatcagttaagtaccaggatcccaccacatctcctctacaaagcccagcaaccaagtgctgtgctaagaacactactgtagactccgactgtcttttttgggcattgtagttgctcattggaaatacgttgtgccttcccaagactcgctgagtgtcagttctgggccctgcccatccttattctccatccgggagttacatagctcccttactcctttggctgagaatctgcttgttctttgggggctcacttgagcgtgccattgcactaataagatgcaaccccagctgctgtggatagtctgagtgatgtttccctccaggcccccacaccctcactctcgctctgtatgactatagtattccacaggtgcctccagtacgggcaaacttgaactctctggggctctcacaagcaggagctccaccaggcttcaccaaataagtgagactgcattagctcaacagtgccagtcacacagccgcttccagaggcttccagatggctacacccagcatcacagaaagaagagactgacgattcagttctagccaccaagatgtcttaaatcattagatgccagttttcttctctaaaaggtggatatctggggtaacaataattaccaccacatcacagtggtcagaaggctaaaaaagtcaacactggtaaatatacatgacactctgggtcgtggaaatgcctccaaaaaccaactttataaaaaaccgaagtgcctaggtccaccactaagtgattttattactccttttttctcccattgatttcttacaactaaaaatccaacttcatagctactttcttgttgtgatggaagggtcccatcacccacttcctggaaagggagagtaacctatgtttggttagaagatggacacccaagggtcggtaggccctgaaatcagaggtctggaaatcccatgatttaccacggaaaccacaacaggaccttcttgttgacacccaacccttcctttcccctccaggcctccgaggccctcagcgtggaaggaccagcgggtgcagctggaagcgcactctgtggtttgagttgcactcctccttgctgctgagtgggctggaccacaattactcaggggccatggagggcaggggaactacaggcctgggcatcttctgactgtcctggtgagtgttaactaagaccgagacaattcccagcaatgacatcacttctcagcgagcttgggcacaatcacccaattgcttttgagagcagaagaccctgaagcaggtgtgttccgccccccacccccagcactggttctcaaccttcctaaggctgagattctttaagacagttcctcatgttgctgtgacccaccaccaccaccataaaattattctggttgctacctcataactataattttgatactgctataaatcataagtaaaactctgatatgcaggatatctgatatgtgaaagggtcattcgaccccccaaagagtgtgtgccccgtaggttgagaacaactgctttaaaacattaatattactatcctgttttaaaggggttcaagatatgctccagtagctacagacttaaggaagtctttaaaaaaagttaaaaaaaatttatgaagcttattatgaaaaaattgcaaataaattaaaaattatatacaaaaagtagtcaaatccagtctataattcaagggacttctatacacttagaataggcatttagaatggaatctgtggagtttcacagtaaattttacgttttcagtttcaaataaattttatgcacttatccagataccatcaaaaacaataagaatgtgtggcagaattaaaactagaaaagcaagtggcttaatccccacttttatagctcaggtccattccctgcatgcagtaatcccaaagcctttttcttctctttccttcatgttacaccacacacacgtgtacacctgtttacacatatgcatatattattggttagatcccaagaagggctctccaacaggcccgagcatggcaaacatggaccagcaggttttgtcctttctccctccctctcctaaagccagcccccaagttctatcactcccttatttgaccactggctcattcctgagatgaaaacactgaggtccagcgatcaaacttcattatttggctccactggctaacctctccagtcaggactcaacttagcacagacttcccattttctccttaaaactcgcccctgcagaaacacctgctgtgtgcttttgtctgatctagagggtccagaggcagcccagccccctccccattccaccctaccccacctcaccactgcatccctgattgtctctttggggtaacaaatctcctttgtgctgaggatttggtatctgggtgagttttgtactgaccatgaggggcccccttacactccatatatgagcgagaacacatggtgttcttctttctgagagagcgcttaatgttgtacactctaagaccatccattttctgcagattttttaacttcatttttctttacagctgaatagtattcatatatagataatataaattttatattttatatactatatggcaaattctcattatccatttgtctgttgatggacagctaggacgattccattctttgtaatagtgaagaaagcacccataaacagggagatacaggtatctccaggatgagtgtgggagtctctgaatatgtgctccgaggtttttttaagtctccaaactgatgtcacaatagtctttctttctccaacgtagttgtcagatttcttggtggtagcttttctaattggggtgagatggtatctcaaagttattttaatttgcttttccctagagctaggaatatcaaactctctctctctctctgtctctctctctgtctctctgtctctctctgtctctgtctcccctttcttttcttttttcttttttttgagagacatctatttggttacttggtttgtttttctcttgttggttggcaggttggtatttaacttctgcaattctttgcagattctgccttgtgtctgaagtggggctggtaaagctttctcccattctctggctggctgttaactctgagtgcatcctttgctgaacaaaaagtagctatagcttggctgttttaattaagccaaggccttgaaattgctctttactgtacagaactgttgactgtttgtcagtagactaaccttgctcattcaccttcaaacctcttctggacatgaactttgcagggcgccatatcttgaacacagctccagtcccccaatggctgtgctgacagtacagtttgcctgccagacagcattccatctcacacaagcagaaggcacaaactactttcccaaagcaataaactgagactgtaaatcccatcgctccacatgaggtgggtgtggaggcaggcgggaaaggatagatgcgtgtatcaggaggcttttcataaagtgaacctggaccatgtgctatgccagccccaactagttgcctgctgcggtctggtttctgtaaataagttattattgaaaagagtcacacacatccatttgtttacacatagcctgtggttgagttgtatggcttcacaatgccaaaaaaacattcactgtatggtcctttacatagtgttgctggctcctaattttagaaagctccagagaatggactacacagacacacagtctgagcaaagaggagtgctcctgttctgtatggcggtgcatgcgcagatgaaccctttgtttatgcctacataaaacagtaaccaatctaaaaggttcaaatcccccccaatccaggaaactctgaaccctacccagtataaaatttatatgagttgctctgtgatcattaaaagtattcaggtaacaaacggccttaactatgaagaaggcaaacaaagacttgggcttctgattctgggctttgatttatgactgtttagagcagtggctctcaaccttcctaagtctgttcttcatgttcttcatgttgtggtgaccccaaccataaaattattttgctgctacttcataagtataatttttctactgttaggtattataatgcaaatatctgataggatgttgtggttgcgaccccctaggttaagaaccactggtttagagtggtccactctcatcgatgaaatgcaactgattttcccataagaacatctaaagagaaaagctgggattcagtatggcccatgtaaaggctcctttcaaactatgacatggtgaacagatattggttcttggggagcagagggctgtggttgaaactgcacattcacattgcgatgtttaataaaggggcttacaggaaggcaggggagattctgtgagggctcataaatcaacacatttcagaatttaaacaggggcatgttcaccaaaacaaccaaagtcaaagggacttaaggctcaggatgaaatggttagaaaagtggagggggtggcgggacacagattatgaaaaaggagccagcagtggacaaaggagaggccagtgttttcaggctgagacgggagcagagcagagcggtggctcctccctgtcacatgttgtcagcacatgccatttcattcctctggaactttctctcaccaccccagcccgccattgtccctgtgagccttcaggttctggctcagttgacacctttgcagagagcccttcactgccaccaaatctaacatcctgtccaatgcgtgggtagcaggaagaggtcacacgagctactggaggcgttggttccctgcatcactggctccttgccacctacacactccttctgcccaggccagagccgctttcactttttattcatgaatacgtctgtgggtgatgaagaattcaaacatccatggatttaaatgtacacagtctggatccatatctccctctcctgaggagagttgtttaggaagctgggatgagagcagacacataatgacctatcatgtgccaccacctggcatgacgccccacacgtagtaggtgttcatcaaatgctgactgaagaaaggaaggtggaccaatcttagcaaactttgcagtgctttggggactttctgggggatcctgctactgctgttggggttttgttggccaactcccaggagcgacattctcaaaagtctgtggctagtaagaggattagaccaggagcccgacactctgttccctacagtgtgactacttaactattgtgttgtgtggcctggcacacggtcctgtgccaatactgtaaatagagatttttctgtcttcaaataagtttgagccctccaaagcgttaacactgtccacacagattaatcccaattgttaatatgaacttttcttttgtcagacccgaaatgctggaatcattttcttcattggatacatttatttcttggttaaaaacaaagcaaaacaaaacaaaacaaaacaacaaaacaccttccacccattggtatgaattacgctgttccacaccaaacaataaaagccaaagtggctgttcagtaaattatgaggagtttctggagaacacagaaatggaaccccaccaaagcctctcttggcaaacaagcccttgaccatgggcttggtttctttgcttcttgctttctcgttgatggctttgtcacctctcaatcctggctacggggcctggctcgccaggcttcattcctgttcctcagctatgctttcaggaaaagacgttttgtcccctgcttaactcaggttggatgtggttcatctaaagataattacacacaagcacatacacatacatacacatcacacatacacacatgtcacatgcacacacaaaaccacacacatatacttacacacactcacacatacacacatacacacaaacacacacacacactgtaatgggtcagaaatcaatatgtgactccattctgaccaatgaaatgccaggaaaaggtctctattaaatgtgattgtgtgtgtgtgtttctgtctgtctgtctgtctgtctgtcatcctttagcccctcccactcctgtgagtcttcaggacagtagaagagggcatgagcatcatgggagccacgtgccacatgaggtccagaaaccacaagatgagcaggaagagtcactgccagctgtgggaagccctggcatttttgacctgtcttttcactaccaggccattgcttttgtggtccagccccacccaggtctgctcatcatctctcatagactttctactctccatacagaacttcaggtctcatgttgtcttcgtttctccgaagtcaggctggaaaacatgatgttgaggattatgaatgaaaactaaataagaattgtttgaataccaataaactgcatggatttctctatttgttaactggaataaacagaaacagaagattgcttaaaatcaggatgtaatagacaaaatcaggcataacagacaatcatatgaacacctggagaggtggctgggtgcttaagattgagttctggggaatggggagatggctcagcacttaagaacactggctgttcttccagaggatctgagttcaattcccacacccagatagtggctcacacccaatatactccagttctaggatgtttgacaccttgttctggcctctaccggtgccagacgtgcatgagatacacagacatacatgcaagcaaatcacccatacacataaaaataagtaaatcatttttttaatgagtgctgtctttaatgagtgaggttttttttagaggattgcagttcagtttccagtagctcacaaccacctgtaactccagctccaagggaattggatgctgccggtctctttaggcatctgcgcacatgtgtgtacacacacatacacatgcacagagacacagatacacatatacacagagagacacacacatacacacacacatacacatgcacagagacacagatacacatatacacagagagacacacacatacacacacacatacacatgcacagagacacagatacacatatacacagagagacacacacatacatatacacgcatatacatatacatggcacaggttcacacatactcgaacgtgcactcatacacatgcacacacttagaaataaatctcaaaaatggaagagttcagaagaaagttaaaacattcaacttggcggagtaaaaatagaaatgttaactccaccacctttaggatttcttagaaaaactacaagatcagataagaatataaaataggatgcgtgctaccacattctaataagaggtcaaagtaattgctggaatgacattgatcagtgccctctgagtcagaaacaaaatgaaaagaatccaagcgaggatgtgcaaagagaggcagagagcacacaggctggtctacaggaaggccatgacccctccagagagcacagaggctgatccacaggttaacaagatctccacagagatctgttggggtgatctttttgtacactgtgtaaagattatctttgtatttcttaagtgaagattttgatgcacactggactttggtatccttaaacagcttagtcttagtgttttgtaaatactcccccaacaccttctgattggtttaataaagagctgaacagcctatagcaacgcaggagagaatagcgggactttcgaacagagagataggaactctgggagagagagggagatttgcctaccagactctgaggaagttgggcataataaaactgagaagcagtaactaacaaactattagtttgcagagcgtagatcaatattaatgggttaatttaagttataagaggtagttgggaacaagagtaagctaaggctttcataaatatgtaaaaggttatcatgttattactgggaagctcgtgggctttagaaggtcacattagagagatcacaaaggctggtccacaggcagaccatgacctctgcagagagcacacaggctgatgcacagagagaccgtgacctctgtcctctgcagagagcacacatgctaattctcagggagaacgtgacttctgcagtcagcagtcgaagaaaaggaacccgcgaggtatcatagatgtgaccacacgaagcagccagctcacctggcctcagaggacacaaaaagctagggtgagaagattgcagagcagagatcattcgtgcaggaggcagctccttggtttgaaatccccaccgtcagcagagctcccagggctctgaggaccaggtgccagatggcaggagcttatgctgacagacacagtgaccaggctggtactgagacttgtgaataaaactgaaaactgctattgggtgtgagtgctgctgtcagcctgtagcaaacactcctcaggggacaccgacagaaagcagaatgacatcaagggaaaccaggagggagtgtgatccctctccattctgcacagggaaactgagagaagaccagggatgaggcttgtggtgtaccgtgccttccaggtgcctaggatggtggacttggggttgataacctcagtctgccttgtgactgagtctctgccccacatccttctcaggtttgaatctccaagaattttttctttcagatttgcaatatgtgaatctctcttataatgcagagagagggagagagggagagacagacagacagacagacagacagacagagagaaagacagagagagagagagagatcgctatcttcccccatgaatgaggggaagataccccaacagtgcaacagtcacagctgaagtttcctgggacacagtccatcactatggagtgaccattccttagaatcagacagtgtcttctatgaacatgatattaccttatgactaaaataatccctgacaaatttgttccaagaaatgaagagaaaagaagaaacctgttacggacatgcatgtactcatgtccacacacacactatgaacatgtgatgggtactcggttcctttagtcttcttcttgtgaaccagtcatgagtctgtggctggtacttgtaacttcctccactggctctgtgtgtcctcggtcctcagcttcccctcagctttccagggctctctacacagcgaggtcctcagctcctctgggatctaagtccttgacggtcttgcatcccgcaacccgcatccttccttcttccggtggttttgctttcactttcataaaacaggaaataaggagggaaagcccagagaggcccccaggttccttacggtcatccttcgcccttgatacatggcaaaagcccaagtgattgatcacatgatcggccccgttcagagggcaatccccttcctccctaacgagagaaatcccatatggtgaatttctctccctaacaacgtggctaccactggagtccttcatgaaagcacctatctcttcaaagcaagatgtcctacaggaattcaagttcaagagaagaggaaacaaactttctccaaggataacgctgagatttctgtcccaataatactagctacactgggaatcgaggctcccttgctctagcacctgcagcattggcccctctgggcatcttgggtgcagaggtgacatcctccaccctagttataaaagggtgcatcaccagaagagcagtgtggtgaaactgtgacctggggggtggttgaagcttcaatgcaccacactgaaacaagtctgtatgagttcatgaccagctgtgagctaggcaaggtggctgtcgtattagcaaggacaagcgctacacaccacagcgtgcattgagcagagccctctgccagacaagcacgtgctccacttcctcccctgccctggctcatcatagacctcctccttgactccacattttaatggacatatagaggcagcagctgagaaacaaagacaggttttcttgtggggtttctggccctcacaccactgctttataatcatatttcacaagttatgtgttcatactctgctttgagtaaaacaaaaccaaaagtataaataaataaataaataaataaataaataaataaataaatgccacttaaagtggatttaggggcataagcctgtatcactgaaaagaaaacattaacccatcccttggttttcctttttctttgaatgaaccaaaacaccattatatctcactggaccgaaatgtcctttgtcctgcttgctactgagttgatagaaaattcggaaatcatgcacctggcttgtagtctacatagccaccaaaataaacagcatcagggtttcaatgacatggtagcaccaacaaatctgaaatgcctcggcccttaagtagatgggtttgtgaaacttgtccctggagcgatcagaagggatggtgcctaaggggactgaaggaggatctactctgagcattgagaacatatttaaattttcaaaacttgggaagggactttcagtggctctgagccagtccctttgctcttaacagaccatgagcaagatggcagcattggactctctgagcatcttgggtggagagttgatatccagaccatggagtagaagaggagaagtgtgagggcataggggagggaaggggagagaggttgtgttatttgcagagagtgtgtggcgccaggcgtgtcagccatagagacaaaaatgtgcctggaagaacatcaccctcctagccgtcttcggcccttgatgtactccgactaactctcacaaagatagaattttggaggagggacttgtttttctatttgcttttaaataacagtcggtgttggcatggcatgggtgccctttatggaactaaattgccacgatggtatgggcttcagggaagccacatggaaaggccgtctgtgcgtaagcgaagagctgccttaaatctctgccatcaaaataatcccagttgccctggtactggcatgagacaggagaatggaatgcagccatatttcttctttattgtttcaggagaaaattgttgttataaatatatatacttagggctgacaggtcagcctgccctaaagagtaagtggggttttgctaggcagcgatgaactccctttagttggtcttcgggagaagaaaagacgtgttaggatgacccacccccaccctccattcccaacagctcctgaggcaccagaggctctggccagcatggttgagaggttttgaaactggatttatgagtccttgttttgcactccctggctattccattcctcttactcagagagataaagccaccctccccctgccaaacggagggatgatggaggccatcccctgccctggctctccacttctgtactccttgccaaagctacagggttctcggagctgagttgaaacttagcacctcacaggaaggaagagctcggagagcccaaaggcacaccattgccagctggatgcttaatgtatgctcagaatttttggtttttctgaccaaatggagatactgttatggtggtcacaggggttggcagggaaaccttcaagttggtccttgtcagaaaggaatgtctgaaaccctctctgtacacacaggtccttactctttccttcaaagctcccgatggatcctaatgcctctaaattacccactaagtgcctgctgtgggcctgatgttatgctgttatgctatccttttgatctgttaaattacacttttatttttttatgtataacaacaaagctagtgagtccttaaataaaaggaggcagatttcattgactcttggcacttttcaaactgaaaataatggagaaaataattactcttgtttattattgctgcttttcataatcaaaacacttggcctcacgttgtcattgtgatagggtctgtgtggccagctgttctcttccaactctataaaggaagctatgtcattgagcccatgtctgatctcagccagggttctcctccggctggaactgtgagtctggtaaaaacaggtcatctgtggcagtacgtgccacgtaaaagtcaaggccactgggcatcagctgcctcacccttgcagagattgctccttcttgatttccaagcattgtctgaaaatggaagagatggccagtcaggtagcaggatggagaaaaatgatgtaggagccaagctcctgcatgggaactttttaggtttctcacaaggtagccggctcaacttgaagcattgccactggaccctcactgaaaactccagcagtcaagcaagagcctagaccgacattcttgttctacgagacgtgtggggaaaaggacacaggatgaggtattgtcatttgaagcaaatggatggagttgggggttcctgcattgagatgtagcaacattaagtggacttcactgacagtcccagaccaccaacaattaacagtttgatttccctgtaaagcatttagcatatgaacttaggcccagcttttccttcaggcgtcccttgagaccatgtagccaacgtgtgaatttgtcacttagaaagatgggtgcaggagcaagagctgctcccatgctggtcctctgagaagatatgaaaccatctcagggctccattagaacagacatgaaatggaggtatcttgtgtttccacaccatgcccctagacccctctgagatttcagagcccttctctgagttcaaacgtgtggaatgacaaactatacacagcttcctaatggtgctttctttggcaatggacattcatgtctgctgggttgagggacaagacccccaaagcttagggcttcttccttctgtgtagaacctgaaggtgatgttactattgttcaaggtttgtctccatcactttttgccctcataacccactcccttggctctagtagactcctggagaaccagcaccctcagcccacagcctaacctgccacatgctaacaaccaagatattatgtgttgaactgaatcttcctgattttccccaccaatttctctgaagccttccttctatcacctgtgccctcagctaggagtcagaagccattcggtaaggagcctcatggatgcaggactcccttgttgcctccagatcagatgctggtcagtgtttgtaaacatagtccatccccaaacagaaactaggcactatagattcagggagatttcttgtttatgacaacctctcagtatacctcatcagcccggtcctttctagtccatagtcatccccatccccatctcctgtacccccatggggatttagaaattactaacaatcacaaagaatcatacagacaaggtggtcctcacctcttccattttcctcttccattttctctggacaaaattttgtttccatgcctgtccaaaacaaaaaacaaaaaaacaaaaaaaacaaacaaaacaaaacaaaacaaaacaaaaacaacaacaacaaaaaaaaccatccaaaacaaaaaactgacagtagaagctagcaagatggctctgtggttaagaagacttgctgttcatgccgaagacccaagttcagttctgatacacctatcacactcttctggcccctgggggctcctgcacgaagctggtacacacatgtgcactcaggcatttgcatatacatacaaaataaaaataatattttatagtaattacagttactgtgtatctgccatataaaatattggggggattaaaggagctgctggcacatgctgtcaagggctgtgaaatgagatggtttaaaaagaagatagctgaccccaaacttctagccctttgcaggcctgcgtgcaaagtcactagctgctagctaattttgatggggggagggggggaaatcaaggtcagtaataagatgattgatatgatttgaactgccaatcaaagtttctgaccccagaggatataacctagggaattttctcatctcccctgatttgcttcaaactgctctggcaaagcacttaacgtcaaagagtggagacgggctcggagctgtagacacatctgcaaagcaggggcaagaggaagatggactttgcaactcctaaaaatgcccaggttgtggctgagaaacctggaatctcattcattactcctggctccaggctccaggaaatccgcagccacagagccagaactggagcgtggagaagccattggttttgtgtctcttcccgttgcttcctacagggttcaagaaaatgttttgtattctatcctcactgtaggtggctgtggtcctaagacaacctcacagagtcaactcatggtgcaggtaggagccaaaatcaattttctgcaacacattctctggcacaaaagactcagagtaagtctatacactgtgatgctaatagccacagtcccttggccctgtgccaaacactgttgtgagcacgtgacacatgagccacccacttcctctctggcacagatgccctggcatcatctgaagtaagtctttcaaagcaggtgacactggcatcttttctctttccataaatgcttcttttggtttatgatggccggtttctcgtacaactgtggaaaagtctatgtcctccactaccagtgtattagtcagggttctctagagtcacagaacttatggatagtctctagatagtaagagaatttattgatgacttacaggcggcagcccaattcccaacaatggttcagtcgcagctgtgaatggaagtccaaggatctagcagttactcagtctcacgcagcaagtaggcgaaggagcaagagctaaactcccttcttccaatgtccttatattgtctccagcagaaggtgtagcccagattaaaggtgtgttccaccacacctttaatcccagatgaaaggtgtagcccagattaaaagtgtgttccttaaactaggaggtttaatcttctggaatccatagccactatggctcaagatctccataccaagatccagataaggatctccaagcctccagataagagtcactggtgagccttccaattctggattgtagttcattccaaatatagtcaagttgacaaccaggaatagccactacaaccagggaatggagaactctcctggaaaatcacttcacacttgcagagaatggccatgcccagtgacctgtcacacccaactagagcagcaattataaatctgtgggttgtcaccactctggggtttgaataaccctttgacaggagtcgcctaaggccatcagaaaacacagatatttacattgtgattcataacagtagcaaaattagttatgaagtagcaactgattaattttagggctgggggtcaccacaacatgaagagctgtcttagagggttgcagtgttaggaaggttaggaaccagtgctcttggattacacagagtaatccaagcatcttcttggttcaggcaagaagtaagaaacatacacaatgctttccttcatgccccacctcaggcttatactcaggagcaaatgaaagtgagtttttagagtctggagcagggaggctggcctatgggatggtatagtggcagacccagaacagtacaggagctgagagctgagggctctctgtgaactcctgacactgcatattttcactaatacgttatttttttttctagagcactgtccttcaccccaccctaccaccccaaaagtacagcacgagcgtcaaggacccaaaagtgtactgtgaagtcaccttggaagggcttggatgtcagcctcaatgagttctactctatcctatagctactgtgatatattcacccctgaggccatgttgttggttgatgggaagctgatgccacaaaagtcagcaagggtaactccagggtaaaggaaagccagagtctaacaattactccacgcctttgggcagagtcgatagccgatattaggaatgaggatagctaagtctgtaagaacttggcatggaaggatgggcacctggattctatttccagaacgcatattttaaaagctggatgtgaagccaagctatggtagctaatgcctttaattccagtactagggaggtggaggcaggaagatctctgtgatttcgaggccagcctggtctacaaagtgattttcaggacagccaggagccagggctgtactgagaaacctaaagaaaaaaaaaaaaaaccactaacaaacaaaataaaaaagcaagcaagctggccatggtagggctcatgatttgataacaggagctcactaacagccagcttagcctagtaagagaccttgccttttacaaagggggagttgagtcaggaccagagagatagatggctcagcagataagagcactgactgctcttccagagatcctgagttcaattccgagcaaacacatgatagctcacaaccatctgcaatgggatcggataccctctggtgtggctgaagacagctacagtgtgctcataaggagggggggaggggaaggggcagggggaggggaaagggaaaggggaggggaagaagaaggggaagaagaagaggaagaagaaggggaagaagaaggggaaggagaaagggaagaagaaggggaagggaagggagaaggggaagaagaagaagaagaagaagaagaagaagaagaagaagaagaagaagaagaagaagaagaagaagaagaagaagaagaagaagaagaagaagaagaagaagaagaaagaggaaaagagaaataaaacaaggtagatgatagatacctgagggataatggttctgaagttgtcccttgatctccatatgtgcacacactggggaaggtgtagtgttatcttagcaaaggaagacactcttgttttgctacaggacaaaggttcacaccatccctaaagagctgcgtctatgaggagacagagcccttgctggccagataatctgctcagctagtcattcagtcaccttgtcagccacttctgcccctgctgttaccgtgtgttaatttcttctatgagtcccacattgagtcagcatgagttaactctgtcctgggcatttccatcagacaccaggcttcttagcagcagccagaggtggggcttttttttttggctaatgctgtttacccatctttaaatgagacttgcactacaaaagaaattcctgtaaagacatttgttttcaatgataattggcttttttttttcacttgcccatagctttctaaaaataattttttctgaaatttctctaaattgttttcagtgtagttcaccttggttttttttaagtattttttttttaattgatagaatggggtagggggatgggaaatcccgctgataatttctgagtgtgggtatttagaatatgaattcttgggccttattactttttaaatgcaaactattacttttgagtactctagggttgagcatcagcactggttgtcggtgctgtagctctcttagaacttttaaatatattaacggaaggaatttttaaaatatgtaccaaagatctttttaaaaaatatttctaataaattggcttcagttcccttgggtcctgggtggttcaaaacctctctggttggttcaaacctcaccctgcactgtcctaggacacaaccaaccaatgtccaaattaaaaaaaaaaaaaggttgttgtggtctggagcttacagaaagaaaagaaattcctaccagccataagttttcttcctgctaagaagttcaccttgttactatctgaagtccatagcactatgggtctaatggtacaagccaggaggttaggacaggcagatcacaagtttaaaacccaatgggggtacagagtgagtttaaggacagcctagatggctttgtgagactctgtctcaaaataaacattgttaaagaaatcaagggcatgactccgtgatagagtgcttgcccatcctgtgtgagaaatcctagattctgtctggagttccagaatggtgagaaggaaagaaggagcagcagggggtgggaggggcggggagggacagaaggagggagggaggagggagggacagaatgaaggagcatgggagaggaatgtgaaggagattttaacccagaccacttagcacaatgtccccagtaactacaggtcctgggtaacagcaagttaccacttgctcttccttaaagagggactggctgtctgctcctattatcagcaatgagagtccctgcccagctttggacaaagggtttctcctccttctagctatcaaagaacatgagaaataacaggggattagccacttagttctgtggccaccttttcagagtcgctacttctcccaggaaactttcctacaccaccactctagtgagacagacagtacagagctcttccatctaggcacacccagaagtgtggcttctgagacaggccacagagaaaccagagttttgaccacacaggcgatggacactcctttcctttctgagcaggctttggtattgtaaattctagaagccagaagaagatactgttccagccccagccccagccccagccccagccccagccccaaccccagcccccgccccaggcccaggcccagcgccaggcccagccccagtcccagcacctgccccagccccagcacctgccccagccccagcacctgctcctgctcctcctcctgctcctgctcctcctcctgctcctgctcctcctcctgctcatgctcctgctcctcctcctgctcctgctcctcctcctcctcacactcctcctcctccttctgcacctcctctcctgctcctcctccggctctgttgctctcctcctcctcttgctctccttgctttgatcatcagctcgctcctggtcctacaaatgatcctgctcctgatcctactccagctcgagctcctgctcctgctcatgctgctcctgctcctgctcctcctcctgctcctcctcctgctcctgctcctcctcctcctgttcctgctcatgatcctcctcctcatgctcctcatcctcctgctcctgctcctgctcctcctcctcctcctcctactcctgctcctcctgctcctgctcctgctcctgctcctgctcctgctcctgctcctgctcctcctcctcctgctcctgctcctgctcctcctcctgctcctgctcctcctcctgctccttatcctcctcctcctcccgctcctcctcctcttcctgctccaaatcctgctcctgttcctcttcctactgctcctcctcctcctactcctcctcctactcctgctcctgctcctcctcctgctcctcctgtcctgctcctcctcctgctcttcctcctcctactgctcctcctgatcctcctcctcttcctcctccagctcctgctccctcctcctcctgctcctgctcctgctcctcctgatcctgttcgtgctccttctcctgatcctgttcatcttcctgctgctcctcctcttaacgctcctcctcctgctcctcctcctgctcctcctcctgctcctcaagtaaaactactcctcctactcctactacacccaaaaaccaacaaaaatcaaactcttctacaccaaaactaaacctacccaaaaataatcatatatcctcctccagatcatcctcctgctcctgataaagatcatactcatcatcctcctgctcctcctcctcctcgctcgtgctcatcctcctcctgctcctgctcctgctcctcctcctcctgctcctgctcctcctgctcctgttccggctcctcctcctcctgctcctcctcctgctcctcctgctcctgctcctgctcctcctcctcctcctgctcctgctcctgctcctcctcctgctcctgctcctgctcctcctcctcctcctgctcctcctcctcctgctccttctgctcctgctcctcctcctccttttccctctcccgctcctgctcctcccccatgtcctgtcccgtgcccttctgctgcttcttcttcgttggctcctgttcctgctcctcctcctcctgctcctgctcctgctcctcctcctcctcctcatgctcctgctcctcctcctgctcctgctctgctcctgctcctgctcctgctcctactcctgctcctgctgctgtctgctcctgctcctactgacctgctcctctgttccacctcgtgctcctcctcccgctcctcctcctcccgctcctcctcctgctcctccttctcctcctgctcctcctcctgctcctgctcctcctccttatcctcctcctcctcccgctcctcctcctcttcctgctccttctcctgctcctgttcctcttcctactgctcctcctcctcccactcctcctcctactcctgctcctgctcctcctcctgctcctcctgtcctgctcctcctcctgctcttcctcctcctactgctcctcctgctcctcctcctcttcctcctcctgctcctgctcctcctcctcctgctcctgctcctgctcctcctgctcctgatactgctcctgctcctgctcctcctgctcctgctcctcctcatgctcctgctcctgctcctcctgctcctgctcctgttcctcctcctgctcctgctcctcctgctcctgctcctgctcctcctcctcctgctcctgctcctcctcctgctcctcctcctgcaccagctcctcatcctcctgctcctgctcctgcaactgctcctgctcctcctgctcctgcttctactcctcctcctcctgctcctcctcctcctcctgctcctcctcctctcctgctcctcctcctgttcctgctcccactcctcccctgctcctgctccttttcctcctctgctacttctcctgctcctgttctctctgctgctctccttctaatccactcctctccaatcctgctcttctccttctcctccttcccggctcctcccccctgctcctcccccctcctggtccctcctgctccctgctcctaattcctcccccctttttcctggctcctgctcccggctccctggttaatgtttccccccccctggttcctggtccctcctggtcctggaaaaggccctggctcctggttttcccggtccgggtcctccccccggtcctggtcctgttccccctcctggtcccggctcctcctcctgctcctcctgctcctgctcctgcttctccttctcctgcttctgctcctcctcctgctcctcctcctgtcatcgctcttgctcctcctcctcctcctgctcctgctcctcctcctgctcctgctcctgctcctcctcctcctcctcctcctcctcctgctcctgctcctcctcctcctcctgctcctcctcctgctcctgctcctcctcctcctgctgctgctcctcctcctcctgctcctcctcctcctcctgctcctgctcctcctcctgttcctgctcctgctcctcctcctgctcctgctcctcctcctcctcctgctccttctcctactcctgctcctcctgctcctgctcctcctcctcctcctcctgctcctgctcctcctgttcttgctcctgctcctgttcctcctcctcctcctgctcctcctcctcctgctcctcctcctgctcctcctcctgctcctgctcctcctcctgctcctgctcctgctcctccagctctgctccgcctcgtcgtccagctccgggtccggactcctcctcctgctcgtgctcgtgatcctcgtcctgttcctcctcctcctgtcgtggtcctcctcctcgtggtcctcatcctcatgggtcctcctcctgctcgtgatcctcctcttgctcgtggtcctcctcctgctcctgtgcctcctcctgctcctcctcctgctcctgctcctcatcctcctgctcctgcacctgctcccgctcctcctcctcctgttcctgctcctgctcctcctcctcctcctcctcctcctcctcctgctcctcctcctcctgctgctcctcctcctgctcctgctcctcctcctgttcctgctcctgctcctcctcctgctcctgctcctcctcctcctcctgctccttctcctgcttctgttcctcttcctggtgctcctcctcctgccgctcctcctcctactcctgctatcctcctgctcctcctgtcctgctcctcctcctgctcctcctcctcctgctcctcctgctcctgctcctcctcctcttcctgctgcggtactcctgctcctgctcacctcctcttgtcacttctgctcctgctcctcctcctgctcctgctcctgctgccgctcctcctcctactgctgctcctcctcctgatcctgctcctgctcctgctcctgctcctgcaaccggtggggtcctgctcctggtcctcctcctgctcctcctccccaaacaaaatcctcctcctcctgctcctgctccttccccctcctactgctccctgctcctcctgcttctggctcccggcttccctctccctcctggttcctaactcctgctccctcctgcttccggctcctggcttccttcctcctggtcctggctcccggtttcctgctccctccctcctggaacctggctcccggctccttctttcctggctccctggctcccaaaatccctccctccctccctggctccctcccccccggggtcccttcctgggtcccggggtcccgggatcccccccccccccggggtccccgggctcctgggtcccccccccccaggggctcccgggtccccaggttccctcccatattttccccccccaccagggatcctcctcctcctcctgctgctcctcctcctgctcctgctcctcctcctgttcctgctcctgctcctcctcctgctcctgctcctcctcctcctcctgctccttctcctgctcctgttcctcttcctggtgctcctcctcctgccgctcctcctcctactcctgctatcctcctgctcctcctgtcctgctcctcctcctgctcctcctcctcctgctcctcctgctcctgctcctcctcctcttcctgctcctgctcctgctcctgctcatgttcctcctcctgcttctgctcctgctcctcctgctcttgctactgctcctgctcctgtttctcctgctcctgctcctcctcctgctcctgctcctgttcctgctcctcctgctcctgctcctgctcctgttcctcctcctgctcctgctcctcctcctgctcctgctcctcctcctgctcctgctcctgctcctcctgctcctgctcctggtcctcctcctgctcctcctcctgctcctgctcctcctcctcctgctcctgctcctcctcctcctactgctcctgctcctcctgctcctgctcctgctcctcctcctcctgctcctactcctgctcctcctgctcctgctcctgctcctcctcctgctcctgctcctgctcctgctcctcctcctgctcctgctcctgctcctcttcctgctcctgctcctaatcctcctcctcctgctcctcctcctgctcctcctgctcctgctcctggctctcctcctgctcctgctcctgctcctcctcctgctcctgctcctgctcctcctacttcctcctcctgctcctcctcctcctgctcctcctcctcctgcttctccttcttcttgctcctcctcctcctccttctgctccttctgctcctactcctgctcttcctactcatcctccacctcctactcctgactctcctcctgcatcttcctcctactcctcatccctcctcttcataaccctacatatccctcaccatacttatacataatcatcttacacctaatatcacatacataatacaccactatcaactttcctccaccacctgctcggctcttgctcctctacctcctcctgctcctgctcctcctctacctccacctgctcctactcctcctgctcctcctcctgctgctcctcctcctccagctcctgctcctcctcctcctcctgcagctgctactgcatgaaccagatcaagctgctgcacctgctccttcctcctcctatcctgcttctgctcctgctcctgctcctcctcctcctgtttcctgcttctcctgctcctcctcctgctctgctcctgctcctcctcctgctcctcctgctcctcctgctcctcctcctcctgctcctcctcctcctgctcctcctcctcctgctcctcctgctcctcctgctcctgctcctactcctcctcctcctcctgctcctcttgctcctgctccttctcctcctcctccacctcctcctgctcctcctactgctcctcctcatcctccttctacacatgctcctgctcctcctccagcagctgctcctgctcctgctactcctcatccacatcattctgatcctgctgctattccttctgctcctggattcgctcctgctcctgctcctcctcctgctcctgctcctgctcctactcctcctcctcctgctcctcctcctgctccttatgctcctgctcctcctcctcctttctcctgctcctcctcttgctcctcctcctgttcattctcctgctcctgctcctcctcctcctgctcctcctcctcctactcatactcctcatcatcataatcatccactagctcctgctcctcctcctaactacctggtttcctgctacctacctgctccagctgttcctgctccctccctcctgctctgactcctgctcctcctcctgctcctcctgctcctcctgctcctcctcctcctgctcctcctcctcctgctcctcctcctcctgctcctcctgctcctcctgctcctgctcctactcctcctcctcctcctgctcctcttgctcctgctccttctcctcctcctcctcctcctcctgctcctcctcctgctcctcctcctcctccttctgctcctgctcctgctcctcctcctgcctcttctcctgctcctgctcctcctcctcctgctcctcctgctcctcctgctcctgctcctgctcctgctcctcctcctcctcctgctcctcctgctccttctcctcctgctcctgctcctgctcctcctcctgctcctgctcctgctcctcctcctcctcctgctcctcctcctgctcctgctcctcctcctcctgctgctcctcctcctcctcctgctcctcctcctcctcctgctcctgctcctcctcctgttcctgctcctgctcctcctcctgctcctgctcctcctcctcctcctgctccttctcctactcctgctcctcctgctcctgctcctcctcctcctcctcctgctcctgctcctcctgttcttgctcctgttcctgttcctcctcctcctcctgctcctcctcctcctgctcctcctcctgctcctcctcctgctcctgctcctcctcctgctcctgctcctgctcctccagctctggctccggctctggttcctgctcctgctctcactctcgatcctgctccactcctatctattgggatgatcccatctgatgatttgtcctcaccaggagctgcaagattgatggccaagtatgtctggtactcacacgtgaactctccaagaactcatgtaccccctaaagcctctgttgaataccagctatatatcaggagcaatgggaatggggttgtaacgtcagttttaatgagatgccaatgggcaaagccacctctggtgtttcatccatagcctcgtttgcaggtcatagtgtcttaaagtcagagtaaaaaattttgttcaccacaaaagcttgctgtgaaattctcacaaagttttgaaccaattcctacagagcatatttccacacttgtaataagtatgggacaggggcagtatgacaagctagtatcatttctccattaaacttagctgtgaaataaaaataaggctaccatagacaggtgtgggcaactgggtgaggcccctagaccctctggcccttgagctacatggatttcttcattgccttagaagagtcctccggaagagatccagggtgatggggtgtcccagatacagctcccctagaatggagggaaggctggacctatgaggatagtgtaagtgataaaagagattaattcctatgccctgcggtcactacaggcaccagtaaggggtggctgcaggctccatacaaggtctaggaatcttccttctatgctctttcccaatttctttactgaagctgatgtgtgaaagtgacacacatcagaaaatttaagcctgagtgagaaagacctcccacgtggaactcttataggcacttgagcaatttttaactcatctcctaactctgggtgtggagggtcggggctggggcgggtggtgtgggagcggcttcaaggttaacgggattttctgtctctacctggtagttacttttaacaattccacattaggtaggtgatattaacatggattcactgtttctttccgggcaaatttttcacatttctttcttatttttttttcttcttctcttaaaatcccacctcttttccccagaaagacatcttctgcttcagtggccccagcctgcctgggggaagttgtgggaagtccccctctgcctactgtctgatgcttcttccagccaggaagctgagcacactaagtgtgagaaccacttggaaacaggagtctctggctctggtctgaagcagatcctgccacacttggttgagtgtgtaaactagcatagtcttgctggacttggacaactgttctcaacctctgctcttaaacctccaagtcacctgcagaattccccttcagtcaggaagtgtgctatttcattttggtctgcccagtctcttggctttttatttgaaatgcttccaatgagagaaaacaggaaccgagtagcttgcatttaaggaaggagaagttctgttggcctatcacatcaaggagaaattttaaaatgagaagaaaagaaccgccaaaaggaaaaaaaaaagtaatttcccttttgacagttatttctgaacacaggcctgggggtcatactcaagaaagtgggggttcaattccagctatttgctcagaatagcaagatgctcttcctgatggtaccagactggcccactactttacatatacaccttcagtctatgccccctgttgtgccctccaggctcccaacaagctaacccagttagggactaggctcaaaagctattgttttaaagccatatattgcctcttctttttatctttatctatcaaaacagggtagctcagaatgcagaggatgggttcattttttggcaactaaaggcactcaggtagctgcccacatttatatacgtgtgtatttaggaaccgaacggcactctcctcaagaagtctaatctgtcagctcctctgaaagtggcactgggaggcagaacttgtagggaggtaaactgatgtccatataggcatttggagaaagagacaggctgggcatgtgtgcacagagaggtcacagaaggagagcatccatctccaagccaaggacagaggtcccataaaaaaatcaaatttgccaacagtcttatcagaactacaggggcaaatttctgttgttttaagcattgtttccattgcaactgtttgtcatgatggtcctagaaaactctcgagggggggggggcggggatcaatattggaataagtggtacgaggcaaagccttctccccaggctatgctagaactgttgagtgccgggttcagcgctcagccccttccttgtccacactgtgaggcttctcacccttccctctgccactctcaggggtgtggcaatcaacctggcgtgggccttttcactccactcagagcccgtggagatgcaggccattctccctacagtgaagaacatgaaaacattccagaagctgaatggatgtcatcaccttgctagcatggagacatgccagtccacagcagccaatgacttggaaaactggaatagccaacacctcacgcactgtggagacccacgaagttactgacccactacaagtaatatgaaaactaaattccccagaatcccagatcagccctcaaaaccatcacagaaagtcattcttgtatggagtctgtaaagttcgactcagaaccctgtgactccgtcctcgagattttgtatcctgaaaaaaacccttctgtgtcactcgttcccatcagctcccttcacacccgtggctggttgcacttgatttaacatctctgccatctactttaaagtttattatctttaggggatggaaggcagtgtaaggaagcagaatttcactatgtagctcaggctggcctcaaatttacgattcagctgcctcagttttgaaagtgccgagctacagtctcgaaccagcacacctaaaattcatcatctggaaaacgctaccaaaaaaaaaaatgcatacgggagggaggctggaatgatggctcggtagggaagggtactcgttaccaagcctggcaacttctgctggatccttggaacccacatggcagaggagaatcaactcctgcaagctgccctctgactgctacatgtgttttcagcatgattaataatttttttaaaacccaacatgtacacagtgcaccctatgagaaacactgtatctatcggtgacttactatgacagttcaaaataaagctgagcggctgtagtgggggagaaacatgtttttcaacttgtttgcagtgtttttcaatgctggtttggtggctcatggacaaatgtgacaatgatttacagtcattcttggtttcgggctcctgccactggacaacaaccacctggagactcagtgtgtggaggcagcaccggatctgctttgtcctcactcctgagcatcccagcatgggctctgttttgcttgaacttgctcaaactgtgagtctttccagtgtaactccaggatggcctgacatgcatctaagagctggtacaggctccttgcgaggctacctgagctctcacacttcagaaggggagactggtgtcctcccgtcttatctcagggcttcctcaaagataacaaaaataaaagcttcgagggccactgggctgcaggcctgcccaacattcatgtggcttactttctccaagtcatgagaccaagtggcttcaaggacaggggaagtagacccctgtcccttgataggagcagctgcaaagggtgatggccacatccaaccaaccacaggattgcagcagaatcggcagctctgggttctcgttttatgagcaaaagacaaggggttaggggagggagctggggaagtagtgcctgctaggtggtgagagaaactgaaacctttatcttttccagtaagaattatgacctgcccttcagtaggctgcccaccgtccacggctgccgtgggaaagaatccatgcacaaaactattgggtcaatttacccagaaaactgtttccaagtcacagctctcaggcctgcctgcctactggagttgtgtgtagagttcaggccgcggtgtagcctggtggcagatcttgtctagcataggcaagatctgccaccctgacaccacaagaaatactgatgtcccgacccattgttataaattctgacttcgttcctgaaagactggtgttagtttgattgttttcccagtgcttctcaaacccagcgaggaagcttaagaagaaatggcgtctaaacccttggcaagagagagccaactaatgccctatctaccatgctgtctaatcacgtgcatgcaatatctgtagtaaaaacctaatgtgacacacacggtgtcctcgtggatgaaggaatcttgtctttcagtgtccagggatcatagagtgccatttatggagtgctaagtggtgagggaagggtagccacctgggacactcaggctcagaacacactgacacaattgcagttcatttggttttcctagcccagggaaagtgggagtgactcggcgatagcagaatgccatatttatttgaggttggaaaagagataaaattaatgacatctgtttaggtagacatttagcccatcttgggctctaagagtgcaagcagagtcacctagcaaatgtcctggtgattgttcttaaccaagaagcttgaagggcgcctttggaacaacccccgtgtatttatctgggaagacataacagggactcgggtccctgggtcagaatgagttcctccatcctgagggcctgcagtctaatttggaaagcagggaaatttggaaagtgtgaaactagcaactctgaatggggtgggggagtaacccagcaagggaactaattaactcccaaacactaacaaagcacaccagagtgtcagtggctccaataggtagctgcaggtgactctctgtgacgtgcacaccccaagcctgccaaaataagagctctaggatgaggccctgcatgtacggctcaggaggttgccatacacactccactctgaacagcactaaacaatatttgaaaaatggctgccctctgagacttgccagagcccacatacatgtcaaagcttagtgaaatgtcatatgtggggttgtggacctggagagatgatggttccatctatcaagtgcttgttcactccacacgtgtgagaactttgagtttggatctgtagcatccacatgaaaagctatgcaaagtagcatgcagctataatccaactgggggtgtagagatagaaggccccagggggtgggccttactgggaggccattgtagtatattgcggggggcagggggggcgagagaggtgagaggaagagggaaagggaaagggagaggaagaggaagaggaagaagaaagagagagggaggagaggcaggggagagcacatgtctcaaaacaataaagtggggagcaattgaagattgaagatagtcaatgttgacctctggcctacatgtgcctccagccagtgtgtgtgtgtgtgtgtgcatgcacacacacacacacacacacacacacatacacacacacacacaactttaaaacacagaagatatgtgctcatggttttccagtcaacatctgagaataaaagagagatgtgcgtttacacagctgtgtctaatgatttcaaaagtttcctgtgtaattttatggaccaagggcaggaggagtcagactaggcttcttgtttatgtggcaagagcccaggagtagtggaccccgaaaatcacagctgggacctgttctctgccattccaggaggacccaggtgactcccacagacagtccccatgtgccctcaccctgggctcatccatcagctcccctctggggcctgtcatgtcaggtttattattaccaggctggcctcttgtgggagacactcaccagtcccaactccctgcacagtactgcttagtggctgcctatacccccaaccccctgcatctaccatcagagcccattgctaagagcttcccaagtaagactgagaacttgagagaagagccgtatgttcaaaataaaacattttaaaaaactttaagtcgggggctgggcacagtggtacacccgttagtcccagcactcgggaggcagaggcagttggatctctgtgagtttgagatcagcctggatcacacagtaagctccaggacagccaggactatgtagcaagaccctttcccccacaaaaatctaactaactaactaacaaacaaacaagcctttaaatagtaaaataaaacctctggtaaccccccctacacacacacacacacacacacacacacacacacacacacagaagacaaaagaattcaatgctaagaagagaaaacaaaacaaacaaagccttaaactagactacagtaaacatcttcaaaagactagtcaaacttgtttccactgtttctacatttctcctttagactttaaagcataccatgccacgtaagttactaacaacaacaacaaaaaaagacttgtccattttgctggtgtttttgtttcatttttcttccaaacgttactcctttgcacagggaggactggcatcagggtgccctggtaacctttctaccattatggtttgtttgctcatttttttttcaggtcaaaatgggctcagaaattttaaaagtgggggagaagagggggagcctcttggattcttcgagtgatggatgctgtgacttgagaccctgccagtggcactggggacgtctgaaacatccaccgctcagattctaatcgccccgtttgcaggatgctttatttcttaattcttcatttggatcccaataaccgagaaaggcaattttaaaagatcactttgtcctaacctctcttggatttcaagccagctttctgaatacatggagttcttcagatattattttatatcgaggccattttacatcctgacacagagacaaatgaattatgggaatatctgaggtggaaatctgagccatgtgcactggtaactgcagacccatggtcgttcatgagcacaaaggaagaatctgcagacggaggagaacgtcagagaagattaagtaatccttgttcaataaagagttaaaatttggatagaggacaacttttttcctaccagagagaagagaagagaagagaagagaagagaagagaagagaagagaagagaagagaagagaagagaagagaagagaagagagctgtgacccagattggtgctcctgtgtaggctcttactctgagcctcaggggctgttgaaaaccttccccctgttgttaactgccttcctattaactgtcctatgttgtaaaaatatttaatctcacctaggggcttctaccttgcctttgattattcaattcccaaataaaagacatgcgtgacctttaatttataataagcttttgtcagcactaaagctgggcagatatctaccctctgtgctattggaatctactttccttagctatcacctagctttccagagttatcatttactatgctccatctgggctgctcttgattccaattggccagctttcatggcccatgcttttaagatttttttttaccccacggctttttcttcctcttctggttgagattaaatatttctacaacagtcctcagttcttaggggacttgcaggtaagaagtcgccatattaaaaaacaaaacaaaaacaaaaacaaaaaaatccttgggaggccaggatattatgtcgcatactgaatccaagttatttctcacaagctccagggcccataaggctaaccagactgtggttgcttcccaacctcagaccttaatactaagtcgtgattcctaggacctcttatgtgtcatctaacaaggacatccccgggacagtggagaatctggactttccatggctttaccaactgagccatctgtccatccccgcagtttttaatcttgagaaattcaatgtaattgctatgtcctcatttcttcgaaggtctttgtagaaaaacagtggcatgctgtgtgactcccataaaagcctattctggaaatgtctaaggataaagtgtccactgtttcctgctctctagagactctgttcaaggggggaagatcctggcagagtctcttggtagaggaaacggaacttcagctagggtcagggccaaggtggggtttcccgcaggcagatgttgggatgaacctcctctcagtttatcagatgcagagaactggaggatggtttgagaggatggcagtaggctgaatgctcacatcaggaatcaggagaacttataggagaggctgccttcccctttacaatcatccataacttgaactttcaagaagattgaccaatatgtcaatctgtaggtggccaggcactggagtggtgtgatggtttgtatatgcttgacccagggactggcactacttggaggatgaccctgtttgagtagctgtggccttttggactaggtgtgtcactgtgggtgtgggctttaagacccttatcctagctgcctggaaaccagtactctgctagccaccttcagatgaagatgtagaatctcagctcctcctgcgccatgcctgcctggatgctgccctgctcccaccttgatgataatggactgaacctctgaacctgtaatccagccccaattaaatgttgtcctttataagacttgccttggtcatagtatctgttcacagcagtaaaaccctaagacaggtggtgctgaattcttgaaggaaaccatgaactctgggaaagcaggaatttgtgcagagagctgttgatgggaatgagaaagaggtgaagagatacaaggatctgccccttggccagtgtttctcaatctttccaatgctgcgatccttcactgtagtctcacatgtcgtggtgacccccaaccatatttttgttgctccttcataactgtaactttgctgctgttttgaattggaatgtaagtatctgttatgcaggaaatctggtgtgatcctgtggaagggtcatttgccaccaccacccaaggggtcatgacccacaggttgagaaccactgccctgggtggttgcttcccaggcagggagggcaaaccattcatggttaatgattcacaagctcttgtgcaccgcaggccggacagaagtggtaactgagactggaagttggagaaggaacaaaggcacttgcccacaactcacacacacacacacacacacaccacagcgtgtgaggcacaacccctacagcagagagtcctagaattggaagcgtggttacaagtgtggttctcggggaggtttcttcaacctgaccctgcaaaagccatctgggttccttcccatcaactgaagacaaaacgtcatgcaggcggatacaagcttgttcttcaaagaaatgggctagagaaagaaaatgtaaaacatacacaaacaaacgaatatatcatttcagctttgaaaaactgtgacaggggctggagagagagcttatcggttaagggccctggctgctctagtgaggacccggatttggtgcccagcatctacagggagccttacagtccaattcctccagttccagggactctgacaccctctttgcaggcaccacacacacacatacatagcatacatacatacatgcaggcaaaacgcccatacgcacaaaatagaaataagtcttatttttaatcttaaaaaaataaagacaagaatatttccgagtgtcacactgtctttacaaatgttcctactgctatgaaaactgccatcagtgctcttgtgagcttctcagaatcaggggcaggcctgtcttcctcagacagctctatttccagccctaccctactgcatagcgtttggaaagaactacaccaatggaagaactctccagtgccacagctggaccatctgccatctctaacatcatctaacagtcccacaaacttgtctgttaattaggtgtggactgttggactccccagggctgctgatactgctgaacgtctttccgatgggttctgttatcaacagtggggttctataaaagccaacattcttctgctttacaaatgtgaggtcccaggttacacttttctgttgccatggttactgctggatgggggggcaggggaaactagtaactcaacaactctgtcagttactaaaagctggacatggatggtctgtggagagttatagacacaaactctcaatgtcaatgtagggtctgaagaatggctccatggcctcacaagcgtgaggagctgcgttgggatccctgatacccacgggaaagccagcaaggcagtaggcgcctataaccctagccatgggcagggaatggacaggggcgtcactggataattaatctagacaaattggtagacactctaagtccagtaaagagaccctgtctcaaaagtaagataaaacacaggaagacatttaactgtggcctccataagcatgcctgcacagaaccctggcattgcataccatacacatacatgtcacacacacacacacagcacatatatacacacacaaatctgttgctgtagctgtttctgtgggtcaccacatcattgacggtacgaaatgcgttttatttattactaacaaaagtgataataattctgaagtttcaggactgtgccctaaatctgcgtctctgctagctaagtgtccctcatgcgggcccctgacctgacaaagcgggtatagacaaatgaaccacttgaagttaccctgagggaaagcatagactgctttggcgctcgggattagaaggcccagctgagtgacttgagcagctatggccagaggagctctagttgtctggcctgtgacacaggaaggcccacttcagctaagagtgctgataactatgtgcagtgaggctcttgaaatacaagtatgtggcatatataaaggtgttaggtatgacttagcgggctcacattttaacctcggtattcagagttcatggtaacgccaagaatgagggctggtgtccccaaggccagtgtttacaccgaggcacgggaaccttccatctcaagaaaagtttgagctgtttttttgggggatgctgcagatgctcaggctaagagttctataactcagaagacggctcagaattaagatgaaaaaccttgtaaagtgggctccattttcacatcatcgagagagccttctgtctggtgaggagagaaggctttctccaaagtagcagtgtccttgacattagagaagcccaacaccaatcctggattggggtgcagctcagaggcagagtgtgttctgaggggcaggttttaatctccagctccaaaaacataacgtcttagacaattctgtggaatactacagagccaaacatcaaattatccgtggaatgttcaaagccatagctctgaggtgggatgccaatacacacacacacacacgcacacgcacacgcacatgtacacacacacacacacacacacacacacacacgacctgatttgatctcgaaggaagaagaggaggtgacacaacagaagatgccagattggagggcagttttacatgcaatataatttgcagcatctgcatttcaaaccgttgtgttcttctagattttccaaagatgctaccatgttgacaaacatgtgacgctttttgttccctttacaaagttgttgatcctaaaatgaacacatctgtacccatctgactgactccgtacttcacaataaacttagggcagtggttctctacatgagaaataaatgaatttctcaatgggcaattcccctagttccaaagaaactggtgtagctttcgagggtaattttcaaagaggggaagtcatccctccatctccgtcctggttttatagcaacaccctgcacctagatgtgccaattgatatctagtcctggatggagaggatggtgggtgaccgggaacagcacccaaacaggacacccagagcagggaggggccagcaggaacaactagaaaggaaagtgatgtttacacacagaataataaaatttctcatcctgcacacaccacctttgacatcaaccagagccactgcctatgttcaatatgtcatggtttccactcctagtagtttgtagacatttttactttgaaatggggggggtgggaattaggggggttaggcttggaaagaaccggcgctgccctaaaaggaatgaggaagtgagagcagagcagtctctggctggctttggctgtgtaacaacccatgatgttccttccggccccagtaatattctgagtttccacctgcccgcccccgccacatataacactcagcacacgaggctgagggcccagtgccttgtctctgtgggtggactcctagggtcagagtgtcatgttgtgtctcccgttttccacagttcgccagaggtaaaaagagctctggctgaagaccgttgctggtaagtactgtagattaacaggacaaaacataaactgccttgtgggtcgagggtcttgggtccctgaagtgtcaggggccagtgccactaaaaacagctctattgagaaacatgtgtcagccttagaaggactctgaatggagaatgctaggggctgtgtgtcagctgccagcttgggggcttagggattctgtaaatgttatcttttgtttctgtacactgtatatattgtcctggaggtaaatttctgtcttacttgggtttcatgagagtgcagagcttttaatatagtatgtgcgagcactcagaaaagcaagtcttggttgttgtaatgtgtactcaggctctcctgatgggaacttagtaactcgtaacaaagtttgggagtagtaaaggcgtgtggcttaaagaatttaggattaagtttctcagaggctgttcttaatcataggtgacatttaggaagaaagactgatgttatcttgcttcatggagtcgtaggaatttttatttcatttggatagaataagacacaatgaaaacttggatgagattctcaacgatgcttcttagtgggagcccagttttaggtgaacacttttctatccagtagctttaagctctgggtccttttttgttttgttttgttttgttttttgttttttcaaactgactttgaaatttgaatttgactggactagttattctattttctaactcttttcatttatgatttgttgtacacaggatcaaagcctcgaggtagtggacccccctcttggactgtcagtctccattccaatgaagctgataagcagtctcgatggtgtacgtaagtcctttgcacctactcattcatcttgtccacagacaggggctgaaggaccttcgctgatgttctttttcctctcttttagtcaaaaacacttaatgctaacaacatggagacattaattgaatgtcagtcagaggtaagaaagtaatgttttaaactttttatttgcactgtaattagataaaagacattcttttgttactcatttgggttatttaattattggtgtgagatgaatatcagattataaactaaacacgtctattgagatcttccaaaataatgttgatctgagaagataaaatacagaatcaatgcatttgacttaattttcaagatgaataaaaggccgtatgtgcattttatggagaaagatgggatgtctttgggtgtcactattttaactgaaatgcatgttttcagggtgatatcaaagtgcctcccctgctgacatcatgtgagagtgaagacagcatttgccagctaactggtgagtttgaaaacatactgatctctcctgtgcgcctaactagtgctctgtttgccaaaccacagggcttttactttactgagatttggttttctaagtgttctgagagagcgcagaacattaacccttgactaagacagccagagctgtaggaggggagattctgtccgtggccagtgcccagggacacacggggtttccaagcgggctgccaagtcttagaacttgtaagctttgaggatggaagcgtgcacacattggagaaacacattgccctgcccaccgcttgcttccttctccagtggagaccaaacctaagcgcccgtgaggcaattgttgctgatctacaacatcaaagaatcaggcatcctttcttaccatctttcataacacatttcattacgatatgcatcagatctgaccacccctcccaaagtatcaggatgggcctctcattcttatctctcttcctcttgctggtacaaaataggtaaatggtcgggtacttggtaaagtgccaagccttcgtggcaacctgcttggagaaccaagcttctgaaataaggctgggtctgggtgatagcaggattccctgggtgacatagcgccctctagcggtagtatctacgggactggaggtgaacagccagccctacccagaatcttctaaaagatcttcgaaaggaagcaaaacacttcctctctgtaattttcacattcaaagaaataaattaaaatactatccatcaatcagaaatacattctttgtagtcgttacgaatacgttaaaatgggtggttttgaccagcaccattgaaatttcgctacttttctgtagttaaaagctgtgcgcataaaaacaggaaaggtggggcctttgaggaacactggtgttgatgtttagggactcgctaccctgacaacagtgtagtggtttggggttgatctttctagaccacggttcatgcccttggccttctcgaattttcaacagtaggttgaaaacagaaggttggttttgagggctcttgttttttgttttttggtttttacttttgtttttcaacgcggcaagctataggggagatgatgtagccaacatccatggtctcatttggatcttggcttgttaacatagatttttctctttatctccttgtttccttggctacagaaattaagaagagaaagaaagtgctgtcctggccatctctcatgagaaagctctctccttcatccgacttctctgggtcattggaaccagagctgaaagtgtcgctgtttgaccaacccttgtcgatcatctgtggggagaacgacacacttcccagacccatccaggtaggtgtgtgtggacccataaatctacttcccctttccagtgggacctgaaaagtctgtgagaattctgagcatgatgggcattggccttccaagaaagcccccaccccacccccaccccactgtccaatgcaggagaggagccatctgccggctgtatccatcaatatactctaaatgatgggccctccctcagtcctctgtcttgtggattgtaacttctaaaaattcaccagagagggagcagtgggggtaaactagtgtttctacggaagcatgtgagaggaaagagggggctccaaataattttcaaatgtgcaaagttaatcccttcacaatttacctcctctgagaaaaatgagtaaaaaggcatcattggtagtgctggctttggctagcttcgaagtctctcctcctgtaacaggagcctacaggtagggttccgcgctttaacagcagtggcgggtgtctccaagtgactgttttctatgtcgtgtgtgctcccgcaggacatcctcaccatcctctgccttaaaggtccttcaacggaagggatattcaggaaagctgccagcgagaaagcccgcaaggagctgaaggaggggcttaactgtggggtctccgtgaatctgaagcagctccctgtgcacctcctagctgtggtcttcaaggtgagcctgaggcatttacactagatggcctattgagggcgcactgacaaactcaccaggagacccggacctgacacactgctccctgcaggcaaagccagctggtgggagtttagggtttttttctctgttcaactttcaattattcatacaagcacctctgtttcaatgatcccaggttccgatagacagggtggcatgaaattctctcaaaacattatttgattgccccttggccaaattcattcataaatcccatctccccagatttcacctacctagaaacagcgcatcttactatgctggttacggggggaggggggagaaaggggggcttcttaagtactgtgcgtgtttggaagaggctccttaaaggaagaaaatccagcgatgtgacttgggcgcacttttctctccctccaggacttcctccgagggatacccctgaagctactctcctgtgatctctttgaggactggatgggcgccctggagaagcccaccgaggaggacagaatcgaggccctgaagcagtaagtcctctggcactgcaggaggctagggccccatcttcgatctttcataaaactgtgcaagtacagccgggcatggtggtgcatgcctttaatcccagcactcgggaggcagaggcaggcagatttctgagttcgaggccagcctggtctacaaagagagttccaggacagccaggtctacacagagaaaccctgtctcgaaaaacaaacaaacaaacaaacaaaagatttctgtctcacggaaactgtgaggtccggggaatctgagtggaagtgcccatctgatcccatccagcatggaagccaggaaaggccctgagtatttaaaggaagcagttctacccaaacgagaggaagctcttcttaaagagcagaaagtaagcttcaggactcatagatcccaagacggagggaacctaagcacaggagtagttttaaaaggcaggagagcaactctgaatgccttaccaaaggctagccaacaagatcggagttaaccttaatgtcatcgcctgccaacaactgttctttcataaaacccttatggcaccacagagcaacttgggagaaattgttttattcatacatttccacagcaaactgcattcttatggttaataaaaattttttttgagagagaagatcaaattctaatagctagcaatgaaaaacgaagtgtgacctctgcatttctgagactcccagaggctttctgttaacataccagcaccctaagctcattgatacgcaagaggtgtccccatggccggcggagtatttgccatgaaatattttccagaaaggggatagtttctgccccccccccaacactatgattatcacgcttgcacacaaagtcttttctgaaaataacaccaagaaatgaaaaggacccatgtgttggaatcacttcattttttttcttgaaatatcaaaatgtaaagaatctaactcaagaataatttgttatcactagagcattgtctagttataaacaagcttctatagattagttctctctaaagatttctcagaataatgtgaaaatgggtggtgaccttcatctggaaattagccttgaaaaggtgtgaggaagctggtctcgtagggtctcggaaaggattctgatgcagttatttaatgatataacaaaattgttttcaaaatggaaggcagactgccagttaaacgggctctgattcacacccagcatccctgtgtgtgataaagacaggcgctgttggggccccactacaaccacagggagtccctgaatgagagtttcacaatgtttcttgtgacaatgcaccttccttgcttttaaggaggtctgggtgggtggagcctttcgagactacatgaaaatcatcatccctcaactttatttcagggttgctggtggcctcccccggcccaaccttctcctgctcaggcacttgctctacgtgctccacctcatcagcaagaacgctgaggtcaacaagatggactccagcaacctcgccatctgcatcgggcctaacatgctcactctgaagaacgaccagagcctgtccttccaggcccagaaggacctgaacaataaggtatgtcctgcctcagtaggagaaactcactggtcacaagcccactctctgcaaaagccaagcactgaaatgcttgtggtttgagtgtctcaaatgactcaggggccgcagtggaggtatgaactgcggcgtgtgttgtggttccacgctcatagaaacctgcatttgcagaggcaccaaatgtatgcatactctgttgtcctgggagacagagtaacagacacagcactacccctcccccacacacacacagagctggaaaaaacactttgttctttttcttctgtgtatcacattctgcctgttcagctaaaattctggacaagcacttccttaaatgaaatcacagttacttcaaagcttttttttttattctgaaaagcctcaaaaagtataataataaagtgtatttattattccaatgtgcttttcaggcacatgaaagtagctagtcttaattctgccacttcctgaatagttgaccccgatatgccctcattctttgcttccttttttatgaatgtacttaagctgacaaactgcttattttctttgttttacaggttaagatcttggtggaattcctcatcgacaactgctttgagatatttggggagaacattcggacgcgttcccgcatcacttctgacgactccctggaacacactgacagttcaggtacagaacactctcacttgagtgtggttctggggagaagttcctgccggccataggtgctccatgcagcaatgtgaagcatccctggtattaagagcaggattcaccttcacaagtcagaattctgtaaggaagtcaccaaccacagaggtctcgctattagatatacttacacacacacacacacacacacacaccagacaccagacacaatctggaattttttccttttcattctgagtcatgaatagctcttgattctattaagtaaactccagctatgggttggagtaaggaaatcccagctctgcaaaggaatgtgagtccatcaaaatggacattgagcctatataagagctacctgaaaaaccaatgttacaaattcagatcaatagaccatagagaatattatcattgtcagtttcttttcctcgaatctttcccttccttctccattttatttttcccactttcttaccacttaaagaccattttagacagaagcaaagtttcagtgtaatcagcttcttgttggatcaggccccagtacacttccaccaaagcatcgttggtataaatagggtattcgctaagagagcctggacagaatgctcagctcttccttaactttccccagacgtgtcaactctgcagaatgactcggcctatgacagcaatgacccagatgtggagcccacaagtggcgcagcctctcccaacaggcaactggagggtcccactcccacaatggctggtctggatacccggggccaacgggacacctgtgagtcaagctcagagtccagcgttagcatggtagtcaggctgaaaagctccattgtccaacaagacaggcggttctctgaacccaacatgtcaccctcacgagagtgcctcgtgggcccaacatccaagcaaaagctagcaaggagtgaggacagcttcactctgtcccaggacgcctcctgttctgaaggcgatgaagctgaagatccctttacagaggaagtcttcccagcagtggacagcaaacccaagagacctgtggatttgaaaataaagaattggacccaaggtttagcatctccacagggacacataaccaaagctttctccagatcctccccaggcgaatctttgggcagctcacctgtgccttctccatcctgccccaagagaaacttcttcaccagacaccagagtttcacaacaaagacagacaaaaccaaaccccagagagaaattagaaagcactccatgtcgttttcctttgcgtctcacaagaaagtgctgccccgaacctccagcattgggtctgagaaatccaaagacttttctagagaccaactccagaaggacttgaggaaagagagccaactttctggcagaatcgtccaggaaaatgagtcagaaatccaaagccaaacatctctgggcttcagcttgtctggcacctgggccctctcagtcgacaacacgttccagttagtggatatgaggaaaccaggaagcccaccatcttacgaagaggccatttattaccagacatcaggactcacagcctacggtggccagacagttgggagtatgaggtcaagaatgttcaagccaagcacagcagtgccccctgtgccttctcaccatggaggtgacctcagtgaagggacacctggtggacacagattgtcttctgtgactgagcactggacacacagtcagactgtccatgtctctatagaaactcaggggagatctgagctacaccagttgaggacagtgtccgagtccatgcagaaggctaagctggactgtcttgggccacaacacagccacttagtctttgaggctgaccaactctgctgtgctagagaatcctacatttaagaaagccttgtaccatggctaacttgtgtgtgaagatgcgactgcagagaactgtctgttgagtcacagataagctcattcagaactcagtgtgcggctctcctctgtgaggatggctcacacggtgacaccaaattttgcctgtgtgtaaccgggtttgtgcaatatgtagtaaatgtataaaatgtattattatatgcaaggtattagatgcaaagggtgtctgcgtacatcccttcatgcattcacttctgtatgttgtttttttgtcctcaggcacttgtttctattaagtagaaagagtttttacttttcttaatgttacagcaaatgccatgcctgtgttcacattagccgccagctgcatgtaggtggaaatgtctgagcctctgatgcatcttctcctaagcaggcttgagacgagtcagcatcatagaagggaacagactggaagacactgtacttggtgtgtgacccatcagccgcactgggagaaggtctttcagtcatctaatggaatgtgggtggcgtggtggaaatgcattctgttagtagtaactcacgcagagtactttgagcctctgcagctcagtcatgtcttgtgcagctgtgtagtggtaagcactgttgtatgcattggggagtcttgtataagacttcagtagagtttatttattagtcacaataaactgccctcctcctttagacagtttattacttgctgatgttatatcctttgcctcaaataaaaatccgccaagaacattatccacacactgttccattcagccagtgtctgttcactatacactcattgtgggccaacgcatacctcaggaaggtagtgtccaggagatgtagtctctgttctctggggatttgagccacttttttcagcaagcagtcattcaggggacagggaaaagtataggacacaagataacctggcacatgtaaagcttgcatctgagtgaaacagactttccagtgtctatacacatttcggttctgtgatgtcctttatcattagcaagcataaggagggatgtttgtatattagactcttactactcaatgaccaatatgtttatgtaaatgttttaaagcatagggctccaatcttcctaattatatccatttttataagatacagtgtacactcgtgatttggacatttttataagatatggtgtacactcatgatttgggtgatgtctcactaccaagttaaaaagttcctgattcctgcccagaggtgatttattgagcatttgcttagccaggttgtaaattgggtcgcccatgcatcatggtcaaaagtaacactaataacgctaataagctggtcagtggtggcacacgactttaatcgcagcatttacaaggcagaggcagggagatccctgagttagaggccaacctggtccatagcatgaactccaggtcagccagagctacacagagaaacccatctctagatagatagatagatagatagatagatagatagatagatagatagatagatagatagatagatagatagacagacagacagatagataagtgggggcggcagctaagagcacttgttgcttttgcaaaggacctgggctcagttcccagcacccacatggcagctcacaaccatgtgtaacttcagttccagggaatctgagggcctcttccaccctccaggcatgcctgtggtggacatacatacacactggcaaaacataatacataaagtaaaaggaaatcttgtttatgctctattaagcatcaacaacaaatcaatcttaaagggcaagccaccgccctctgaccggtcagtgagtaagagcaaccctttcttagagctgagttatgactttggtacctaccatgagccaggcatcacactgagtctttcagaattggggaaaaatgatctcccaccatgttcttagtgatacagacagacaaacagatgacagatggatggatacatagatagtgaatggataatagatgatggatagatagatagataatagatgacagagtttgtgcatatatatggatatatggacatatactatatatacatgtatatatatatgaaattatttgagacaggatttctctgttgccaagcagtcccagatgtaaacccttcttgccccagcctgctgagtactgggattagaggccacatcaccacaatggctcttagtgatttgctaatgaaaaccagagcatcacctgcagaggctaaccaagatgacaaactggaaagttttagatgtattcccactttactaatgagttgacctccatgcgacccttcctcaaacccttctcaaacgcctgtatgtttgtttgtttgtttgtttgtttgagacagggtttctccgtgtagttctgaactcactgtgtagggcagacggaccttgagctcagagatccccagcttcccaggtgctggggttaaagacatgcactatcatgcctggctagctgcctatattttaaaaagcaacagtgagagactggaagccccagtatagtttatgtcagatatccacagcttctcatggtaaagtctcgctgatgtctttctttgatcagtaaagagaagttgtggtgaccatttcaaatatcgcatggtgtgggactcacttgtttctatgtggcccactgatgcttccaatttggacttcttaactctgtttccatgtatgtctgtttgtgaggcagccacaaccactgtagctggaagggagcactgaacagcagcaatgccttgtccatggctctggagactggaagtcggacaccgggtgttagcaagtacttgggaggcagaggcaggtgaatttctgagttcgaggccagcctggtctacagagtgagttcctggacagccagagctatatagagaaaccctgtcttgaaaaaccaaaaaaaaagaaaaaaaaatttttttttcctcctataaagaggggatgggcaggagggtgacacacaatgtactgtaattattttcaaaagcacacactgtccctgaccctaggacttaaataaattgaagctgacctagatatgttggcttagggaaatttaccaaaattgggaatgtttgctagaggcaagaacaattgcttaaagcttaagcccagtaagagcatggcacgatggcaagtcctgcagtagttggggtcagcagctaggtctggcaacattaatgtaccaagcaatggctgatggccacagtgcttggaaacgctgggcatgggaatgtctaatactgcttatattaatgcacacttcaaagaataactagggggctggagagatggctcagtggttaagagcactgactgctcttccagagatcctgagttcaaatcccagcaaccccgtggtggctcacaaccacctataaagagatatgataccctcttctggtgtgtctaaagacagctacagtgtacttatatataattacataattcttttaaaaatgtaaaaaaaaattagataaacgcctggttataatcttgttgggagagctgccagtgcgtgctttcctcctatccaccacgcatgaagccacattggataggatctcaggtagctgaaggttcttcattaattgaattctgtggttttaactcctcttctgcaaaaggagcaagagtgaggaggccagcgtgtacacagctcgctagagaagacagtgaatcactcagcaatatcttgagtataggctgagacactgtactttctctgctacagaatacaggcttgatatggggaccagagagatggctcagcgtgtagagatacttattgcacaagcatgagaacccaagatcagacctagcgctcccattaaaaggtgggtgtggctatgtgtgcctgtgaccccagatctatggaaagcactgagaggaggtctgctggggctttctagctactataagggattgcttgggtttgctttctgggtttgtgttactcactacaatgcaataaactcatgtaaagaccacatctcatatatctccaatctcaaatcaagaagaattgaagacagggaaaatgacaggaaagggccatgcttaaggaaacagggggatggaggcttagagagactccaacccacaggagggaacagaggcaaggctcagctcatagtgctgacagtcaaactgtgggaagcacagacactttgtagacagtctaagaggaatggctgtctgaggaaataaaacaccgcaacagtgtctcacagtgcatagaagatttaatgtagcatgtgaaatagaaaattcagagttctagaataaataggaataagcttcttccataacctcagaataaaacaggcctttacaacatgatttaaaaatctaaagacacaggacataagttaaaacctaaaaatcaacagtattggtaaaacacagtaaaccaaataaaaatgaatgaagccctcttttagccatttaagatttctctcagtaattttctgtggttttccatgtccagaaatatttattatcaaattcattcacaaatttctttcatctccaggagtgacacgacattttagaagttttctctctcctgtgggtatgagtagtctgacatcaatccccataaatcacacttgaaaccattttagaaatgatctgtctaagattccaggtaatagaaggaatctctacacgcaagccatcgcctgtgatgatccttaggcaagaacagttggatttagttatagcagcacagacgtttgagaggggatctctctagagtaagatgcacaattttacaatttacaggggtgtttttgctactacagtctgctataatttttgttgactagacaaatgatcccaatctttaaaagtcccaaaggaacagatttcagctgtataaacctcagggggctgaggcctgaggctgaggaagtttactgtctgttaaagatttcggcacccaagtcttaggaagaacacaattcgagtgccataccatattatttccaaccacaatgaaaatcccataacattgcgcttcagtactcagatcaaaccaacctgcatcagtgaaacgatcaggagccagcctatcccctaacagtacaggccctcctgtgcctgtttcccaagagaaggggcaatgtgctgggctggattctgattctatgctccttctgtagtaagtctgttctgttttacaaatctgaaatgtttttaaaaccacaaaataatccaatcaagaaagcagatattaagacaaagaaactcatggctttaaattaaaattttgcaaatctaaaagtacttttaattcctccagcccacacatcctgtgtttttaaaaccacggcgcatagtttaggggaagatgaaaactggtgaatgaaatcacagaatcagacgctttagcataacctaccaatttaaaaatatctatatatgcactcaggtctcagatcctttggcaaaaataactctcattttcaagaatagaaagtgttagggggttttatatcttcttacaagaaatttccatccactgaatgtgaattttacctttcactcaaatacacaacatgttttgatactgaaaacttcccaagaagacgggcgcgactctgcacactctgagtcatggttttactctgactggtgagcgcgtgctccccctggctcttactcaagagaatcaccacagcccttagatcaaaaggaaatgatcagagcatcctgtctggctctcagtcctgtaggaaattgaaaagcaggtctatcgttctgagtatcaccaccagattcaaggaacctctggcacaccacggtcagcctgagagccaggctcctgtgggccagaaccaagttcaaaggacccgatgtttacatgattctggagtttttctataggaaaaagaaacgcttgcaaatacaaattaaatcacaaacgcagatgcttatccaggatgaaaagcacattatgaattataaactgaagaagactagaaaaattcacaaaaatttccacttaaatagaatacatttttatcaacttcccaatacatttctctgtgtgttaactaaagactatttaagtactttcttcctaagaagaaatatataagatacaccttttaatatatatgtatatacatgtatatatcaatatatcatatattaaaatatatacatgtatctattatattctttaatgtttcctgtagaagaggacagaagttttctttgagtgtggttagtactgggatgcctttcaacatttcaagtttagagggatttactggctttagcttttgaagttgatagtagcatggagatgtttaagatcatcagtgtggaaaaatctgtcacatattttcatacacgagcttgaaaatgtaggaagctttccacagaccacattctcttgcttgtctgcctgtcatgtctttggccctctctaaacaccaactttctctctactccaatctttctgtggaactggtcattcacagctataacctaccaacatgacagtggccatcaatttcagaagtagcatatccagaacagaactctgggcatctcatccctctgacagcaagcatctcagtgaactgtgtgtacgtttttatttcgcttgagttggaagcatggcgaccttcctgtgtctgtctagtccttgcccccatatacaatgctttactaagtgttccagtttcattctgctgcagtgacaaatacaactcatgaccaaaagcaactcagggaaggaaaggatttatttcatcttataggttgatccattgttgagggaagtcagagcaggaaaacaagcaggaacgtaaagcagaaaccatagaggaatgctgcttgctggcttggttatagacccatgcttagagatacagcccaggaccccctgccgagggaatggtgcttccagcagtggactgggctctatacattaatgaatgcaaccgagacaatccatccccctacagacatgcccacaagtcaatgcaatctgggcaatcctttaactgatcccttcctgatgactctagatgtgtcctctcaagagttaaagctaaaacactatgttatcttaaatttccaaaatatcccaaatgcacctcttctattttctctgctactgttctagctccaggctagaagtatctgactgctcaccacctcagacactctcagagctcaatcccaactcctcccccttggaactcctaattctggccaccttcagctcctcaatataacaagcttgcttccaaacagtgacttggccatcaccgtctgcctggcctgctcacccagcacacactatgtgctgagtcttttctgcgtcacaccagtctctgttgaatattatttccttgggctttttctgccttttaatccaaggcagccccttgggatgaccttctgtagcgtgtcatgttttcatctaagcactttggcttcactttcttccttttctggttcacttatctaaccctcgatagtaggaagaaagttccatgtttccccagagctcatgggtttacctggttccagggagctgcttagtgtttgctgaacagtgaacctcccaagcaagctctcttgtcttctgttctctgtacgtggaaacatttggaagctgcactcagttgctcaaactactcacaccaaagagagaagagatgctccttcatttcctgggtaaaatgcacaccgctgaggctgactcagtcagcaaactcaatctacttggcaagggtgcagacaccagtaggacctaatccctcagtaagcacatggcctcactgtggaaacaatgcatccatgagccctactcaatgccttgtgctgaggaaaagacgcaaatgtgactgaaatctagaagagcatgaaccagaagatcagaagtcccttcatggagaaaactatggaagaagctgagatctgaaatgtcaacagaaaataacctgggagaaggaccgaggaggaagcactgagcagcatggaagggagatgctgcccaagtctgccaggcagtgctacagcacctgtggtcagaaggcaggcaggaagctaacagtgctgtctggggtacagtgtaagggccctgaacctgtgagcaatgtggtatcggaggagggaacaggcatggtcagagccccatctcaggcgtgacgttctgtggttccataaggcagaaaggagcaagacaatcaagcaaaggctggaaagatgcaaaaacagaagacccaggtgtggtggcatacacctgtaggcccggcacctgggaggctgaggcagaaggattgtgagtttgaggccagctacatagggacactttatctctaaaagtagaacatattaaaaagaataaagaactattgaggaagtaaaaaaaaaaaggagtctggactgtgtggttatcgaaatatggggaatgagaagcaggaaagggagactgcaaaggaagtaagaaccaggaggtcccaggactgagaccatgagcaccaggagctgacactgtgcaggggtgggatcaaacagacgagcattcaatcctacctgtcactgccctacttatgaccttgctaaggtcctttcagatttcagttttgcctgacaaatgggaatgttagaattgatatcattacaactaaatgaaattacatatgtaaagtatggagcatagtgtctgctgtgttaaaatccccattacggagactggctggtatatccagggtttaaaggactagaatcctaggcaggggagaaacacgggaagtagtacagaacttcctgttgctttccctcttcaaaacattttgttaacttctgtgcaggacatttaagtcaagcacaaagctttgacctggagcctttctaatgtaggaagagaaaaactggagttgagaaccgcaaccaggattgaaagggataggggctgtaatgaggacagcctgataatttgcttggcttttaattagttacctgctgaattctacgatgaaatgaaaagaaaattacatacacagttcaagttcatccaaagatggaacaacaatgaaaaagacaataaaatgcacacgcgaaatgtctaaatccttaaggccatcttctcttactcttaactgccagctacagtaaggtcaaattcttaaactgggaaagtacatttgtcgattgagcactggcctggctagcatgagtgaggacctgagggtgagcctcatattaacttaatcctctctggacaaaatcagccaagacatttgggcaagtttttctgcacattgtgcaacatttacccatagcccttaagaatcatgtttggcttctttccttcttgtatgaccatgtccggtccatttgtttcagccttcaggacagcgcaggcatctccccagattatctgccccctgaatgctagtttctgtccccctcttggccaggaaaactgggtaacagtctccttgcctctgccacagagtagttgattctcaatgaagaaaccggagtcgggagggtcctttttaaacaaactgccaaacttctactcaaacctcatagtggtctttaaccctcgagtaaatgcccaagccttcccactgacttttggaactgacaacgtggttagtgatgtcattttccctttgtcctcaaggctctgcccactctatgtcttcgtcctcaaggctccacccactctatgtcttcgaacatgactgatgttgagagctctgttcctgctgcttccttgatatggaatgttctgccagtctgaagtttcattacttcaccgccttctcatctttgctgggaggagagcatccttcttcagccttctctaatgagcctaaaatccctccgtccctatacccaacctttcatgctgcactttttttctcttggttcttataacagctaaattttgctcccttgccttgttttttacgattcatctatcaaaatataaattccacacaggcaaaagtgttaaattacaaaaaaaaaaaaaaagacaaacaaaacttctaaacctttagtttccaatgactgactagtgcttgtcatatagcaaatactcaaaatcctttgggccaaatcatcgaatttcagacaactggatgcaagacaatcatgccaaacacagatatctgggattgtcacctgagagagactctccacaaaagattttattatcacaaatatataagtgctactataaccaaagaagtaaatgagattgccctgggagtcaaataaagagaaccagactgtgggtagaaacctacagaacgtttagtagctatcacattattaataaaccccagttatggcttggatggcacagttagctacccactcagtacccactcttccctagttaaataactcatttgctccccctttctcctggacaacagggtactcaaagcccagattttatctctgaacttaagtgagagaacactttattgctttagctgtttggaactggtttcctgttccaagggggcaaaaacattctgataaactgttcaacatttctacaaacctatgtcaacttttctttagtatttctgcaagtcgtcaacacacaccctcctggatttctacatctcagacttatgaacctctgatcacacccacttgttagtgtgtgcgtctgaattttgtctctgctactccgtgtgggttctggtgcaaactcggatcgacaagcttgcttttagcctctaagaaatggccccatccacgacattcaagaggtaccttttccccagatgctaacctcgacattatattcacttcaatgtcactttctcaaaagattcctcaaaatcagtcagactgaaagtcttcagcagtgtctgtctatagcatttaccacacactttttagtatacttatagaatggtgactgtctgctttaaacggtaaacttgcaggtacagttctaagtactgaagcttcgattaacactttaaatccttacaaaccctaagggataaattctacttctgtagactggaaaaacaaagcatataagcacagaaattataaccattcgcccacgtgttgctgggctagtacactgcagaagagcgattaaagccaaggtaggacttagctgcactgaaggtgttaactgcaaacccacataatcacaagggatgcatacactttacacattaaaaaaaaattaacctctttaaagttttaaaattaaatcctaaaacgcgttgctcttggtcgcctgcaggatgaaagcataaaggaaacctgcttgatcaacaacctacccagccctttccaaacgttacaagtccaaaggatggcccaatgagagcccaaggtgagtggagaaggcaggcgtggcaatccacgccagttagcggaggaggaaacgggaaacaggagacagcccgccccgcccgcctgtgccccagcgcgtaacagagcggggagccaggctgccaagggcgtgtcaccgcccggggagcctggagcgcggcggcgtggcaggagaagaaacgaccgggggaggcccttgaaagatcaggagcacatgggcctgctgggatggcgctgacagcagcccccgcgccgggccaaacggcgttaccttcgccccaatggccgccaccaacatttgggcggccctgcctgccaagaagcggccactgcaccagcgcgcccgacgaccagcaggtgggcggggccgcgagccggaagtgccctttactacagacccttccggaaacccagctggccggaactgcctggagttcctgcctccaggcggaacctcgggttgctcggcaaccgatgggggcgcaactgtccccctcgcgctccgcccgtttctccgagagcggcgtcctctcgggtcgcagcatccctgcccttggcactacttacaagtctccgactacgacgactccttagccccaacctgcttcagagcccaccttcaccggaggggaagcagttcgacgctcaaccaggcttcggcgatgacagaccctaaccctcggacagccgaggcctcaggcctctacacctattccagcaggccccgggccgtggcttgccagcgccgccgccaccgagacagcattttgcagccgtgagtgaccaaagtagctcctgtctggtctccgtttttgcatcccttc

SEQ ID NO: 417 - DNA, 253912 bp, Mus musculus
aggcatagaagattgctttattagaaaatctcacaatggatacagcacacttgtccatacctattttccccaaagctaccttcagaatagcttgcatgggtgagggatgggtgggcccctgtcatggtgggtaaggttggagggcggatgatacacacttgagcctaactacacagtcacaggcatgttttcaggtcttcaactcccatgaaagcagtgattgttcttactgaccagttagtctgcatatcttcagctcccaggatactcacactatttaagccagagcagggcacctgaacagagaagaaaagcaagggtcaggggaacttaaacatggagtccttcatgcttggctccagttagacattgattcagaaaacttttccatttgtcatagcatgctggcttaaaaaaagaacagaaacggctagtgctctgacgttgtaatgaagaatttaagaactatcagaatgatgattgaaggactgatttagcctgttaagggtcctgtactggctagttttgtgtcaacttgacacagctggggttatcacagagaaaggagcttcagttgaggaaatgcctccatgagatccaactgtaaggcattttctcagttagtgatcaagggggaaaggccccttgtggctgggaccatctctgggctggtaatcttggttctataagagagcaggctgagcaagccaggggaggcaagccagtaaagaacatccctccatggcctctgcatcagctcctgctttctgacctgcttgagttccagtcctgacttccttggtgatgaacagcagtatggaagtgtaagccgaatagaccctttcctccccaacttgcttcttggtcatgatgtttgtgcaggaatagaaaccctgactaagacaaattggtaccagcagagtggggtattcctgtgacaacctgaccatgttttggggaggtctgtggaaggactttggaactttggtcttgaagatccattcgttgttaagagctctgtcagatgttttgtaggagcctggaagataatgttgagaacagtgcagaagatggagggctggcttgtgaaatttcagagggaaaattaaagactcttttcagggccattgctgttttgattgtgaagattctgtagttctggttagctggggctgaagaatcagctgtgattaacaagataccagaactactaaagcaaaaactttgcattactgggactattgatgctggttagctggagctaagaaattagcggtgattaagaagagaccagcatcattgaggtgacatcttctgggaagtgttttctgagagcacagtggctgtgttccagatatagccaaagttgtaccttgtgctgtggctggacttggtaatgtgtaagggtcacccaggtggtactggttttgaaggcatgaaggagttgagcagagcagctgaggcttggcactgtgagaggccatggaaggccattggtgaaagtccagcctcagttgcaattgatggcccaggactgaaggggtcatgcagtgttttggagatgccagtaccatgagatgaccaccaagagcagcagcagcagtggagtacaggcatctggagcctagaggatgacgcgtgtgctacaaacggcatggctggagaagtgacccaagcccttggaggagcccagaagatcgtaagttggatcccagacattggacggttggagattgacttttgcttttgattgtggctgtgccctgatattttccctcttgaaggaagaaactgttttagtggagcccacagttaagagacttttaattgtaaaaagactttggattttaaaagagatggatattttaaagaaattgaaattttaagaatatgtaaagactgggacttctaaagttatttagatcttggggatgaataagaatgtaagggttgaggcttactagtgatgtgtttgtgtgtcaagttgacaaggggtcaattgtactggctagttttgtgtcaacttgacacagctggggttatcacagagaaaggagcttcagttgaagaaatgcctccatgagatccaactgtaaggcattttctcagttagtgatcaagggggaaaggccccttgtggctgggaccatctctgggctggtaatcttggttctataagagagcaggctgagcaagccaggggaggcaagccagtaaagaacatccctccatggcctctgcatcggctcctgctttctgacctgcttgagttccagtcctgacttccttggtgatgaacagcagtatggaagtgtaagccgaatagaccctttcctccccaacttgcttcttggtcatgatgtttgtgcaggaatagaaaccctgactaagacaggtcctgaattcaaggctctgcaattagttgctttcagcacagagcaaagtttgctcagatccccgtggtgctagtggtgctctccattgaactaactcaaacttaacacattccaagtttagatgagtgacaataataagcctgcttgagcccccagcaactggggttatctttactctcaggggaagcttttgcaggagaacactgacaagaacgcccctctgtgagacgcagtgagtcttggggtctcaaaggaaagagaatttcacctgtggacttcatctccacgatagtggactttatatatgcattctttcatccacagcaccaagaaaactgactttatccagctctctaaagagaagctaatcttgccctgttatgctagggttaagtgatctttctccacaatggcctgcacatgtttccatatcgtgttttactccttcacacacacatgcactcaggcttcatcatgttgatgataccaagttcttttattatttgcaaagttagttaaatttcataaaaagtattacctcacgtgaagcatttaaaaacttgggcctttagctgatggcgcttccaagctcctggctgtgagaagacccactttcttcatcagtttttcatgtgaccctaccatcttcaagctagcattggtgaactgaattcttcttgttttaaaccagctactgatgtgttctgaatctccctgttttattaacatctatattttctaacttattagcatatattcattgttcaataggatagttttataactacattctcattcatgtgaatacctctgatatttcagatctttctcagtttgtccactgctcacattcaaggaaaatactgtagttttaaagaattcacatgataggttccatgtacctgaacctcccagtcatcataaaatcatagaaatcactgtaggggcaatgtactctgaaagtcaacttcaaattctgtcaaccacagtcataactatgatactatcaaccaaatatgtctaaattatctcacccttttgactacaacccatgtatggttttctgcaaaaaaaacaaaaatttagactatttttaagtgtttcctgtggtcctgaagcaattagagaactctagattgaagtagagtccctctgtggtcttgacttcagaggaagggcatgctaaccaaatgagccagtaatgagagaggagcctctcatttcagaggcagaatggggtgccagggactgcattaaggtaattcattgcccgctaaagcaaggtcataaccaccgtttgagttggaaactcggccatctacagttaacacacgatgcctgttgattccgaaaagtcgaaaggttatcaggtgaccttgattaaagcgcttccttcattgccaggacatccagtttcagctatttctatgcgtttcctacagactgttactgaagtgttgtgtccataatagctgtaatgctatggatatgctctacaatatacagtttctcacaacaaacagcaaatggaccctaggtaatttgtttgggatcttgcataatattgtttaaaaaaggaagagaaggagatggaagaaattagccccaagtgtttatacatcagccttaacgaaaacaaggatggacaaggaagctgaggaagaaaaagaagatacattttaagctattgctaccagtctggaaaggtcaatgtcatcgggggagtagtcctttgaacaaagctagcctgtgccctcatttagtcctctcctaaaaacaaagcctgattttaaagagatgaaagatgcaacatccttatctgaccactacaccttgtatacatcttgtatgtactgaactactataccctgtcaacatttacattgattatgtgcttttgaaattaaggagatagaaatgtgagctaccttgatttgatcattatacattgcaaacatgtatcaaattatcacacttcattctataaaggtatacatttaaaataataattggggctgggtaaagtgtatgctgtgcatgcatgaggacctggatccccaacacctatgtaaataacccaacaatatatcacatacttgtaatcttaggaattaatgggggtaggggcggtcagagacaggcagggattctaaggcctccaggcagtctaagcaatagttaacttggggttcagtctgaaacttgacacctagtagagacctctggtctctgcacacacacacacacacacaccagaaatgcatgcacattagatttaaataaatttaaaatgaaataattaattttaaaaattcactaagcattttaatagtgaaaattgacaggaaaatgttttaaagtctttaaagcaatattagggctgaatataatttgtactgccataaaaactatgatgcaaactgtagttactaaattctatgccccaaatattcttttgagtgttttaatattttaaatgttaaaaggtatccaatgcatgctatgtcaggtatctttggaagtcagattgtaacctgttcttgttttcttccttaagcttcctcagtaattttaaaattttattcctttgtgatcaagtttgaaagaaataccaatatcttaagagcaaaaggaaatgtatgaagcttaaattgcaagctggagcttccattgggacatagctgagtctactgcagagagcatgtcacttccttccttcctgcaccattcacaaactgacatgagttctcccagtggagatgacacagtggaagggccagcttaccccagccccaagtcctgcaccagcggattgtcagttgaagcagctgaggatccgaaagtcaaggaacaaagcaggctctgtgttctactcacaagtcttgtcattgctgatgtgcaacaaggcttaaaaggccactcccctctgtcttcctccgctccattgacaggaaggcatcttcagcaaagcattatcttttaaaggggaaagggcaagattcattagccccaatatttcagattagattttagattccctacccagagtagaagttcttccacagaatctgccctgttgggtgagaactcaaggttggaagccacagcccaggaatgagaaacagcaaagacagaggcatccttagcatccagcagctcctacacgctcctttggccacttgacccctcttaaacttttctggttttgtctgaaactcttagacagcgtgtctttgaagcaagtgggtccccgactcacttgccaattcttctgtatttccacccaattgggaaacaagttctaatgtagtctgcctgtgagctgggaacctgcaaacagagctccccgtggagggcctgactgcctgctccctgctctcggctcaccttctggactctgctgttgtgctctaagagccacttggcagaatacaatgtgttctcatggccctgcgaccttgtagctctgtctcctcttcctctcagccctcaagggatttaccttaaattctcatgtcgttgtacttgtgaattgcctttcaaaatggacaggaggtagctcagggcccagctgtgtgattttcttctctaagaacaaccaggtttcattttaaactctgtgtccatgtgatctcgtctatagatgataactatcaaggaaaaggattctctgtgtgcctctgcatacatttcttgtcctatattttggctttgtgttttctgcttgttttgtcctattcaggtttatctggttttatttgatcttactttattattttcttccttcctttgttcctttcttccttcgctctttcttaagtgcatgctttataaggaggagggggcacttgggtcagaatatattgcatgaaaaaaatctattttcaataaaattaaataaaaataacattgctcctctgatgagatggaaggtaaggcagaaactctaggattgcctagaggtcagtgtgcctgaggaatgcagtataagggaatcaactcctaacagctgcctgctgacctccacaggcacactgtggcatgagtgcatgtatgtgtgtgcacttgcacatgcatatgcatataataataataataatgatgatgatgatgatgatgatgaatatatttaagtgaagccatttagttatactttaatgtagacagtgtattttttaatttattttttaattccatattttacccccccatccactctccaactgttccacatcccatacctcctccccacccccctgtctccacatggatgtccccacccccaactccacctgacctctaaactccctggggcctccagtctcttgaggattaggtgcatcatctctgaatgaacacagacccagaagtcttttactgtatgtgtgttgggggcctcatatcagctggtgtatgttgcctgtttggtggtccagtgtttgagagatctcaggggtccagattagttgagactgctggccctgctacaggatcgcccttctcctcagcttctttcagccttccctaattcaacaacaggggtcagctgcttctgtccattggttgggtgcaaatatctgcatctgacgctttcagctgcttgttaaggctgttggagggtagttatgctaggtccctttttgtgggcactccatagcctcagtaatagtgtcagcccttggggctccccttgagctggatcccactttggacctgccgctgaaccttcttttcctcaggctcccctcaatttccatccctttaattctttcagacaggaacaattatgggtcagagctgtgactgtggaatggcaatcccatccctcacttgatgttctgtcttcctgttggaggtaggttctttaagttctctctccctactgtatggcatttcatctaagatcccttcctttgagtcctgagagtctctcacctccctgatctctggtacattctggagggttcctccaacctcctacctccaaggttgcctgtttccattctttctgctggccctcagggcttcagtccttttccctcacccaataccaaactaaacaccattagtgggtgggtcaatgacattgtttcccattcttccggatctctgagtgagactcactggaaggtagttacatcggtcacttctgcagttccttctgtcctgtagcctctgtggcctcccactgtctactgtccctgtcttaaggacggaaagggcaagcaacctcctgatgttgtgttgaaaaagtgttgactcctgggctccctaaaagtcttagccccagatctccagggaacttgaaaacgcctgcccagtgttttcgtttcgtcttaaagttcaagtgtacacatagatcttttcttccttgaagaacagatggagtctctagttactataaagttcttgtaacttccaataatgtttttgccaaaacagtactcatacttatagtcaaatcattctgtatagaaagagaaatgaggatagaagagaaaggaaaagtggccatgagactctacctgaggtttctgcagccttaggtcctttagagagggagagtaggagagagaggcagctggctgactgacagtggtgaagagcctgaggaggaaccacagagaccacagttgagagcccaggtgctgacctctatcagcagcacttggcagcattctttgagaactattccttggcaggggctctctaaagcccaggagctacatcagaaaacccaatgaagaggtcccagtcttaaggagctgggatacagacccaaatgcagccacaagctctatcacttcacagcgggttgcttggactaaattatttcatttccaagtgtttcaattcttcttctgaaatttttgaataagctttggaagagttttggtaataattaagtgccagagtgtctgtaccatgcctatgtctagtgaatggcatccttgctggtaatccctgttccaaagtggaccccctctgaagagagacatctacacaccacgttcagtcattcacatgataccacctgagtaattgcacttgatgcctgatcggggattgcacaggactcgtgagggctatagtactgtcctataaagaaccagacaccctgctctttctgttccccacaaagtaactagatattatttacactgttgaacagtattgaaaaataaaacaatacaaaaactttattttttaaatataacatacatacagtattttttgtctttttattagatattttctttatttacatttcaaatatcccttctcatagtttcccctccaaaaaccccctaccccccccccgacccgctccccctgctcaccaacccaccctttcctgcttcctggttctggcattcccctacagtggggcatagagcctacacaggaccaagggcctttcctcccattgatgatcaacaaggccatcctctgctacatatgtagctagagccatgagtccccccccatgtgtactctttggttggtggtttagtccctgggagctctggggcttctggttggttcatataaaagtatacatggagtgcctcaagcagacccccaggaatcagccctcagaattctgctaagagtatgaggctattttataaagacactttacagcttggccacctacagtgtgaacttctcatgtgtctggggtgacacagtttccacccacaccctctgactgcattggtgtgagccttctgagaaacagtaaccctactttctaaacaggatttccaggctagaaatgaatctttgataggtctatttcattgcctttggtatcgtcttttggcagcttctctgtcattagtactgtattaggggattggtaggaaaaggagaagagaaaaaagaacagacataagctaattgtgcaaagagccaccagtctgctgaacacatttggaatcggagaacattcaacaagagtgagggttaggaattactggtgtgggttttatttcctcagactagcctactgctccttagaaggaaatagtcagaatccactaaacagggcataactcttctagaagtcatgtgggtttaaaaagagattcgactccatcgctgccctccctgattgggttgactgctcaggtaacacatatggcttctgagtattttgagaggatactcatcagcccaaaagatgatccctggaactgatacccactactggcaagcagagtgacaggaacccccagaggactgtgcttgcagagaacctccagcgcctgtggctaactgttgccctagtttgatcttaaagtcatcatctgggataatactttcaaatctgttcccctgcttaagaggcaccaggcatgtgaacgagttctctcccaagatcctttacatcagctggtcagagccagcttttagcaaacatagacatcacatcaaaccttccaacagatgtgcctttcacagaagttggagcagaaccaacactatggagaaagtgtaacgaggaaacagccaagcattcccggtggataggcagagcactctcacagaaaacctgctctagggtagaaagtgagttttacagagtgtttgaaccacctttcccaagtcctttcctacccaggaggccccactgccagataggaggttcagagcactgtgtactcaacgaacttgcttcacaagtcttaataaaacattttagtaatcagtgtaaggtttagaagtggggagtcagcatccagcccctacctaactcctttctggtgtgatggtgtagaagtttctgattagtgttccgatttcccctcttcctggcatgggtgccttgcaggaacactaatatgtgtgttgtgccaagcactaagagcattccatatgcattccaggccaccaagaggttcagggtcactgagtcagacaatgaattggaacagttgatgacttttgcagggtctgggtgaacaaaggaagcccaggagatgcataaaggttggaggctggctttctttttttaactgtttagcacgccttgctttgatggctctgaagacaaagagtcacaggccctccaatatgctgaaataaagctagtgagcttagcgttgtgaatctcagtgggataggggatttgcttaggacttatttataaggcatcaagccaaaaactcaagtttactggcagaatatttttcttgattctcttgtgagtaaggacagggaactgataccagaaaataaagccaccagtccaacgttgcctgcttttaaattaatgtgtgtgtttgtgtgtatgtgtgtggtgtgtaagtatgcatatggtatattcataagatatatgtatatggtatatgtgtatgtgggtgtgttatgcatgtatatggaagtgtatgctgtgtgtgtatatatgtatatgtgtgtggtatgtatatatgtatatgatttatgtatggtgtatgtgtatatatattatatatacacatgtatgtatatatggggtatatgggtttgtgtgtgtatgtgtgtgtgtgtgtgtatgtgcagttacacactcatgtgtgcagaaatgtatataaatgagtggacattcttgtggtggccacactatggccatcaggtgtttccctcagttgctcaccacatttccagtatgtggtatccttttttttttagaaaagtatcttcacagaaactggaatttattgtttggcctagaatggctgtctagtgatctctgtggattccttatttttacagtcctgtattggattcacatgtagtaatgctaggctttttacataggtgttgggcgtacaaattcaggtcctcgtgctggcacagcaagcacttatccatcaagctacttttcagtcccttgctctaatttttattctggccatggcctagaattcattggagtcagagcccagccataatgactccttgttcttggacttccagccccaagaaccatgagaaaataaatgtctatagtttaatgcacagagccgtgtggaatattgctatagaaactcaagcagattaatgcactatataatctacagaccctggtgtacaagattcagcaaggtcactgcagcatgtagtcagccaagttgattatccttgggattggattgctaaatccaatggatacctttaatgactgtgctacactttcccatggatatgccatagcctattatacaaagaggttcagaaaaagaagatgaagcaagctccagaggtgccatagtcaagtactttgacatgtgcatgaactcagtggctgaagcaaaataccacctgctgctggcccatcatgctagtcctgcctactccttccccataggacagccacagatatttccatagcaggtgcgtggcttccctgtacagttttcacagacatctctctgcaatgttctcagtgagtcactgtttctgctccaagtaacaactgcccagagagcagaactcagaaaagaggacagactgatgataccagttggtttcaactggggtgctaaaatgtatgctacatggagagtggagaaatagaaaacttaccaaatactggagatatcatgtcttccatccaacccattcatatgtgctgaacttgtccttttggtttgcatgtatagttcttgaatcatagactcagaaaaaaatatgtttatcttcaatacgtgttttgttaggaagagcctttgaagaacaagtcttgtaagaatggactgattatgactggtttggagatttggctcgctcgtagggtacccttcaaagctacgccatgattgtgatgatggtttggagacttggctaactcacagggcacccttcaaagctgtgctatcctgtagttctcctcttgaattttatatttgatgacagccattgtctggttcactgtcatgcttctggcatgtgtcactgatggcccctttctgaaggttgtctaccagggctctgtgctcccaccggccatcttccacatgattttattggaaaacatctacactagtctagagcctagattgaaaatagctagttatgcagtaaacatgcactttcccaaaaaattcaagttaaaatatttcaaattagataaatcttcagagccctgtcattaaagggagtgacactctcttgcttacctttctaaatctttaacggaaagaatttgattacggattcgctgaatatagaactctcggattgagaaaatctttccttcctgttctgacatgagttactccccgctcgtgagtcgtacacactccttcttcctagtcttcaaccttatgtttctctcagggccatcacacgctcattctgaattctgacaacagttctcactgctgatacatttttacttttattttgtgtattttattttgtttttctaggaattggtgcatgtgtgtgtgtgtgtgtgtgtgtgtgtgtgtgtgtgtgtgtgtgtgtgtgtgtctgtgtgtgtgtgtgtgtgtgtgtgtgttatgattttcaatgttagaaatctgtgatagaatgaattagaaaatagatatcattctactcctttagtacagatagtctaaaaggtactaatggagtctttctcttcttctactttggaccctttccaagatcctcccatctccccaaatcagcatgtacaattcctaaactacgcatgtccacccttccttaatcactttctttgacttgggccacccaggaaatgaaaatggagttagtgctacattgggactcagtaagaccaaccactccagtgcttacaggggctgcgatgtgggtgaggctgaggtggtagactggttaccctttgccatctttacagaagctagagtcatccaggaaatgagaacctcaactgaggaattgcctccatcagattgccctgtgagcatgcctgtgggacattttctagaggaactgagttgagagggccctgtccactttggagagcactactaccctctgagcagatggccctgggttgtataaaaaatgaacctgagccagctaatatgcagagttcctccatgttcctgcctctgtacctgctcaggttgctgccttgtttccctcaagtgagtgatcagggtttataagccaaaaccctctctcttccccaagttagtaacaaactagaataggtagactaagtcaaggttaagagtgggcagctgtcctcagcttcaggtcaacattccaagtagcagcatggactaggactgctggctcctcagggttgttcaaaacagtcggatatccaaatgtttacataaaaacacatccatgtaagtgtattgagaagtaattaaggtgtttacagtacacaagactagtccaaacaaatgtatctgtgaatcagatttcacctctgcaccaccactgggaactacttaggtcaaactgctccagataggagaataagagcaagacatgaaagggtcacaatcagattctctaccatggtggctttgattttgtttggggacaggagtccagccagcatttttttccagagatgggaaagagccagtgacatgatctaagcttataggatccctctgcccactttagtcaagcaaagattcaaccgtaacaggtcagagataccaacataagcaaagagcagatgccatatggaatctgcatggaagtgctcgcctagaggccacttagcctgtcatggaaataaaagcaggctgcggaacagaggggtgcgcttctgcggagcatgtctctgaggggaattggcaagagcctctcagccacgctggagggaggaggtgctgtctgtttacacctcagtcctcggtggagattgattttctgcaggaaaactcagagaatattcctgataaggggcttcctgtagaaaggggtttggttcatacgtaagaaaaagctacataatgggttgggtcatgctgaggggtccccgttgaacagggtaaggggtgcctgagtgtctcctgccagacacatatagcctctgcgttcataacttttgtcagaaggagggagaggccaatctgcatctgctctccagggacagcagatgagttaccagctccgagttataggagttgaaagtgttctataaggactgaatggcctggttctttcaaagagctttcccataagacaaaggagagaagtcccctctgccttccaggcctttcccagccccttctccctttgtctgctccatccgggaactctaaggtatctgccctgagatcctgagatggcctttcccattaagtcccattcttatttatcttctatagagagagctcactcgaggtctgagtctacaagccgtgggagtgtccaataaaaccccatccaggggagcactgatctcattatctagggatggtttcatttaaagaacggctttattcactgatgaatgaggcaggagggtggaaggctgtgatttgcattcattgtgctctcagttcttgaaacactgaattgtgtttctgcactggactctgcctttcttttccacacccagcagctcccaggtctgtatccataagatctccaaacccaaacaatagagccctcccctcggaaactgaaactctggtttcagggaacgaagccaaccctgaagcctccctgaggttgctccgcacttgctcctggtgtcataattttggtctttgcttgcattcaatttagtgaataattatattcctgtttcttaatgttttcctttcattgcttgtaagtgttgggattttttttataccaataacattgaaagttcctgaacagcagaaatagcttctcacacattgccagagatccacatgcctagtaggaccaggctcagagaaggtactcagtgcacaccactaacctgtgcagagtgcatagagcacccggattcacctttaacctaccagttagttaataaggatgaaattcagaaccaattgagccttcactcaccctgtcctattccttgctggaaaatcctaagtattgttgctgggatcctgatgaaaaagacccagtattcagaaatgtcattgacttgtgtcccaagggacagccttcttatgtgaagcacaactctgtatggataacaaccatgactcactgctgagggtgtgtgggagactccatgaccataattccatgtacattccacatgttcccacacacagccttcctagactacagtgttgtcatggcatttgtcctgtgactggaaacaagtttcactactaactgatccttggaccttcagaatcataagtattgtccacatctcaattttaatgaattaatcacatgcacagtgaagtctgagaaccaccccgcgagttccaggacagccagggctacacagaaaaaccctgactcaaaaaccaaaataaaaaaaaaaaaaaggtgaccttatcatgtcatccttagagagatacttggttttctgaactaacactggagagctgtcctgagctctaaatgaatccatctatcagaatgagaatcctgagatgttaagccacaagaaaaatgacagcaagaactggaagaacacatcatgacaattgataatttcactaaaatattatactctaagcaaactatagttccaacttttactgctaaaatacctgttctttataagtcatacttgctctctgcttgtatctagaaaaggatgacttgagaaaatgaccaaaggtctgagctggactttgcttctagtaatattattactagaaaaagaaatgatgggtgctatcagcacatttttctaagcagtaatcaactattccttttaagttgatcagattaaaaaataaaattattactaacattaaaagcctagtcacctaagactatggacaaatgtcacaaaagacagagccaaagaggtgagattgtccaagccttttagagcccagaccatcttgagtgaatccaagacactagacactgtttttacattgttggatttggttttgctttgatctgattataactgtgacttggtacttccttttagaataaggatatatgagacttatagccagaacccatagccaaagaaataatgttttaaaggagaaattttcaatttttaaactgttaaaatttttaaggaatgtattgcgataatgacatgagatttgggggaaaaataaacatttttaaaaatatagcttcattgacaaggagtcaattgtactggttagtttttgtcaacttgacacattgtagacacctgagaagaaggagcctcagttgagcaactggctccaccagattggcctgtggacatgtactgtcttaattgatgattagtgtaggaggtccctgcccactttgggtagtgatacccttaggcacatggtcctgggtggtataagaagggtagaaacagaggaagaaaaacagtaagcagcattcctcagttcaatcctgcatacaggttcctattttgagttctagccttgtcttcccttgatgatggactgtaacctataggtcaaatacactttttattccctaagtttcttttggtcgtgatgcttagcaaagtactaaagaaacctaataaaacagcagggatgggcaaaaccaactatgattcatcactactacatacagttagcataataagaccagtctccacctcaggatcacccacctcaggtcacctacctcaagatcacccacctcaggtcacccacctcaggatcacccacctcaggtcacccacctcaggatcacccacctcaggtcacccacttcaggatcacccacctcaggtcacctacctcaagatcacccacctcaggtcacccacttcaggatcacccacctcaggtcacccacctcaggtcacccacctcaggtcacccacctcaggtcacccatctcaggatcacccatctcaggatcacccacctcaggtcacccacctcaggtcacccacctcaggatcacccacctcaggatcacccacctcaggtcacccacctcaaggtcacccacccacctcaggtcacccacctcagaggatcacccacctcaggtcatccacctcagaggatcacccacttcagcatcacatacctcaggatcacccaagtttacgttccaaagagtgaggctcatatcttactttcagcaatggtgatttgtggtcttttagtgcaaaccttgcctattgaacccagctggtcaaaaccttccatttcacatgatctgttattccttctaaaagtatgtaaatgtacctgattctcttgtatagtatgagcaagcttgaaacaagccaagttaaataccattttttagttgagtctaaatttgctattacaaagaaatgcacactcgataggaatcttcaggggtcattaaatcattgcagaatatggttttccacatccttaaataactatgaatcttttccttaaaaagcaaacaatacctccccaaactgaaaaaaaaatctaaaaaggaattgctagaattccactgaaagacacattctcctagaaattacttcctagtagataactccttgatcccactttctataaaaacgccatggagaaacattcttttgagcacacttaaaaatgaactttgccaaacaggcaccttgcagagccaaaaacctataaaaaaaaaaaaaaacctaaaatcaaggaaatctttcttcacattattggtcaagtgggcccaaaataatggaggctattatgactattgcccttggttccttccaatgatgccacacactttggacacaagactaggaggaatcaagttggaactgtgctggaagtcccttctctgagcactagctctcgtggaatcagagggtgagatggaagctaccgagagagaaaagtaaccagccaccctatcagctctaaagcctacaaaccacaatgagcaggctaacaagagatccccaactgtacaatagtgacacttgcatccccagggtaactgacagataattggacttaaggactgctcaagaggaaggaatttataaatgtttctataaaccgagacaactacccatggttggagaagtcatatattctaaaggaggacccatgattgccaatcacccaaatcaatacagcttctaactgtattctaaatacttgtccttacacctgcctccataaatacacccttcattcaccctttatcaaagacacttttttttttttttttgcatatagtggctgctacagagatgcacaagtggtcaaaatgcagagtgtaagtggccatggtggtttgaattaaaatggtccccataagtcattatatttaaatgctcagagaatcacactatttgaaaggattaggaggtgtggccttgttggaggaaatgtgtcactggggttaggggtagaaggacattgaggtttcaaaagctcaagctaggcccagtggctctctctttcctgatgtttgcctatccagatgtagagctctcagctctttctacaacactatgtctgcctgtgtgttgctttgcttcctgccatgctgataagattttaaccccctgaaactgtaaaccaacccccaattaaatgctttcccgtagagtaattgttgtagccatgatgtctcttcacagcagtagaacattgactaaagcatgcccagacccaatcagttcatctacaatgtgaagccatatacctaagactcataaaatgtctcagaaaagggggcagaaagagtgaacgagcctaaaaatgaggatgtctgctgtaagattatgttttctagacaagatatgaaagcttcacccatgaaaatctcagtagtttggttgtttaaacaagaccaatattaggacatccacatcaatactccaatggagacggagaacatttcacaaggccccaccccagataaagaacaataaagaacagatagggaatccttggcagcaagagaggaagcatcagcttttgtccaggaacaaacctctcctctcgggctagccagtccctagtggtcagccataaacacatgtgcatatgatcaaaacttacatggattcagtaagttttatacacacacatgtgtggtaaagtatatgcatcaataataattatagaagaggttataaatctgagaggaagtgggtgaaagaggagttggaaggaaggaagtggtaatggaaattatataaatatgctgtactgtataaaattctaaaaaatactttaaaataaattaattaaatttaaaatttttttaaataaggagaatggcctagcgagtttgctagtagttatgagcacttagtgttcttgtggaagacctgagttttgttcccagaacccatgtcagatggctcacagccatttgtaactcacgctccagaggtaaccaagctcctgaccttcacaagcacttgaattcacatgtgccgccctcttccccaccacatacacacatacacacacacacacacacacacacacacacacacacacattattaaaagtaagtctcaagaaaataaaacccagagggagtcaggcaacgtcaaagctctaagcgagtatccgagtatccaccattccatatttctcagctggagctcactgggcacaaggtatttaagatttctctccctttgctatttcccattgaagtgagagaattcacgttgattttccaggttgtagattcagcaaacctttgccagcctttcctctgccttctgtgcagggccaatgtaagcccacctgccttcaaaagctttcagaaatgagtgagccaaagaaattgatataaaggcaattttgtcttgtcatcccaaagagcaggagtaggaaatctatctcaaaaggggcaaggggggtgcatatttaaaaccagtgaaagatttactgctttcctttttccctttcaaagaagaagtcaagggctattccttgtttgaatgagaacaaagacccttggggatcaaggtagaaggtaaatatttgaaataatgtgtcattgtattttccataatgacctgcagtctttgaaatctgacaactttcctatctacaggttggtttgtttttccttatttgctctcttagactgtcagccaccaaagaagctcataaacacaaggactccgaaaggcatccagccaacatgacctcagaagtatttacatactgtgatggagaccgtgatataattcagtttctgtatcactgtattttctgccaattactactccagtgtgtctctcggggatgtggtaagtattggtttaagataaaaaggcaaagacaaacatgagtgtatgacatgaggcttggttttccatgaggccattgtttcttagccctcgctgctgcctgcacctcaccacctgcagttctgagctcccaggtctgcagtgcatcctgagccgagccggatggccagtggggtttaacagagccattaccattgagaaactacacttggaaatggcagggatgctgtgtgtcctatatggtacacagttctgaccaacctgatttaagacattaaaagctaaacctggggtgaaaaatcagggaatagaaatggctgaatgagacatcgcaccaggctgaaatcgggtaacatggacaaaatacatgaatatgaaattgaaaggaacattgaaatagatggactctgagaatagagtgcagaggccacctagaaaccagaatttatgctgtttagaatgagaacttcgattgctttgacccttttttcatgcatctaaaaagaacccaaataactagatgatcaccttgtagccagatgttcctagcacatatcaagaggttatcagctgttgttttctggacatttccatatgtttgtacatgcctttattagtggcatccccctgctccattttgattatcagttacatggtcccagtttctttccagtgcataaaaccatcaattttttctgccttcccaggaaagtcattcagactagctgaacccattttttcaaaatgacagcccctaagacccaaatgcattccttttggtttttatagtttctaagtttgaacggaatgatacccactagtaaaactacataacctgaggtgcggactatactcctcctactcagaggaaacaaggttctagtctacaagatgaagagccaaacgagagtctagtctacaaggttctagtctacaaggttctagtctacaagatgaagagccaaatgaagcgcaactgtttagtgaaagtctgcacctctatctgctctaggcacctggcaaaacaccacacacttgaacacacacacatatacaaactcacatgcgtgcatgcacatatacatgcacacacacatacacacactcacatgcacacgtatacacatacatgcgcacacacacacctgagatgctgttttcatgcacttctggtctctactggaattccctcggctgtggggatttccagcttgcctggagccctttggcaaggtaccctgttactagagaacaaaggggaggaaggactgtggaggatggtaaggaatgatgccagaggagtccctgaggagcctggcagctttcaaatgctctcaggcacccttttctattctgtctactcaaagccaggctctccaggcgtttcctaaactctcttcatgcaagtcagactggtacgccccagtcatggggcaatagattcaaaagcaagctcccctgcggttaactacctatctatcacggcttctttttaaattttgtttatttattcttctcacacatattagatcctgacaacagtttcccctccctcttctccccctattttttttcctcccccctccccatccactcttccttcattcatttcagaaaatggcaggcctcccagggccatcaaccaaacatggcatatcaagttataatatgactaggcacatcctgtcatatcaaggctggacaagacaactcaatatgaggataaggggccccaaagcagacaaagtgtcaaaaatatccccactcccactgttagtagttccacaagaacaccaagctacacaatcataacatatatgcacagccaaaccctaggcagagatcaaggagtcttgtagaagagggggaggaaggattgtaggagccagagggttcaaggatactacaagaaaatgacccatagaatcaactattacaacgtcttattgtttaaaaaaaaaagcttcatttgtagtgaagggtatatgggcaacagagctctagcaaatgtgagcagaatccactctgtatgtctcactaactctggagctatgaccagtgtctttgccttctctagcttctgtcaaaatatatctgctttgacaagatctctcaacatcataaaaacagctgcaaatctcctaacatttttaatataagagaaatttggcaaaagtgatcacttcagggtctggaaacaaaatagagagagagatcagagggaagtgtttatccatgaacaactgataaccaagtaagtggggtccgtgagcccagcctgggctgctcccatcatcctcaagctccggtattggtgagccgtcaaccacctctaggttatggctagaggagctcaccatgcctaccatttttgttaggttgtcaataaagatattaagtctggcaggaaaaaatatattggggattctcctatgtgttatatagtctgaggatatagcgaaagccagattgtacagcagaaagacaggctactcagatactattcatggaaattctagaaatgagagagctagacggctcaaatgaggcccctcgatggctctgacacggcatactctcacaggggagacccacgagagagcagtagaacataaaacccaggatacatttgaaacctgcttgaactttgaactcgtgcctggggtacagccagacttggaggctgcactggagatgtgtgagcacctcctcagctccctcactggctgactgccaagctatgcagacccagggctacccagggctacccactgaagatgggctgtcaagaggaaagtaagaatgaaagcaaagcataacataacattctccatatcacagggacaccagccgtgcagacagactctgagcaattagtcaaaacaacagtaacagaaacattagcaacaaaacaaaaaaccaaacaaacaaacaaaaaacctgtgagccctgttgttgaatttaataacatgaggattacccaagacagagctgaaagaaaaatgattgaaagaagtctctgggaacgccacacccgatcattatgtatgctcacagagcctcagagaaagacagaaagaaaattgaagggagtggtgaagaaccaaacatcacatgtgctgataagttccaaaaaatctcaagaaagcaaatacccagaaaacaattcaatgaaccagacaaaccagcaataaatgatggctggctttacagagagcagtggactctcccctagacatgaagccctccatcctagaaggttacagatccaatgaagttctttgtattctgtaggttgggccctcagacatcaattaaccaactcttcctaggcatgcccaggcaccaacgttatctaggcagttcttcaacgaatggtcttctctcagatgattctagattgtatcaagccaagccaggagaggaagcatttaaggcaaaaattaaaagtaaaagcaaaagccttggttttggaggtctgtaacctgtgcagtagcaaatgatacaaaagtaaccgtcaaaacgacaaggaagatacctggcagtgtgctgtggtgggccccttgcattccacatggagtagtactgtgttcaagtgaatatggacgagtttgcagagcaattactgaaggggaaaggaaaagaataaaagctgaaggcaaaaggcttgaaactaaggcattaaaatgcatatgctgggcaaaggatgcatttaagctgtataaagagtgtctatgggcctggagagatggttaaggacagttgcaaaggatatgggttgggttcccagcatccacatggaaacttacaaccagctgtcactctagttccaggggactggatgcccacttctgatttctgcagttactaggcattcacacgctacactaacatacatgtagggtaatatgtaatttttaaacacatattttaaaacaatttaatatattatatatacttttaaaatatgaaaacagaactgcaataaagtaggctgatactcgtacatttctggttaatattctcctgtgttagttgttgttatcaagttttatatgaataaatggtcattttacttcataagtacatgtaattttgtatataatcaaaacactgataaattaagactgttttaaagacccagtgtaaagggacaaacatcttagctatttcaccaaagacgacataaagatgcttgacactgttactcatcgggggtgtgcagaggcaaagctcagacagacaccacacaacaccccctagtgtggttaaaatgaaaacgacaactgttagtcatgatcttaccattcctctcctcagagatcacccccagagaaatgaaaacacatgtccccaagcactgtgcccaggaatgctcattatggctttattcagagcagctctaacaaaaagcactgtggtgtctctcaggaaaatggacaaacaaaccatggcatctttctgcaatgcaatgtgactcaacaaaaagaagaggatcaaatgctgaaacaagcaagagcatgcgtggatccctacagatgcgtgtcagatggggaggatcgtgagacaccaggcagctgtgtgagcatcagtgacagaaaaatgagcaaagctaatgagggtgcaaggaagtcaaaatgaggctgactttatgcagtgacactgactatgtgagaaccatctaggatagagaaatatctgtgttcatatgttatatcttaatcaaaatgtacagtttacaatgtaagatctatacattttactgcaatttcatttatgtaaagaaattttaaatacttcagtaaaacacaccataggcacaaactaactctctctctctctctctctgtctctctctctctctctgtctctctctctcacacacacacacacacacacacacacacacacacacatccatatgccttctttttcagctcattggctgtgactgccctccaaaggtgtatagacaggatgatatacattgggtgtcatgaattctgctcaggtcccagccgtgagcaagacttttaattccagtttgtggtcatccccaaactgatgaaacaagaggatttcccaagcgaaactgagcagctggctttgtggtcaacccatcaccagctgccatgttgacaggtgtctgacccagcccaaggaagaaaagatacccactattgagccaatgtattttctggcctgatccatcatttaatacatgacatatcactgggatacataagcatgaattacaaatcaacagactgtttatttgaggaagaagaattacatttaggggtggcatgctctgagttaaagagggggttttgctcaccagtgtctactcaactttcctaaaaatggttcctctcccccatccgcagctccctctcatcagatccagtacttaggttcctggggacttcagaaactagcaacaactgtgaaatgacacatatttaatgactaaaaaccattcatctaaaacccaaagcttttttgaagaatttgaaacaacctttgctggcatgctgaaaggttcaggggtcagcacggagcatggcaaggacacagtcatggtcacaatgaaggacacatttgagcagttttcagagaactcataaaagatgagtgcccgaaaccccagtataaagagagaaagtcaactacagccttccctttgtaaatccaatctctatgtaaggtattgctcaatcatagctttgtttttgtttgtttgttctcttgtttgtttgttgagtttctaacagagccccctttggcctggaacttattatgtaggtcaggctgaccttgagcaaacagagatcctcctgcctcagcctttcaagtgctgggattaaagatgattaccaccaagcctgttgggatagctcttaaatggaggttaaagaacctcaggttactgggttaaagaattctgcctttaaggtaagaatgagtaggaaaaattaagtccaagttaagaacatgaactaaggagctggagagatgacttagtacttagcacatatagcacttgcagaggacctgcattgggttcccaccactcacactagtcagctcacaactgcctgtaactccagctccaggagatctcatggccacgttcagcctctgcaggcacacacactcaccgccccccccgcccccccccaccaccaccaccatcaccaccatagcctcacagagataaacacatatacatgttattttaagagcatgggctaaaagtctgacatatctaagctcaaagtccacctctgctccaaagttgtaaccgggctctgcatttgcagggagtggtcccatttccctgtattcatttcttgatctgcaaaatgatagaactaggaaatctcacaaggctcatgtcaacattctacttgaagatatgcagaaaatgctaacaggaaaataataacttttcagtaaatgatctcacggcgtcttgtctcaatcctcacaaacaccaaagtagtttagggacacaatttaattaatgtacaggtttgatcccaaagacaacttttacgtgactgtcctttttatatcacacctgcagtaggttgtttaggtaagagaatcattctctagatatattgtaaaagtatccacgctctagtttcttttctttgttgttgtgataaaacacccaggccaaacttacattcagggtgaaaggaacccagaggcaggagatgatacaaagggtgaggagaaacacagcttactggcttccttcggctgcatttcttatagaaccctggtccacctacaagcatcacctacagtggatggagccctccaacatcaactagcagtcaagaaaatgccccacggcccaatctcaactgacattcttttttgtcttttttttttctttttttcttttttttttttttggtttttcgagacagggtctctcttcctgagtataacaagttggcaagtgagactagccatcaaatattctttgtaacttttataattatcactccatgacatggagtatttctaatgcactaaaaatccccttttgattgcaatatcctccatttgagggaagtgacaaaggcaggtgacagcaaatcattctgctgtgtaccccactgagaaacctctggaaaacttgcctccatggattgtttggactcctcgcgagcttatttggttttcttttcatcaactatggagaagagctgtggcagatggcaagaaactctttaaaagtcctgacacatacccaagatataagatacaatttgctaaacacatgaagctcaagaaaaatgaagactgaagtgtggacactatgcccctccttagaagtgggaacaaaacacccatggaaggagttacagagacaaagtctggagctgagacgaaaggatggaccatgtagagactgccatatccagcgatccaccccataatcagcatccaaacactgacaccattacatacactagcaagattttatcgaaaggacccagatgtagctgtctcttgtgagactatgccggggcctagcaaacacagaagtggatgcttacagtcagctaatggatggatcacagggctcccaatggaggagctagagaaagtacccaaggagctaaagggatctgcaaccctataggtggatcaacattatgaactaaccagtaccctggagctcttgactctagctgcatatgtatcaaaagatggcctagtcggccatcactggaaagagaggcccactggacacgcaaactttatatgccccagtacaggggaacgccagggccaaaaagggggagtgggtgggtaggggagtgggggtgggtgggtatgggggacttttggtatagcattggaaatgtaaatgagctaaatacctaataaaaaatggaaaaaaaaaaaagaaaaaagaagaagaagaaaaaaaagtcctgacacaacatgatgattcaattgctttctaaatagtccagttgttgatcaggtgacccagggagcagactggggctctgaggttgctgaagtagctgtatggagaacagctttgaggactgggaaagagatgggaacatgggcagggccagaaagatacttcagggtagtcttgtccggaagcacatgggtccctcctgggtatggatgcaccctgggaaatgggagtgctctccagaaaggcagagctaatgtgatccactgagagtgtcccagcgggtggctccatctaaaagtcctgaagggaggacttccaggtgtctcagtactgaccccactttagtctcagatgactgcatagccacagctgcctgtttataaacacactgctcattgacataaacagcctgactgtttccataaataccaagcttccctaaaggaacgtttgcttctgattctgttgtgtttttattttattttgtttttaatgatattgtcacctctgaaagatctgagcttctattctctagttagatctgcattggtatcatttaaaacttacctgagacacagttctgtatctgagggagaaagctctctatatttaggcagaaccctgatcttcctatgtctggaaaaaacctctcttcatttgagagagggcttcctgaagctgagaacctgagatctcagccttaggattttaaagtaaagcgctgtttgttgatacagctgagaatgattttgtgtggagggtgtggaatttactgccactgtggacagaatacgctggtttctccacttgagctgaaatgtaacaaatccatctttccatattactgaagctgaaggccgatgtgtggcttatggaatgagtcttctgacagtggtttcctggattcttgagtagaggaaggtcaaaacagcctgtccattgttggtatgcaagggtggtgcccaagctggaaagcacatggttgctttgtcccaaagaacagctcttttggaaatactgcggtcagatatttggggtgtacagataaagtaaggaaaacacacatgggctaaatgaggaggggaagaaagcctattcatgagagaatgaaaataaggatgtatttgttaggttttggataggggctactcctgcagtagctgctttctctgtcctgacagctgcctctgtaattcccgatgctatggggaaatgaaaggcactctacctagagagtctctttgataactcttacttccccaaggaagtttgctctaagctatcaggggctacggggaccatatcccataggatggataccagccaaagggccaaactttccctttctcatgctgtctgagaatcagatacaaaccagatatgagcacctactggagcacctactgtgggctattcatcaactacatggcatgggacctccctcctctctctgaaacctgcaagatggtaccaccaccatccccatcacattgccgtgtgggtttaaactttacttaaagctcctgataatgctgcagttttgtggcattaataactcttctagcaaacctcttatcccaaagactatctgctccaatgtctccccttggccccaaactgatacttttcagtatttctattcttctttggccaataatagctagataaattttaatgcaaacaaaaataggtgacatggactagttaatcgcttgtcaccaaaacttctgttccaggtgtaagttgagttagatgatatgaaatgatggtaatgatatgatatggttataataatggtgatgatgatggtaatggtggtgatggtagaggtgataatgatgataattgtgattggtggtggtgatgataatggtggtgatgatgatagtaatgatgatgatgatagtgagtctggtgatgataaaatcaacaaccaaaaccacaacaaatataagaaattgatcataattacaatggccatttcaggagtccacgaactttttccaagttcttctccaaaggtaaagtcactacagttttttaatctttcctaatgagctttcagtagatgaagagttgatattaaagcaacaggtcttataccaaaaaaaacccaaggtgcttggagtgagaaaatgtttcgagtttgccccctgagagctgcttaattttggcatcactcttaatctcctccaaacttatctggcaaatggaacacagaaagtgatataaaagccaatcactgaggggctgaagaaatggcacatcagttaagccagcatgttgtgtctgtagaggacccaagttcagctcatcactgcagtggcatttctcacctgcctgtaaccccagctccagtatccaacaccatcttcaggcatccacagacacctgttctcatgggtacaatagtcacacttgggcacacacatatagatataactaaaaataaaattaaataaacaaatacctataaatgatagaggtttgtcctctataaaatgcagcacagatttaatgccagattttgtaaggagtgacagatttctgtggttagttctcagaaccaagaccacgcagatgcttctgggcccactcagctttggcacacaccagttgaagtgatgtttaaattttttcatctttgagttggtgacctaatcctttttcctctaagatcttagaagagggagaaacattgcattttataaaaatcaggcatagagtaaatcgtctatacccgacatagacaaggtgtctctatgttttatgatctcaaaacttaacttgctttggaaatctccctcaaaaatacatattttttaaaaaagtaacatatgaatttaccttatggtgactttgtggtgatatattactatcatacaccagaactgcctttgaatcaccaaagattagagaggagcagtatttgttgttgtgacagagttaattaattttacctctttctcttgtggacgtcagtagatactggcatttcagttatccaaaggccctatcacttgctgtacgagatagccaggatttcactgtagccacagatctcttggaaaaggtgaatccaaaaatgcaggaagatgttccttttcagtcatctcttagacggacctttcctcggtagactttgaccatcaccctcatggggtgatggctacatcttcattccctagtggatatgtacccgtttccatattgattcttgctcctttgatttatgtactcactgtttctctcagaatgagtacttacgtgttgacacagttgagtggataatttggaattttccctccctagccctccctcatctcctttgctattggactttttaaagactactttttcagatattttactgtgtatgagtgtttcccctgaatgtatgtatgcaaaccacatacatacctggaatctgcagagatcagaagacagtgttagatctcctgaaacagaagttacagatgcttgtgagccactgtgtgtatgctgggaattgaatgtggattctcttcaaagactcttcaccaccttttggaagactttcaagaatccaagtccacactggtcatgaatatcatcaagaggacaaagaaaaaagtcttctcacatggctcaatccaaaaccgaacatctaaataacaccatgaggtagatttctcttttgctggtaaaatgttgcccagactttctgttccaaaatcatcaagccacaagtgctgtttaatcccagaacaatccctcagaacaactctggccactcgagtctatgcctcacctgtattttaagtgaaatggtaataataaaggaaggtctggctccccaaatctgctgagagttcagacaagtaatacgttgttacaaaagggtgtgttccctcccccatatggcatagattccaagataattgcatcttttcattttcaagatctatgaattacactcagagggaaagaaaggattatgggattccagagtaagctgaaatatccatttctatgacagggtaatgagtgactgccctttccctcccagggctctcttcatttttggttcaggcccttgtcttgtgtctgaagactccaggggttcatctggagacagccacctgcatctgatttctcacttaagaagtactaaggtcaggttcaatgagggcatcattggagaaattccagtttgacttaatgtccatggaaaatgagcattgtggaattgcaatccttttccctgcttatgtgaaacatgcccctcccttatgttctcaaccttatgagatagatcagcttctcttctcttcttcagaactctcccttcctcctgacagttacaatgaatggctcctgcctttgcagtctctgaagcatgctaatggcctcctttcctgtatccatccttcctctattattattgatctcatagcttctcttctctacagcagacatgcaaaaagacttctgaacctccaaatgaataggtcacatggaagaactgaggcatattattttggttctgatacctaaatacttttatatccaagagatctagccagatttcacaggcaagcattatattaatgtctcctgacttcattttgtacccatgctataatgcaaatcatcaaagaaactcaaagtggaaattcatgattttgaggctactgcacagctcaaatctctctatacatctctggaagacaacacaaagctctaatctcaaaggaaactgatttgtagcagcttattatagttctatcccaggctctgacagagcaaagtttattttcctgcatcttctacagtgaacttgccctacatacgttgaacaaattattttcacaaagtcaagacttcttgaatgaatcagacttaaatacaacaagaagaattagcatgaaggaaaagtgcaccatgaaaaatatttgagcagtttgtcataacatgagttctaaagaaacacatacatatgtgcatgtgtgcacacccacacatagtcccacacatacacacataataaaaccaaacaagcaacaacaacaaaaccataatattggaggagaagcagagagaagcctgcctccacttgtttcagtgtgcatagagcaatggctccttttctttccagatcttttctcatactaatggtttgtagtcctaaaacaaagcttctgtgtaattgaatggggatacctgttagttctgtgtgcaactggtcctctgctcatcctctaaatgtgagccttgaatacatcagagcacaaacctgaagctctatgagcaactcctgcaacttctctaggcataggacacactggtctcctcttatagccaatcaggatagtggtgtgactaatgactagcacagctttaatcctactctcaaacttccattttattttgtcctttgtttaaaagtgccaaagtaaataagttagtagcacaaaggctattttaagattctatttctcaatggtgtatacctataccacttgtctagggagcttgaggggtgaaagtcaaggaatgaatctatttatttaaaaataatctgatataatgcacactttagaactatggaaatacttttattaggcaaccatgagcaaaaacccattggggaaaaaaaagaaagaaatatggtatcatcgggggctacttctacacagcacaaagaatatagccatactgtagagtctgctgggaccatctgcaaagttccccagaagaggatgctcccatatccagggccctggcacagtactacactgcgagggagataggtgtgaactaccattaagacatcattctctcagctctctcctagcttgctatgctccccagcttactgattcctgccttcacacctatacagctgtcagtacactactagacagaaccaagaatgcagggccattttcaatagcatcctgtttaaagagaaatctaatatctgatgactatgaaaaggttatttttttcttctgaagtcttacagaagaaaagaaaaccatgattccctttgttattaattcttttgttatgatgacttgcagctatagagggagaaaaatccctccccctttaagaaaccaagggcataaaataatggttgcagcttctgcccagggaagtcactcaggaaacaatgagcgagaggcagtagtagatgcacaagtcactttgtgcatctacccattggtgaggctgccaatgtctgaagaaagaaaatgaagttttccaaaaactaggcacgtagacaaaagcagggacaaacaatgggccttctaaatgttttagaatgcacttacagttcctgtagacccttagagaacaaaagcaatagctacatctaaattatagtgtaacacaagattaaaaaaaaaattattccaaagctttcctaaatagtggtctcaggaaataaccattatgtattgtgtgtgtgtgtgtgtgtgtgtgtgtgtgtgtgtgtgtgtgtgtgtttatatacgtatgatgtgtggacatacgcatgtgctccgaactaaagatccctcttcagtcacatatctgtaaaataacaaaatatgtggtcttcattcccaagttcatatctcactgcatgattttatggcaaactgcaggcaatagttacagttttatcacagttcaaaatcattcataattaaagaacattaatatataacataatctaagaaaatattttcaaagctaaagtcatattacaaatagagaatatctgcataagattactgaaaacatatcagattacccaagattatacaataaacacaaatgtaattccaatcaaaatgctaaaggagattatttattttctttaaattgatttgaccaaaaatatttcaaattttttctgagagaataaaccatataatgtgaaagaaaaatattataaatatttgtgtaagtcaaaaggctacaacaattaacaacttttcaaacacaatgttgaaaactggcagacaaaatgaagggtttttgttgtttttgtttttttagatttaggtgtcacaagacagtcttcctgctatgtagcccaggctaccgaccagtcttcttgctccatcctcctgaaggctgaattacaagaatgcctcactgtacccaacagaaatctgttcatgtttcttacttacttttgtctttgtcttttttccttttttaaagggtttcattggctgcaaaacgataggctttgctctgagattttcttttttttttttttttttttttttttttttgcacacatacgtagcaatttttatttggtgccaagaaaagagctgttacagaaagcaagttatactataaagccacagcactaaaaacatcacagtactggcatacagagtgatcaggtgaatagagttgaggacccagatatattacgcccaagaaactacagatacttgattttttttttcagcctgaatgtgctctttattttatttgttttttttttttgtttgttttttggtttttttttccattttttattaggtatttagctcatttacatttccaatgctataccaaaagtcccccatacccacccaccccccactcccctacccgcccactccccctttttggccctggcgttcccctgttctggggcatataaagtttgtgtgtccaatgggcctctctttccagtgatggccaactaggccatcttttgatacatatgcagctagagtcaagagctccggggtactggttagttcataatgttgatccacctatagggttgcagatccctttagctccttgggtactttctctagctcctccattgggagccctttgatccatccattagctgactgtgggcatccacttctgtgtttgctaggccccggcatagtctcacaagagacagctacatctgggtcctttcgataaaatcttgctagtgtatgcaatggtgtcagcgtttggatgctgattatggggtggatccctggataaggcagtctctacatggtccatcctttcatctcagctccaaactttgtctctgtaactccttccaagggtgttttgttcccacttctaaggaggggcatagtgtccacacttcagtcttcatttttcttgagtttcatgtgtttaggaaattgtatcttatatcttgggtatcctaggttttgggctaatatccacttatcagtgagtacatattgtgtgagttcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctgggttctttccagcttctggctattataaataaggctgctatgaacatagtggagcatgtgtccttcttaccagttggggcatcttctggatatatgcccaggagaggtattgctggatcctccggtagtactatgtccaattttctgaggaaccgccagacggatttccagagtggttgtacaagcctgcaatcccaccaacaatggaggagtgttcctctttctccacatcctcgccagcatctgctgtcacctgaatttttgatcttagacattctgactggtgtgaggtggaatctcagggttgttttgatttgcatttccctgatgattaaggatgttgtgaagatggaaagatctcccatgctcatggattggcaggatcaacattgtaaaaatggctatcttgccaaaagcaatctacagattcaatgcaatccccatcaaaattccaactcaattcttcaacgaattagaaggagcaatttgcagattcatctggaataacaaaaaacctaggatagcaaaaactcttctcaaggataaaagaacctctggtggaatcaccatgcctgacctaaagctttactacagagcttttgtggtaaaaactgcatggtactggtatagagacagacaagtagaccaatggaatagaattgaagacccagaaatgaacccacacacctatggtcacttgatcttcgacaagggagctaaaaccatccagtggaagaaagacagcattttcaacaattggtgctggcacaactggttgttatcatgtagaagaatgtgaatcgatccatacttatctccttgtactaaggtcaaatctaaatggatcaaagaacttcacataaaaccagagacactgaaacttatagaggagaaagtggggaaaagccttgaagatatgggcacaggggaaaaattcctgaacagaacagcaatagcttgtgctgtaagatcgagaattgacaaatggggcctaatgaaactccaaagtttctgcaaggcaaaagacaccgtcaataagacaaagagaccaccaacagattgggaaaggatctttacctgtcctaaatcagataggggactaatatccaacatatataaagaactcaagaaggtggacttcagaaaatcaaataacccccttaaaaaatggggctcagaactgaacaaagaattctcacctgaggaataccgaatggcagagaagctctgagattttcgtatgcatttcattgtatgggtgttgcatcccctttccctcagctcctcatccttctcagctgcccttccttctcccctcacttacaccttgcgctgtttgcctcccctcatccttcattcagaggctctcttttcccagtcgcactgccacattctagtttgttggacatcactcacatccacataagcatactgagcagttagaggcaagaatccccacatgacagagtaaatacagtgtttgtctttctgatttctcattatccagttttctctgttcatgggcatctagactgatttgggggaggttgtagaaaaagcagaaataaacatgaacattcaagtgtctctgtagtctctgaagtaggctgtgacatcctctgggaatacacacgagtgatattattgttctacttttaatgttctgagaaatttacaaagtggtttcactagcttatgttcaatagtgtacaaagcttttcaattgcccataactacacagttatttcttgtcattttttttcttgatggtggccattctaatcagggtgagatgaagtctagaagtaatttttaatttatatttctctgctagctagaattattgaagactttgaaaatattattagccacttgtatttcttcttttgaaagtaagttcttttgaaagttttgaaagtaagtaaatggatcattggtccatttactgattggcagctttgtttctttggtatttaattttttacagttctctctatatattttagctattaatctcttgcttgaagggtacctggcaagattatttcccaacctgtagagtttctctttattctattgatagttccttttaccgtatggaagcttttaaatttcatatagtctcatttgccaattcttggggggttgaggaaggaattaattatacctccatacctcagagttctggagattcaacccagggccttctgcacgtttggtaagagatttactgctgagctagaccccaccccagaaagttcagagagaaatacaagtgtgtataaaatacagtatcaagttcttagaggagcaataaattgtttcagaacaggcaaaaggaaggcaacaatgctaatgtcagtccttatgcagacatttcaactccagagatattcaagagataaatataaacaacaacaccactagtataaaatattataaatatcttacatagctttttgatcttgaggtaagaccataagaattaagagtaaaatcaacataactcaacactgatggatttgactgcctaaaagtcaaaattttcaatattaaagatgccacaaacattttaaaacaagtggaaaatctacacacacacacacacacacacacacaaactaacaggatgcataaactctaaaatgctatcaaaacttgtctttaagcaatggaattccaattactttcattctcttacatttgtatgtgttataaaagctagaccttttatggagatttaaagtggcttaattgctctgaagaaaataaaattaaataggaaagaaaaatataaagtaactaaaaggaagcagagtgttgtatctacatctctaaagatatatgtctcctaaaattctttaacagtcctcttacatctttcttcgcccacattgtctcattggaaagagttgctggcaacctccaattttaatttagttcctggaaatctgcactggaccagctggggaaatggacaagtgtgttttagtggacatttgctctgtcttaagaacctctgcccaaattgctcttatttaggtattggaaagttgctgcaatgcacattgggaggtttagaatttaacaatctcaacaatttttttttcaaatctcaagtttattctcccccaaggagatgacacattaaaaactaaactttggcagccttggggcattttctataactagacacatgttactgtcctgaatgaaatagatacttaattcatattccttcctaatccatgacaacatccaactctcaaagcactacagctagctgccagccatggaaataccacagacaagttagaaaggggtgtggggaggtaaagcagatgcccaaaatgcccatctacccactcgcgtggagaagcagcaaggagcatccctgagaagcaagttcttagaatgccgtaaaacctgagaataaagacttctcaaaatctcaattctttatctgaaaaataggaatttagaaaaaaaaatcatgagttacaataaaaattgagttttactgaaagggcaccaatggcaatgagaagacatggaattctaatgtctcctactacagtaccactgctgtgagaaagcataataacagaaggagatttctgtcgaccctgacctggtgtcaccagcatcctccatcagtttcatgaatcgcaggatgactgttctatctactatgtccagctgctgcaaaagggcaaaggacacaaatgttccttaagaacatcaagatgtactataaatcagagatgaggtatttacgtttcttttctctctgaagagtgccaggaatgattcttccaaaataataatggctgtcataaaaggagcagtcctctcttccagagtaatcaccaatggcagatgatgtgcaagccaactgcttcattcaaatatgtaccaggagaaaattccatcttctccttctaggggtctcctgcggactctccccctccagtgttagtgacttcagtgcctttccctctctgctctctccctctgcattcttctctcttcatactttagcagaataaactgtcctattgcaatgacagaaagagctttcaagctaagaccatcatctacttccaccccaggcatgagctgctggtgaaaagaaacattcctggagaggtattttggagaattttctgtgttagaataatgcttgtgtctaacaatggctaagaagcaccaaactatctcccccaaacccacagccatatcactcagagagttttaacaaaacattgattaacaaatcataaacataaaaacttttggattgtaatttcttgttctcatgagaattgagagaagattgaggagacaggggaagcatactcacgtttactccaagtggctgtcataaaaaaactacagctaaagacctgctaagatcaagcacccaaaatttcagcagtcagaagggaggagcagataaactctccccttaactgggaagctattggcaggtggacttgggagaacttttcttcttttggagacatggccactggtgggttgtccgtgtcccagtgaatggcccaatactcatgcatctatggacagcattaaatgaacccagagggttattacaaaagaacaggaaggggaagaggggaagaggtagagaaggtaagaggagaagagggaaagagagaaagaagaggggaagaggaggggaaagggggaagagaggaagagaggaagagaggaagagaggaagagaggaagagaggaagaggggaagaggggaagaggggaagagaggaagagaggaagagaggaagagaggaagagaggaagagaggaagagaggaagagaggaagaagaggggaagaggggaagaggggaagaggggaagagaggaagagaggaagagaggaagagaggaagaggggaagagaggaagagaggaagagaggaagggaagaggaggcataggaaatagtcaaatgaagttgagggttggaggggtcagtgtagtgtgtgtggcttccatcacatgaggggttagtgtagtgtgtgtggcttccatcacatgaggggttagtgtagtgtgtgtggcttccatcacatgaggggttagtgtagtgtgtgtggcttccatcacatgaggggttagtgtagtatgtgttgcttccatcacatctcattgcacatatctttgagatattcaaagaacaaaataaacctacaatcattcttattctatgtgtgtttttttcaccatcatttttccacagaactgaaaaggatcaaaatctttatatctgtgcctacatttacatttgacaatatctactataatcatagcattaacctagccacggcctgggacaatcagcttgcatggaaaagcaacctttaataggcgtaatacataattaattttatctcaaactgtggaagataaatttaaatgatctaacacaaaatcctactagcaatggtcacaagctaaaccaaataagtagtatggactgagtagaagctgttttacttttagttcttaaacagacaaaaagaaacatataagaaaactatttggttttttggaaattcaaagtgaaagccttgggaagtctttgatggacaactaaaaagaagatttaagcaccttagatccagtgatacgaagataagagaaaacatatatcattcctttgtttagattcaatttatttttaagaaatcatgtctcattagggttagtgggtgattaaatgagttcaagagtgtagtgtggcatgattttatgtaaaatacaggtggcaagaaaagccattcaccaagtgctacagtttggatccccctatattttctgcagaaaaagaccactccctcccacactctgactacactatttgttgaagccaaaaaactggcttattgatgaatggggacatgggagatcatgcaaatggttttgtattttcttcagaggagaaaaaaatgcctaaactcagatatgcctgttatggaaagtgaagtctaagcagagcaggctgtggcatcacaaaatacgagggcagtagactgactgccaagacaagtcacagccagaagtgggcaccccatggctgatctgatctgcatgaggcagaaccttgtgatatgctcccttcttgaaagttattctagctgttgtccagctgtccggtactaatcatctagaaaataaagtgagaaattagatgccgttacaattatctacattttacaccatctccactgtggagtcttttgtggcaattccctcactgcaacaataatatatgtagtatagacaattgttccttgatgctggcagaaaataactataagtaatttgatattagacaatgtcctcacaaagggtaaagcacatgaaacccttcaccaccaaagatttaaagctttccagagcttagtaaaatctctaaataaaacatatataccccaggctacttgacaactccctgttggaaacctgaggtcagtttgcatctttgttcacattgggcacatgcctttcagtttcaaggactttctggaagaaaagagtgacacaaaatgcaacatggatatggaatggaaatagcttcggacactgccctttgaacaagcaagctggggagatgccaggctctgacacttactggttctttgatgtaagtcttccaaacacgatccatgtactgctaaacttccccagtgtccctggtaagcttcaaagttaatcactggttaatcccggtacttctacaatggttttctaccattaggggtgtgtgtgtgtgtgtgtgtgtgtgtgtgtgtgtgtgtgtgtgtgtgtgagagagagagagagagagagagagagagagagagagagagagagagagaaagggagagagaaagggagagagaaagggagagagaaagggagagagaaagggagagagaaagggagagagagagggagagacacagactaggagggagggactgaatgagagtgcccattgggctttaaaacagcatattgtcccttacttacttggtttgaaaatcaaagggaaataatgagttaaaatgcttgggattgtggtgagaaattctgactccagtaaactttttatgtataactcatttaactctggaacatctgcaggacagctgttgcccaggttcacagtgatcgttcattacacaccacctcagaatgagaaacaggcacccttggaagtatggtatgcatgtgcatgtgtgtaatttgtaggaaatctaattgatgaagcttaagtaggaacaacggccaatgacttgaacccattaaagcaatatgattatgaatattcaccagggatacattgggaaaatattcaattaatgactcggaagataatttttgtcatatagtcttgcaaataaaaattccatcagctgtcttcaaagactgacaaaataaatgatacgatccgatatgcagcggggctgtagaagcatggacttcgtggagaatcagcgcgactgttcttctgctcccagtgatgtggatttccatgtctgcttctccttgctcttgtcctttttctggcagagatttacctcttaaagcagaacgttttcaccaacgtgtttcaaatatattatttcaaggatgcctatgctttttggaaaatcaaaaccattatcttctgtggacactttctatgagttgttttatattttatgataatagaatcgcacagatcaataaatgtgagcaataccaaatcagacagttcctttgtataaaacttatcagagtctttaatttaccaatgtatagtctggttctagatggattctgttttctctggttgggttttccacaagattagaacctgtttgttttgttttgttgttaattaattaaatgggactaccctatgtgtattctttttccataccgttggcatttagtctaggctccgccccgctgttacctggcaacagccaggtgtgcctgactcactataaaaggagctgctggacccctccttgctctcttgctctcttgctctcttaccctcttcctccccattccctttccccttctctccatggctggcctctactcctcttgtctctctctgccttttttctaactcccctccctattcccggaataaactctattctagactacactatcctgtggctggtacctcagagggggaagggatgcctcagcatgggcccacagaggcatccccttgccctacaccttaccacacctccgccaaacatatctctggtctctttctttttataaaccacaacacataccactaaaatatttgacagatttgaggcagccttcagtagtaatagattgacatgtcatagtgactttcacaaagcatcttttctcttcaatctacaggacatttttgacaagatgaggagaaaaaaatcaattctcttttgaggaatcaatgtattaatacccaagttattgccgccaattggaaacccattgtcatcttatttctgtaagtacgcttttgaaattattattttactcaacttttattaaactgctaccacttggtcttattaaaaagtctgaaaacatctttattatcagctgtgtcacaagggtcaggtcatttctaagaaatgtcaccaaaatgaaaagaaaagacaggaatcttctactacataccaagactatgagtcagtcagctatgaggtaccatgagcttaacgaggcagagtagaaatgaaacaaagggcaggcagactacagacaggaactttcagctggaaagaaacagtcctcggttgaaagttttaaacttttatttggcagggcgaagttatgcatgtgagaggggagccggatctgttactgttagcaaggcataggtttgaaggtaaggtcttgaatggctaaagaaacaaagaagctggggaaaatgcaataaaataaatggagatcagagactacattcaggtgggaaaatgaaaaaaagtaaaaacaacctagaagttctgaagacctataaatattctctatctggagaacatgtctcaggcatacataacgttatggccttgaaggctgctgtgccatacccaataatccttatgtgacctagtaaatgtgcccaaagagagcatttgaagctacacagaaaatactgaagcccagacatatgtcaatgccagtccccagcaggccagcccgaaggcaaaatattctggaacacctggctggccagcagagattctttgacggcagcagcttgggacccaacaggcatatattccaacctctctggtagtttcacacagtaaagaagtcatcaaatactattggcttcattttttgaagcattggttttgatccacctaaaaggaaatgtttgaggggagagatggatgagaggagtgagtggggataatgtgtttcacagcttaacatcaaatgtcactggaaaaatagccagaaagcaattcagagtaaaagtatgtgccttctggctaagtcggcagtaccttttttattgcaaaatggaaataaacagtccagctcatttataccataaaagggcaatccacaaataacccaaatcccaaaataaaggcattgcccaacatactaagacatgattcagaaaggtcttgactccagagtttcctcagtggccatgacaatggatgctcaggggttctgattaagtaaaaagttgcaattaatccggagccaacaccagagaagaacatttacagccaacgcacccttcttcctgagcattgtttatttggccattgtcctccaattctcagagtgcttagatactaaaatccacatccagacctgatgccttgacaaaacatatatacaaacatatgtacatatatacatacattcataataacaacattcaaaccaaaattaagagaaaagtacctctgtaaacatgttctattcaatgcacaatagtttaccaaagggaaaaataaatccaagtgagcaacgcttacaataagcacatgctgagttggcagaggaaaggaagaaatgataatggtttctatctatccactgattcactagtgcattgagcacctactaacactaggcactacagataaagaaggggagaaaatggccacctagaactagaaagaatgcaacagattcatcacttagactcccatgtgaaaactgaggtatttgcattaatacatttaattttttaaagccttgatatcagaggtgtctcagccattttgtaccacttaatcctaaaatgtagatgaagaactcaaccataggaaaacgcaaagtcagaaaggttgtgtttggttaaagccttctcctagaaaaggtgggagtaaggattgtttgttagatgactatttacaccactgaataaagtaaaggcaattaaccagaagtgtttccatggttatctagcctccaaacatctatatccctatattccacatcccacatgtagtctctctttaaaataaaccaaagtgagcagaaaatgccatcgcccactggaagcaagcgttcaaaccttgagccagtgggggacttttcaaattcaaagtataagaagtatgcatgcttcataggtacaactacagctattaaaatatcagaaaaggtgtaaatatgtgggtcccactggataagaatcgactgtgctcagatattcttctggcatgagtctccatgggtgatgaagatagctcgataatgctactctcatgagaaggaaataatcatagatagcaaaggagccagggaactgaccttcctacaagttcttcacagaacactaaactgagccacaggatggagagaggctatggcctcagatcatgtgctcagggaaggcctgttgaactgagaaatgagactcccaggagagggagatctaaggcacaggattttagccaggtagagagtagcattaagggcagaggctctggttgggaggacataggttatgcagaaaggaagctgtcctggccagaggagatcaggaaccacctggagttaaaaacaaaacaaagggatggagaacaagattggattttagatctaatcactaagagaatccagtgaaagattttagttaagaaactaaagtcatctcatttcaataaacagtttttaaaacagttcccagagcctcaactacagaaaagactgttctttaaggcagctggctgcacattgaatgaatggaaatgaagtgtctgattagcgtgtcaaagcaaggtgtgcctttcacaggtgcttctctgggtgtaatgacttgcaacttcctcttagatcctgagaacgaaagatcttgagcaactttgaagtgagagggtgagggtggccaacctccaagcttaggctggcatctgtcacagttaccattatagatgcaaatttattagacaggcttaagacacagcaggagtattagagcatcctccatgttgtctcctgggaaacagactcagggagccaaccttttcctctatttctaattgccaccctcaatggctagggatttctgatgggactgttcaaatatatcctctgtgtattgagaacaaaaatatcagactttaggctattttttttgaagcatgaaactacattgtgtgtaataatcaatcatcttatttattcagttcatcattgagaaccattaaacaatttcccatgtcttggattatatgttcacccatatcttccatttactagcagtgggcacatgttgcttttatgtgtttagtttgtgtaaaggtgtgttttgtctccatgtaagcctatgaaacacaggcatgcaggccataagagggtgtctggtttcttggaactgaggttacaggttcttgtgaaccacgcgatcctctggaagagcagccagagctcttaaccaatgagccctctttcaagccccaggcacatgttttaggcacttttaatattactgatttagacatcttgcattccttcctacaacgctctttgtgagtaccatctcattagtcctgagagggccatcaacactctccacatgctctgtcaataaggaagcagattcactgagccaagatggcgtgcagctagttaagggcagaccatggatgagtccctgatttcacttgaactgagtggaggatattttgtcccagccaccttaaaccaatacaccagtcaataacaaataagcaacccaacatcaacagattgttggcttctgcaattctatacaggcatttgggccactgctgtgctaggagctgtttgtagtactttgtgaggttgtagccccttgatatctgagttctgttttccagctgcactcacaaacagtggaacagtcctggagactctccatccagaactgtggcctctttgcagcatttttgtggtcgccttgaactcccatcagtctctgaatgggcccaagtatctatttttaaaatattaaaatggatatttcaacttagaaataactcatgaattgggttgttttaattaatgttatgttctgcatgatccaaataattaacgtctatggtattagcccacctaactatctggatccaggacaaaaatcttcatttttttcatgtacaacagaaagtcttatccatcattcccaaatcatcttcaattatttatttatattaattaaaattttcaaattgtgtgtatttatggtacacaatgttttaaaatatgtatatattaaaatgctacataaaactgattaatattacttcacatggttacttttttgttaagagcatttaaattctatttttagtgatttttttctaaccatagattattcaataaatttcttgctctgatcctctcaactgaaacgttataacccttgatcatctttttatatttctcagtaaacttcagccttggtgatcaccattctgatccctgtgtctatgagtctagctttttggtttccatgtaaaagtgagatcatgcagggtgtttactttttcctggcttgtttcatttaccataatgtcctcttacttataataggttagtcctattgtaaataagactctttttcttttaaagtctgactagctttctataacattatacgtagataccacattttctttatttcttcgcccactggtggacacatggcaacaatgaacagagtggttcaaatgtcccatgtgccgagtttatttccttggttcatgtcctagttagcatgagctgtaattttgaaaatcctagagttgtctgaaaggaaagtcccaactaaggagtatctacaccacactggcctatgtgaatgtttgtggcaaatcatcttaattatgaacttatgcaggatgaccaagcccactctccctaggccgatggtcctgggatgcataagaaacctagacaagcatgagcctgggaagaagcaagaaaggaaactataaaatagagttcctccaagacctctgctccagttgctacctccaggttcctgccttgacttcctaccttgtgttatagactgtgacctagaagtgaaagccaaatgaaccaattctttaccaatttgttttccatcagagtgttttactacagaaacaaaatgaaactagtacataatgtataatgcttaggaggtctcaagggtaacacgataatctaattttcaagttttcaaggctcctcctctgacatacaatctatcaagagtgcacaatgattcttttttcttgacattgttgctacacacacatcatttatctttttgataagaaccattgtaacaggtataatgtgctatcttgttgtggttttcatttgcatttccctgatgactaatggtgttaaataatcatgtatcctttggccctgtgtcttctccatttttacatcatcgcttgctttttgctaccatttgggttcttgatatgtttttcaatattaaatcctttccaattgtctagtttgcaagtattttctctcattgtctggttgtttcttcacttcgttagtggcatccttcactgtacagctttttaatgccactttatatgatatcatttccacatttgttgttaagagattgaggccctgttccattctacacatgatcatgatcacagttcactcagaaccattacagaagtggtccttgcttctatcacatgttcttggcatcttattatcaaaagatgcttcatcataaagatatatgttaagttcttgctgtccattttatttcatccatcaataccagggccttgctgttttgatcactacaaatatacagcacattttgaaatcaggtaatatggtatctttgtctttgttctttttgttccatattgctttggtattcagtgtcatctgtggttccacacaaattttaggaggttttttgttttttctatgtccatgaaaaatgtcattggaatactgataaggaatatagtgatgtatattaaacccatatatatatgaaatatataataaacccatatgttatatatatataatctgttcagtttctttcattaatgctttatagtttttgatattagtcttttactcctttgcctaactttagccataggatttcatttattttgtaattattataaatgggtttgtgttctagaccttttctgaaattttgttctttccttgtgatctgaagctgatactttagtgaagtaatttataattaggaacttgattgaattcattgacaacttcaatatatttttctaggaagtcagtacaatacgacgacagaaaaagcaagctaccaacattgaagaagcatgagaaaaagaggccaatagagatcattctgatattagattgatgtgactgcatgtggttttctttaccatattcagtcatttgatttaatgaactaataaagtctgcacttttacctggcactatagatcaaaagttgggtcttgcacattctaggcaactgttttatcccttgagctaaaactctagcccctagatgtctcttctttccctctcttgactaattgtaatgactacaacttctaggcctagaaacagcaagagtgggcatgcttgtttttgttcctggttttaaaaagaaatctttcaaaatgtctaccattgacttggatgttagccctaggcttgtactatgtaggctttttcattgctaatttgctgaggctttttaatcttaagatgaaagaatgttgaactttgtccaatgttttctctgtagtttctgatataaccagaagttttggtccttatttctgctgatgcagcacccagtgctcactgatttgcatgggtttaatcctcccctctcccagtttgattgctggatttttttgtctgtttatttactttgttttgtttagttttgtgagaatttttgtatctatgttcagtggcaatatcaccctgtagctttcttttattattggtttctggtcaggttttgatatcaaggtaatgctggcttcatataatgcgttaagatatatctcccgctcttcagtcttctggaagagttttggaacaattggtgttcttgacaattgatgatattgagcagtgatgccagcaggttgtgggctattctcattggagtgtttcatctgtaagatactattcattgagttacaaaagaaccactcaatgtggtacctaaacattagcactaaattactgtgcagggattctccttaaaccctctgagtgtgcgtcaatgatgttcaaacatattagggatactcttaaattagggaggtagtgaatagaatcgaagtgatcttgacagaatatgcaaaacagaggaacagtgaggattcaatctgatcttatatatgggtttcaactcttcaagaatcatttaatttgtgagccccagaaactacccatggtgttgcttagaatcctgagcgtcctttgtcaccccacgtggatcttctcagaaatcctctcagggagttcatctgtgatgaggaaaagggtttgcaagatcttccatatcattctactttccacaaaaccttgatggattctcaagatgcctgagtgttgaccatggttatatttaagctgtgtttcactctcaggtaggagaaagaattcctgaaactagtctcagcacattcctgacacagacagctaaaaaaaaaaaagtgtgcaaaatcttattttcaaaatgtagaattagtcttaaaatatgaactcttataaaaagaatatattatttgaaagcaaaatatactgtatatacctaatatgagatataataaaagataaagttagaaaactggggttcagatataaattctgtcattttccattgaaatcaatttggacagtttatatatcctgactctcaagttcttcatttgaaaaatacaatgtaaaaatttaaaactgtatcttcacagagattttataagaattaaagagaaaatgagattagtgccttaaactagccaagtccatattgctaaatctatcaaataactataagtcttaatctcaccccatctattagtcactttccacaccactgccccctccctcattcttcaaatactttctttacttgaactcttgaataccacattcattggatttttgcattcctattttaagtagaatgtcttggttttatttgttgcttcctctacatctttgtagcatcttaacatctgagtgttctctggaagaaaagaagcccagcataataaattcaaagccaaatttctcaagcatacaaaatggagagggtcgaggttggcctgcagatagaagagctatctgtcacttgagaaaatgacatgctattcgtggatcgttgcatgtgatgctctgagagtagatggtatagaatgtgatcgtatagaaggggttgtctagaaggatacccacttcagtctggatgtaccaatgtgtgtctgtgtacacatcaagggatttgacctaaggcaatgaataagagaatgaagaaaaatcaaacattcaaacacgcagaaatatctgtgaatcaggcagatggaccgggcactttgctggagaaaccacagcacccaggatgcctgatgtggttacacagacttgaacaacgagactgggtaatcacatacagctaaacaagactcttaatatccacacatgggccacaagggaatgcttggccattaccctctgggtctgaggctaggatctcccatggtcatgtcagcaataacaatatgcattcactaaggaccttacacactcagagccttctatacatcaacaatgttatatctgacacaaatccacttaaggaagattttaatattgtcaaaatccagcctggaaccagcgatttaatatcaaagatatatgttaaccaaaacatttatgtcagttttgtttgtttgatgaatttggagttagggtaggctcagagacaaaggggtcaagcaacttaatttgagcacctaaatttaagtctcaagggtgtagggcagaaaaagaaggatatacctaatatgtgctagataacagacacagtgaaggtcaatgaccagtttaaatctttgggtcctaactgaggtatattgattcctcaaagtgatgtacttttgctaagtagcttcataggcattagtagccttgaaggccattaaagatagacttctttttctcgttgagtttggacactactttttcctgttttcctggtaaaactaaaaagaaaaatagcacaaccatttctagcatttctttagtcagcctgtcaaatgaaaggaataccttcaaccttctggtctgctttgaagattaaaacattatatattttggtctcttcccataaaagttaatccatttgggcctgtaaatcacctggtttcttccttctttcttttcctcttccagatactgaccaaaacctaagcattctttgacactttgtgctctctcacctttgcctccccttctgccatacttgccaacctccattactgaacatgtttgctttcttggaccatgactcaaagggcatggctttctataccacatctcccctttcttgactgcttctgagagtacagcctgcctaccttttcctcctctaaatttccctctttctcttttgagagaaccccaatttctctggtaatatttttacctcatcttccaagaattcagctctattaagtactaaaacttctgtgtagaattatctcgatttgtaaattctggtatacttggaatccaagagaatactaaatccaaaggttgtaacagatactcatcacacacttactttatcccaagcatttgtgtataagattcacactggtaataccattatagggccattgttatgggctaattttacaagtaaaaaaaaaaaacaaaaaaacaaaaaaaacaaaaacaaaaacaaaagagagcttccaaagatggttgagtcaaccaagtgtggctatcaagcaaagagacaaatgatcagggcagcctgagcccttagcctcctgtgcctgggcccagtgctctagactccacctacctgcgggctgaggcacagctgcaatgcgatccctgacagctgtgatgatttgtgtccctcattcaaatatgtatgaacactgagaaggaacaaacacatcattatgttaagtgcatgtctgctaagatgcaatgattcaccattttagtagtttcattgccacaaatcatacattatataactattctaagctgatcaaccccaaacctattactgtcagaaagttcttgtgtttcctcagtaaaacacattttcctcattcactcagaggttggatttaacatctgtacttattggggaaaaagaaagaagacaaacaaaacaaaacaaaacaaaacaaaacaaaacaaaataaaacacctctgcaaactgcccttaaatctcttaagaatatagccacacaaaagagcagccctacaaagaggttcaggacagtgctggaaaaccactgaccatgtcttagttagggtttctacttttgtgacaaaacaccacgacaaaaaacaagttggagaggaaagggtttgtttagcttacacttccatattgttgttcatcattgaaggaagttgggacagaaattcaaacagggcaggaacctggaggccagaactgatgcagaggccatggagtagtgctgcttcctaggttattctgcatggcttgttcagcctgctttctgatttaaccccgggccaccagcccaggggtggtaccacctacagtgagctggaccctcccgcatcaattatcaatcaagaaaatgcactaaaggccaatctgatggaaatactttgtctgttgactttcccttttccaaaatgactttagcttgtgtttatgtttgcctcaagagaatgtatttcatcaacaagaggatcagtatttctgtccgcttctattgaaaactgaagggagggacagtgagccaggattcttcttactctccttcccacacacttgcacaccctccaggttttcagtaaccatactccaggatccccagaactgtagcaacaatcaatctggaatcaaatggcatgtacaaagttcttcaatcacacgcactagcccaccatgctgatcactgtgagaccagacccactgctgggcagtagggggcactatgctctcaaccctgtaaccctgccagtaactatacccactggaaagaggaagtatcaattgttcagtccttggagtcttcttttcttcatatagtctggcctagtccacatctattgctgcaactgcttccccgctaggtttcgttttacttacgtaaaccaaagctttttaaaagccagcacccattattgaaactgaggtagactgctcagcaaattcaatattattttaaaacaatagtatccaaaaccagaacttagggagaaattccagatctacagttttaattggtcaaaaaacctatcatcccatgttattgcattaactcttcttggaagacaagaacaaacatccattcacaccagacagaacatgaacaacagaccaaactggccattccacaaagtccaacttggtgagccaatgatttcactgggcttactgatggagcatgagttatgggttacttaccaaatcatgggtaatcctttaccaacagctacattaccatgaagtcccaccccatcatagatatggcaactaggccaaggtaatctctatttcaaactagaggtgggataattaattatgttatgccaaaaggagacaagtcagatgccttagctcttgatccattcctacacactcaagccaggagcaaagccctgaacaagagagcccacatgagggtctgggtgacactaaaatccatcagatcattgctatcaagtctctttgtcctgggtctaggttgtacttgctaagatgaaggaaagtgttcttatcaaatgctaaaagacttgtacagaccgatggcaacctaataactatatagtggcagccacttcattcttctcctgttgatgccagtctcccatagctcttagaattgatttaaattatgtacatatttaccatattcaggtattactaagacagtgttcttcaaaggcttcattatgacaagaagaactaaagttaagaaaacacttggactttcccctaagtacataaagacatagacatattctcaatggaaaactcatcagtagactctatttcctatcaagaaattccagttatggaaacaaagttatcttagttttactgttgggataaccctacgggaagatcaacaaagcaccaccgggggacctaacccagtccatgccgaattcttatacttccagagtgccacagatgatttttatgttattaaccatttgttaaaataatgaattgttgagatgagactctatctacccttttctaagttactttacactgtgtactgaataagtcaatatacacttgtgccttgccatgagaaactccattttacaagtgtcatctgactccatttgtaagatgaaggctgactctgtgcctgggtggtcgtatgaggtgcatcatatgtccaactccatccatgcagcaaagactgaccaatgacttttcctgagaggagaaagggtgccaccctatatatttgtcagggtgacttgggtctgtacacatgggtatataaaaacgcaccgggaaaagcaggcccaagaacaggttagacagagcagacctaagaaaggatggaggctcctcatgtgaaccccacaaagaggaagatgcaagtcactgtgctggtgatgactctactgacctgtcacatggtccaaggacccatgggtagagaactcttaactcttccagaaacttcagctctgctcagcccttgccattgacacttctgactagtccccatatgctcatcatctggtttattggtctgaacatgccgcccatccatctccctgttcagttgtgtgggtgcacttctgctcttcccttcatttcactcctacagcccaattctgtccttgcagcctaactctgaaaccagcagccaacagttgcatcagctaccctagctccttctgggaccagatcagattccttatcttattaatacagactctatttgcatttctatcggcctccctattcttcaggacctttaaaacctcttaaactctgtcatggacttttaatcctttatagtcattctgaaacctatacaaatacttatgtagacacagaattactgtgtaatgtgtaatgtataatctgaaagttaatattagtaatcaagattggaattaaaagaacccattgtttgcctcagcctgggttattgagcaaagtggaagtatctagtgtgtctttcaactactgtctttaaaaccattataccttgtgtattaattattattcaataaattatggccttgtggaaagacacaaaggtgcttgtctaaataaataaataaataaaataaatgtgtggtacttctctatgtttctgatataacatgatgatatggatatattacagaaacagtactgaaattctaaagggctcacatatatattatctggcactgtcaactgttccaacccctaaactataaaatatacaataaataatatcactgatgaagttgcattgaaagagttctccattacttctgtcagttcaatgccacagagtccttactgggaataagatggataaatttgatcatctgtattagttacttttctgatgctgtgataatataccatgagcaaaaatgcaaggtacgaaagaaggagtttatttggacatacagttccagaaggaaatgaatcaatccatcgtggtgggcagcaagtagcaggcatggtagtcagagcaggaagatgaaatcccacatcttgaaccacaagcacaagaagaaagcaaattacaagtaggcacagcttcaagtgctcaaagcccaccttcagggatgcacttgctccagcaagaccacccctcctaaaattatcaaaagcagcaccacctagggaccacatattccaatatcagagctgatgggagatgtttcccattcaaaccaacacactatccatggatattttatttcctgaacctctgtttattaagaattggtcaatcaatgtccatatgaattattttgtgtttaagctggccagtgattgagaatcccaacaccttcatctgtttccaacatctgccctactcaaactccttaacccatctgttattcaacaccaacgctactgggcccctgctctgcactctgttgcagcatctggtacttcacaccactgtactgtctggtctctcgacttagatttcaacttaggttttcaaatcgtctttcaaggacactgatttaggataatctgggaatggtttctgtgagtctaagatgttctgacatgagagtgtttctaccatacaaaggagctggcaagtgtccatacttgtatgaagttaggcatcctgttggagaaatggacactaaacatgtggtggcaaaatgctaggagcatggccagactgactcagtcagaacaaacacttcttcacagtgagtttgtgcttcgttccagtttgactaattcatttgacaggagacatgggtttactttttagcctgaaatggaaaaggattatattaagttgaggaatgtcttcagggacactgggattccaaggttacattcttactcaggactgatctacatctgtgacaaggtttctcagggttttatcccagctcagttactaaagtattacctttggatactttgtaaagattctgaattctggtaccactatgtaaggaataagaattccttagagtagaatcctatacttattcctatgaataccatactttcagaagttctgactttaaaagtcaattttgactcttaagggttttagaaattatttgcaaaaacatgtgataactcaaagacaataagatggtattagtcatcatcaaagtgttaaagtagtccccagagtaaaactaagaatcacttgaagagaaagaggattcattccagacacagagctaaacttcttgaagacccattttctacatggctgttaagcctgccttccctgggaagctgttcttcctccttgtctttggagtgcaaacctctgtgaagatataggcacatcaggcccctcaccatttctgtttcgcctagagaagcacatagagtaactgctctcctaacagagctcatctgggtgcagctgaatgccctgctctgtgatccacagtcatttgcaatccatggacaattatccatgattggggacattgggaggccccatggatcatagctggcccatcagcttcatcagctgggaagcccagctaggtgaggatagtgttggttgcttggtctcatctttacttgggccactcacttcacctctgtgatcttcagccaaacaagactgttctcagccatgtgactttacttacctatggaagttaggctattagagtcaagagggagatttcgggttgctatcttaaccccttatcaagaaaggcagcgaggtttagagactttaagagacatgtgtaaatttcttagcttgattttaaaaaatgtaaattatcttatttgtcttatctatcacttacattatcttgtttgccccttggagtttcccagggtgacatatgctggcagatctagaaggtcattggctcttgtccaatactccttgtacttcatcaatagactcagtaaaaaagaacaaggtatggaatttggcaagattgctcagtgggtataagtgagtacatatgttctaatcaccagctgggtgtggctgagggccttgcaggatggagacagggaggtccagagaacttgctgaccatcttagcctccaattcagcaagagaccatgtctcaaggaagacatctagtagcctcctctggtttccatatgcatacatatgaacacaaatacccacccacccactcacatgcatgcatcaaacacacacacatatgcacacacacaaatgcaaacatgaatataaatgtaatgagttattataactgtagtctatgccaggttagccttcagaagaactgactaacaagtagccatttccttgtggaaagggtgagatcctaggcaagtttcctgatgataatcaattcagtctttcattcatggcatctccaaagaattatctagcctttaaaaactcagcttctcataaccaggttttctatctataaatatcacctcaaccttttatgacatttgcttaaggaaataccagacttccttcctacactgcatgaacttagactgttcagaacattgagggatcactgaggctaaggaagtatatgaaaaaaaaaagctttgtaaacaaacaaaatttaattgtacacactcagcaaaaacttagtgattaacaagatggtaaatcaatagtgttgattgaactcaaagaagccatccattaaagccagccaaggtaggaaaggacagaaaccctgtggctaaattcttggcaaatttcgagtctatcgaaataggacatccattcattactcactcaagaagcactgactatatctctgcaactgtgtctttccataagcgtttcctgatggttggctaggagacagaaagggagacagcacagaaaatattactaatatcagtatataattatatcataaatatttaacaaaataaagtaataatataagttctaataaatgctcagatagaagatacatgatgtatcaatagaaaacataattatgaaaatcaagctgagttgaaaaggctcactacatacattctccactaatagcattgaaattttgtcaagtcaaatctatccatgctattttaaaaatggtgaacagaaccccttccctttctcttcttttctctccaactactgatcgtgttaaaatatgcttgttttaaagagaaaatcagaatggacatttgacagatttatattattttcctcagagtagttgagacattgctgtattaaatacatcactacgaaagcccgaatttggtaatatatttgtgttgagcctaagttttaaggccataaatcctgtgtagagctcccttatcatccaacctgaattcacccttgaatgtgtactactgaatttataaagcagcccattaaccacatcataaatactttgtaggaagactcttgcttcccaaggtgacattgtttcataaacatcctcttaaaagtagctttacaatgtaagtaagggaacttagcatttcatccatacttcaaatacagaaatattgaagatacataaaagtttaggaacttgcctaatcttacatgagcctgtctacaaaatcaagccagagtgcttggctagcacccattctaccaagacaggaatactcgctctcctgacggcagctgtacaacccaaaagttgtgaagtgcagcttctacctttgctttattcaggagaacagtgatgtaacccttgtgtctcttctcttctgtttgaaatctgcctcaaatagacctccaactgcatgactgattcaatagtaagagttggaagaacagaaacaatcagagaaaaggtgacatgttgccttaaacattctcaattaatcttaattaatgcctgttatcaaagagaaaacaatttccttatttcagaaaagaacataaaataaatggactcctatgaaaaagatgtttgttattttattttactttactttattttattttgttttgttttattttattctgccatagtcctgaaattttcagggcctctggagaacagggaagttcagaaagtgggcccagatgcaccctacattctaccttggaagtcagtgatactaagcagtgccagaaactgcaactatgagctcacagtttcccccgttagaagctacagtggccactgagaatacagctgagaatacagtgtttgttctcctaagcacaggcacagaaatcctgcaatccagacttcaattatggtgggttttttttctttcggtgtcttctccaacattcctctaaaaatctcttcctgccaatatcctctgagtactcaatgccctttttgagttacctgtgtccttctgcttgatttctctatgcctggaaggtctctcatcacgtatggacctgtcaaggttctggttatagttaaaactcatgttttatgctttttaaagtcttcttcccagaaggataaacctctatttctgttaaatccttttattttatggtttgttcattgtgttatatttgtttgtttgttggttggttggttggttggtttttttcattcttgtgtctcagcccactatcccgcctaatatggactgtgatctttatgaaaatcattttcagaccctcaaatccagcaaggagttttgccattttttcctaagtgcagtgaacctaatgttctctttattttatgtccagtttcttccataactgtttttgagaagaaataccaatggaatctgcaattgcagattttaatatttgggtataataaatttgtcattaaccagaggataataaaataaaagttaaaataatggtaagtctgagtccatctgggaatggccaactcctgccttatataacctcagagtgaagcaccagataatcttggccaactgactctcatctgggtgaaaagtcagagcttcccaggcactttgaatgtagagaacgatgctagactgaactttagcctgatatgaacattaataaatgaacatgatgtgtgactcctgaaagagaacactataggcgctgttctatagataagtagggtcagatggttcatgaaggtcctgtttgggtgaagattacagagggaccacagagggacaacagagagaccacagaagtgagtgatctgagtaaagatgagactctgagcagccaataccatcctcacccagctgggcttcccacagctatgtcagaagctggtaggccagctatggcccttgggaaggcccctggcataaatgtttatggaacacaaaggactcaagatcacagagcaggaacctcagctgcacctggaggagctcttataagtgagcagttacaaaagctgcttcactgggtgaaagagaaattgtaggccaggtgtgcctataccttcatggcactttgcactccatggacaagtaggaagaatagcttcccagggaaggcaagcttatcacacactctatacagtgcccaaactatacacaagactgtcttcttcactgacaggtcataaacaaatgtaaacaaatacagcagccctggttgccaggacaacatctgatgatcaaatgacccaagctccatacaaagggatgagctgtgcatctaaatgctttcttcaggccatttcccatatactttgtgatgtgctccctctgcttattttttccagggggatggaaacttagggaagagcccactgaatctccatcataggccactgaagctccatcagaggccactgaagctccatcagaggccactgatgctccatcataggccactgaacctccaccagaggccactgaagctccatcagaggccactgaagctccataagaggccactcaagctccatcataggtcactgaagctccatcataggtcactgaagctccatcagaggccactgaagctccatcagaggccactgaagctccatcagaggccactgaagctccatcagaggccactgaagctccatcagaggccactgaagctccatcagaggccactgaagctccatcagagaccaatgatttgacaagagtccctgtgaagcttcctaagcagtcagaatccccagtggagagaacagtctcattgactcattcatcctaaatgtagctcttgggacttcccaaagagatcgcagcccccacagtgcagtttaaggacactccctgagggcctcagggctctgaccccaagcccttctttaagcaaagcactattccatctggatatttcctctcactgggatcttttccatctcttcccttgtctagacttgcagaagatgctgaaaaaaaggtccccatctttgccctagaaggaagtgaatagttaaaaaatcttgttcacaggatcgtgggtatatgtaaggaagaaagtggatcccgtcatggaagaagctcagaaatgttggactactttaattactagcagtaattattcattaatagttaaactttgtccttgtagatgggcataatctttcataaatggagaagaaaagagaaaatctccctcttccacttttaccatggatcaactgcaaacttctttaaaaaccattccatactgcctgtgtttgtagtggaaaagagaactttgctgctttggagagcattgttttggttcatagtgatctatgtgcaacttgaaaagcattctgagagaagagaaatgcctttgatgtctcttctaatgtgccccccttttcagaatgagttggtatgggtatatttggacttttattatactgtgataaaaaaaataataaacatttaaaaccttaatacaaaaattcaaggagatagtgcaaattccttgaggactctccatactactttcccttccagctttactaatatctaacatacatttccatcagcagtatataagtttctctgtatcttcccagcatctgttacttcttctttttaaaagaatgctttaagctggacatggtggcgcacacctttaattccagcactcgggaggcagaggcaggcggatttctaaggtccaggccagcctggtctacagagtgagttccaggacggccagggctatacagagaaaccctgtctcgaaaaacaaaacaaaacaaaacaaaaaaaaaacaacaaaaaaagaatgctttaacatatttagcctcctttccccagttcttccaataactgccctctcttcccttctatcccttctgccctccaatcttttttagttcactttgttttacccagctacttctgaaagtaggccctgccctggcatgtgatccacccacccagggtcacatcatcaaagaaaactgactctttgtctccttgttttcttttccagttcaccgggttagctctccctgtcctgatctggcagttttctgggtactatattgctgcatataaaatgcttccttgtaacctggttgtcatcctgcatagactcaagacacaagtctagtagcataagaagcatacgcaatagtaacatggttattaaactattaaatctaagaacagagtagaggtaggccttgcatatatatcgtgtgagaatatgcatgtgtccatttgaaacaatcaaaagaaatacctatttctatcagtggccttaaacttgagaaatgcatgaggcacattttctttttgtaatttctgctttctgatacatgaatgacaacaataccacctgtctttcagggattgtgtcaaattaagagttactgcatgtaaaatatagggaactcaggaaaagttaaataattagatcctttcaatcttcgcttaaactcttaaatctaaaaacttttatatcatctggcccttccccaggaagaacagtagttgttaaggaaataccttgccaagaggtagtgaggaacagaagagtcaaaagtaggcatgaaaagccctgtttggtgaagtgaagtatatttaggggtctagaattactatgagcaccatagatcaagaaagtcaagtgaccattaagatgggaacgatgtatgctttatgaaggggctcacaagtatggcttgtttatgtgatggggttactaaaggagttgagaggaacaatttctaagtgtaaatatacgacattcctggaatgtaacatgatcaggaattagaatgaaacacacaaggaaaatggcttctaactggcagaaaatggctagaggaggtttccaaggaaacacacattcaatatagaccaaaggcatcctgctgttccactgtgacccattctccctcgagacttttgctctcttcatccccatcattggaccttgtacacaatgctcctgcccttgatctgagaactcccatgcagtgttacctagacaatgggggcgtggaaaacagagttgtacttcagattacattccagcacaggttctcgttgttcgcttcttcagtgtccaccacagctacagggtggttcagattacaacggatttccattccaaataagcccctaattaaaagtaataccctttctccatctgctcataattcccacaagcattttatgcctttgggctcaatttctcaggctcagtctgtgccccggaaagtcaggagagctttgccaggaggtagggtgggagaatgaacttgccttttgttttgttttttaatcaatctttgaaagtaaattaggtgaaaatcactttagatgtctatctgcatactttggatgttaccagctcaaaagaacaactccttgtccaaagactggaccaaacaggaaggttcaaaacagatgttgacgcagatgttatctattaaatttgtaatttcaaaatgactaatatggcttaacatacgcaaaggccattgcccaatggtgcggtgcttcagcttgtgtgaggggcagagaaggatgtgtatgtggcaactcagaaggtgcaaggagggctcctcttttgcttcatactcaagactgactttctgtgcacctcctcgagactgacgaaactcaactttgctcaacatgacaatgacacagcttaggcacaaagacatttccccttttcttctatgcaacttgttaactttctaagcaatttgcaatgtgggaaaaaaatcccattaattatatctgagttctaagatctcccacttcactcctgtctctccctcctaaccaacgtcatcctccgacagaacaggtcaagacaaacattcacaggaaagatacattttggagagcaactggccactagaaatgcttacacagcattacctacacccacttttctatgattctcaccccaagttcaaccatgctgacattttcaggtgcccctcagaggaaagttctacatgttctgaggagctggtaggcatgttttggaagcatagtgctcacagtgagctctgagatcagtcctcctagcaaagtgacaatgtggtcctcctcgttcacttgtgcagatgtcaagaacaatggttgcccttggcattgagttgtggtcttagaaatatgttaaccgtgcacgatagtgtgggtggtaccatttccaagcctctctgcctgtgtgatactggcttggcctctggcagtgaatgcatactcctccttcttgggagcaaggtcaggatttggagaaagcagtggcaggtagcacaatgggctaaaagtcagcttgatcttggccaagacttgagaagatctatccttcatatttaacaactcagaaccactgtttcctttatttggtccattccccagcattcacagataacaaatgaatcactccacaatcaaaagaataagatattgacacacagtaccttcgggaaacaaagcacaattttttctcctctcttcaagtcaaagctttgctgggtgaggttggaagtgttatactgtaaagtaccaccttactcaaatctaactccaagtcagtgtttcttctagccctccccattagttgacttaccatccttacagggagcagggcctatctcaaacattgtcaatgccacagtgggagttaatgcaacaaccagaactttctagaatgtgtctaattttgaaaaacagttacagaataagaacacataatagtacttgacagctagcaagcaaagacatcgggtatagatttacacatgtctaaacaaaagtaaacaaaggtgcagaactctacatttctgaaagcagaagactcagccattgtgtcaagtccaggatttcatttgaagagtctttgtggaacacttaaaacttgtcattgactggcatatgtctgagtacattcaagaaaaagtagtctacttgactgctttatagcatggagtttatgtttagctaccttgtatatcaattcaaacaaaagatttgagatagctgtaactataatctgagactctgtccatctgccctttccttatcccacttctccaacagtctcttagcttcctttgctcatgctcagtttgaccccactctgccagtaagttgctagcagccatggcctaccctgagcttctgggcctacagccttgcactccaagactgcgctccaaactgaatgcacttctttctataaaaccctgtttatgtcataaaatgcagatcacacagctgttccagatctttcttgctatgatatttacaaagaagctgctgacagagtccagcaatgaatatggaattcaccatgtgatttgcatgtgaatatctgtctgtggtatagtctcactgaggtcaataggctacccttgagcagtagttggtatcaacatagttgctccagaggggaaacagaggccatggagtaatatcagatggttaactcctgttctaaggtgaattgaatttgtgatctttagtaattacttcttctctgtaatcttaaattccttgctttcgttttatactatgaagcctgaagtgatggctgagttcccaccaattgtctttgagaacattgtctaatttatttatttattgcaattattttttaaatttctgtagctaatcatctagagcatgcttgtttcaatgctagttttctagcacatgcatacacacacacacacacacactgtttctaagcagtggcaaggtctctctaagtattattcaaggacccaaagttctaccattattgtgaccatctagtgatgggctttttaaagttgatggcagactgtaaattacaagccaaataaaccctttcttccttcctcaatttggttttgattagtgtgttatcacaatgacagaaaagcaaagtagaaaagctatgtattttcatatatgtgtatatatgctagagacataagatcttgtttgctttaccgtgattcacttgtccatttgcttactttagtgtgagccacggtgtaggagtttagtaagtagtttagtaagattgggtagaatgcaactgccaagtcctaaattagcactgctgagagagcaaattgggtagcaagggtcctggccttccttgagctgtatgctaagggcctggcacagtgagctatcaaaatcaatcaagcgtataaacaagtctcctggggatgattaatccttgctgagaaggtgccaggaggtaaacgatgtgtcaataattctatagtcagctctaataggccaggctgagtgggaagtgttggcaaagtgctgggacagccaggcgtgtcttgacgcaacacaaaggtgttcgcttagcctactaatatttttcttggataataatgaaaatcctgctggaaggaccttctagttctccttctgctgataccaatccacacataagttgacaggggaagaggatcaaagctttttactttccttttttgagaaaaaccagtggtcattttcaaattctgactcattcttttatccaataaggttatcaactacaggctcagggtaagatatatacagcaaagagcaataaagatttagtgtttgttctcacaaaatttgctctgtgttggggaagaaagacaatccattgggcatatatgataactgactgtgataagtgctctgttcagaactcagcaaacaccatggagcctgctttgttggggagaggctttcaaaatatcctgaagtctgactaaagcaaaggtgcagctatgagaagaacttctggaagtgtgttctaggcgaagaaaatagcatacaatccttgtagatctctctgagtccaagtagagaagatgactagaaattgagctagacctgagtctacctgcaaagaaacaagagtgaagtgtattcaagttaccttcagctttcatggtttaggattcctatgagttcttatgatgtttgggaacctcatacagtgaggcacagtggcacagagcacaccaacatctctggaagatacaggaaggcactgcacttaccgggcaaaacccacagagcctcatctgccatagaaagctgaaacatgggccaggcctgctggggaccttcactctctacccctttgccattcccatcagttagtcacaagtgctcaaactagagttaaagggtccttaacacagcacatagtgagggagaccacaggattaaatgggcagcagagacaggcctattcatcgctagcctgagggaaagacttaggctagggaatcagtttagcagccaggtcgtttatcattgggttataagttcatgtaagataaatatatggttcctaataaaaacagacacccagacaaggaggttctttaacaatgaacaagtctcacgctccctctgctctggcaggcatcacaggcgctgttccaggccatttccgttatagcccagagatgataaaaggaaggattcattttcttcatggattgtctcctgcgtaattgcccccaggcactggggccattttcggtcttgtttttgttacaagtaaataaattttaggtaaataactttcctaatatggtctggccaaagagccacctgtgcaataatttccaaccagtaagtccagacagcttaaagaagcttctagaaagttctttatgaggcaagactatcatgacaaagctcatatcatgagcttatttgacttggcatttgctgaaaaagtacttactgtggcataatttggatacaaacctaatgttattcatctatagcctagtcattaaaacatgggccaaagttttccattctcctggatcaggttttactgcaagactgaagaaagctggttgcattaacatatccaccccatgttatcacaaatgtgaaccaaaggcagctccctctgtctacataaaaactgactcagtaaagcttataactttgcaatgaggatgtatgttcattagttatttttacattagaatacattttagtaatatctcttgacctctgtctggaaatgttgctttcatttccaccatctgtatacttgaggttgaatgtctgtacatgtgtgtgtgtgtgtgtatgtgtgtgtgtgtgtttgtgtgattgtttgtgtgtgtgtgagcatgcacacgtgtgctgaaaagccacctccccatacagactcagcagtagtgaggctgtaatccacgcatctttcatccatccaaagcttccaaacagactcgggcagaaatcttccacatgtttgcgttgggccccctgaggtggtgaaaacatgacttttcatgaacttaaacgcagcgcaaaactttccagagagtgataacctaattctaaacatgtcagcatatgcagctcttcaagtcccaacagcttttctctgcagctgtagaggaatcaagagaaaacaccaggaccagccttcccgagacagaggatggtgggctttgaacatctctctgacgggaagcagcagtgggcaggtcaggaattcatcaacagccacattaacgggaactactagctctgtaagaatgtggttgtcagtttctggaagatataccaagccatatttgatgctggagaccaaggagtatgaggtagaggaggtgatgagtcaccaaaatggctggaagtttgggttgacatttatgtctgagatttatcttggtaagaagagctgaggaaatggaaggcctgtcatgcatttcttttcccacaagaaacagccctttatggatgcccatgtgacctttcattagctcagcaaacaggcctcagatgctgagcagggagaggacacaatattgagtacggggaaggtggaagggatggcactcaagcaacttcttaagtcacaacttttcagagttagttatctctgatatttctccatattaactgtgctagacaaacctaagagttgggacatcaatgtataggaaggaacatggccatcagctcatctaggcatattcagtaaaggacacagcatgaaggacagagagtatgtcatcaccaggcacaaaactcccccagagcaccccctccctaccatttctctgtacagcctgcttactgctccacctacctggctgtctcacgtcactcatcttaagtatccagtcctgtttccaagcagttctgcagaaagggacacattaacggcaattctttttctgaaaacacacacagttacagtgattgggacacattctagcagggtttgcttcactatgaaagtgctgcaaactggggccccattaggaaatgagtgaattgcattttagggtgttaaatcctacagagtccaacccaagtccaagtagatcagtcactgtgtaatcattaggtcacagaaatactagccccttgtgttctttggtttgttgagttcatctgataaagtcaccaaactaacagaatgaagaataaaatctataacatctcatttgaccatagttggaagtaaagcagcagttcttagagaaatttcccagcccttttgccttggcaaacataagagggaggaaaagaaagaaagacagcaggagaccctcctcattgctaacttgaggcatgtctctacacactctgcatttagagcttagaagttgagcgaaagacaaaagtgagcagctttcatctatctgggaatgactgtaggggagggaagcaagctgacacttctccttgtctatcatgatttaaatggatttgacagtcctgctccacctttggagattcctcgatacgtgcacagtgttcttatgagctcaccagtggctacctattccttatatttgaactttgattcctctgaaacaagaattcagggcttcattgttctttgtggaacttgagtttgcttttgcttttactcttcattgtttagcttggggctgaaaatgtctgaaagttctacaggaagcatcattgacagtcttggaatgtttttcccaagagttgctgtccacagaggggaatctgtagattctctgcactaagggaagcagtggtttacaaatccctgtttgggaaaatggccactggttctcagtttcctatccaggtgaagagtgtcatcaagtctgccattctgtgactgtccacttatatcacccagccatattccaaaggccatattccaaaagccctcctctgctccagaacccacagaacaaaaatcactctctggtctttccacccctttgtcccaagccacgaaaatgtttctctcctgccctgaattccctcacctcctgttctggactactattactactctcacagttatgatcagatttgctcctctgctacacatttgtgacaagcaacttatcctctatctccatatacccaagttccccacacggtggggttccaaatggtaccttcaggaagtgatactgtctgccctaaagaaagtcacctttgtatccaggtttaactctcttcctgctctcctgttctacttgaaatcatacttaattttgtatacttttgccttctcatctaggctggaagagcaagaattgaatgcaacttccctttccattttctctttacataactaagagccaatacaattcaaatcatgtgtggcttgatggtcctttgaatgcgtattttgtttaacatctagaagcttcttccacagcctttttgtttccaccgacttctcttcagacttgtcaatcattagaaaaaaaataataagtcctaaaagcttgtggtagccagtccctgctttaatgccatccatttcactctaaaacccctaaatgccatcagaggccaacagggcccaggtaaacgtgctttgcccccatgaaactgagaaatggaaattcctttgaggtatagcccaaattccttccatgccctctgtcttcaccttcataattagcacagctttccaaaagaggccaacaccacattggggttgtcctctatatcttccacaggcacagggtagctagggttctggctatttgtgtactgtttgttgacccaggaaagaaatgtgttaagctgcctcaacatttacctgttctgtacagaaaacaaatacacaggggggaaaaacaacaggttgacacaagcagggttaaaagggacaaacatctatgtgaattcttaccaaaagcaattcccttaggtcctgtcaacttgccagcagagagcaagcatgcagaagtttgggagtagtaaaattgacttcttggggagttgcttatgtctcacctccacatttccccctaggaacaaaggcttttggtttagaccctcaggttgaaaactccagccatcacaagagacagtacatgcagccaagaggaagacctgaagtggaaatttctagaaatgtcacatgatgccgactcacacagtgttttgctaaggcagactcacgtgtggttttgccgaggtaagacctgtgggaggacatgtgatgtttggagagggtatacataggactcagtggacaaagatggcaagcttgcatagctagctttgcaatgctttatgagtcccacatcttagtctttgcttcattgaaagaggcacagcagagaacttctcctggcatcccagctggttctggtcattcccacagactcatgatgatttgtcagaggcctggcagtttctgctggatcatgccaccactgttgattcatgtttagtatcctgatactactgaactggactgctggtatcctgacaagtggcaattggaatcatcccaaagaactagttctaaacaggtccacattcctttgtcctatttgaaatcttttccccccctacctttggacggtgggcagaagggggattgaagcatttgagaacctttattaaaagtagtttttaaaaatctaaaactactaaaagtagtttttaaagtcacagcaacactgtgcatgttgctttggatattaatgttatccttggaaggaaactcttttagggctctcatagatttcccatataaatacaaatcaagtagttggggagaatgaaaaaaacccacagagattacagataatctgttgtcagctctgattatcacatcacgaactatgttattagtgtctaactgagcactgctattctttgcctctctgatactcaacagcttaaagaaatggcattattattgtctccatttggcatatgaggacattaatggccagagaagtcactttccaaggaatttccaacccaggagtaggtggaagatttacacttaaccataaaattgctctatgacctgagcttggcatttagataaggtcccatttgggccattcagaatgacagtgggtgtcacacacttatacaggcatttttgcagctagataaaatccaatgcagcatgagctttggggcaccacaataaagccttctatatattttgtcttcatgagaaaaaatagttctggtatggaatgctgttagttaactttgatgagtgtgtcaggtatggtgtttgagtccttgaataaagttactcctaaaagacattgattaaaaaggtacaaatgctaaccacactttacagagagaaaaatagactaacataggtcaaaaaatagaaccaaaccaaacaaacaaaaataaaacccttagggttttatgaaaaccagagaaagacaagtaactcacaaagggaaagcagagtaatagcaaagcttggtaacgcatactacatacatacatacatacatacatacatacatacatacatacatacacatgcatatatacatacatacacacacatgcacacaggcatataaatgtacatgcatccacacattcacatatatacatgcatacatgcacacatgtgcacatacatacgtacatatatatacatacacatatccacacaggcatataaacacacatacaaataatctcctaaatgcatgcatgcatgcatgcatgcatacatacatacatacatacatacacacacatgcacacatacatacatacatagacacacatacatacacatacataaatacacaaaattgagtccgtttttcattcaactacacctgggtataaggcctgtcctggaatgtggttaagatttgagaggtattaagagagcagaaagaatgattaaaatacagtatataaaacttttaaaacctgtgagagtgggattggtttgagatgcaacacaaacccaggaaagacatgagatcccatgggataaaactgaccctaaagcacaggactctggctgcagaacagttcagcttcccagcactagggtctatggacaaacacatcctgcttttggagttgttttaacataaaatatgaacattctcaaaataaggagggggctagagccttggaggaatgttaacacactttgtagccaatggggcaggttaaatactcattaagtggcttgcattgcaaatgatcacttttccatagcaatggctaaactgccagcatccgtttagagaaatctcccaccttgtccctgtctggatttgccacagtgaagaggccccaaggatgtcaacctcttccagtataaggtgggatccagcacaggtttccctggccactttctcatgtgctgaggccaagttggcttggtcataggccaggttccagctctgtctagcatagttaaatatcctatacatagatctttttcccaaacacagagctcgctcctggattataacttcattatcacttttaaatctaaagaacaaatgttcaactccaaaatcagggcaaatgtctgaaaccttattcagcaagtctccacagacaaagtcatgtccagccccaaaaacagagtgtcatttccagatgctatctgctgtgtgtgtctacagggagcaggatgggatgaatgccctcttctctggctgcccagctacctagctagtaggagtggctttggctttcttgaactgaagtgctgagagccttcctaccccagggccaatgtgctcatctcccatttagaggtaattttctatttcaaggggaccagtggcccaacagctcaaatacatattcattcatttgtttatttaatcacaacctcttcaatactgaacacccacatgctagatgcgcatctagacacttaagacccatggctgggtgatcagcagagctagtcttcagatttactctttgcttctcagtgctcaaaatacatttcagcacctggttgggtggaggctctttctctaaaatatttaatcaactctaactctgtgtttgtgactcacaagctcaccagttgaccagcttcactggaggagaatatttgcagagaaaaaacagagagcagaggagtaagaaagagaagagaaaaggagactggaagggaggggagggttgagagaggaagaggggagagaggaggagaggcatggggatagacgagactgaatgagacagagatcccagcacagaatggaccagggtacaaagaaaaaccacacatagtaagatgatgtggggtcagcttgggcgggctgctatatggactgtgacatcaccaaatctaagataggaaaggaggaaattaggaagaacgggggaaatcttagcaaacacaacatttacagataaactgtatggcagctttccccatacataattattcccataatgaaaccttaagtttccatggagacatcttatatatgtataatgtacgtttaaatagttacctctttcctctttttcaaggaaaccactaagaagctgtgcagctcagtcccgagattcacattttttcctcctttcacttcctgttaagtttcctttaggcttctggttaaagattttaagtttcttttcctacgctcccgaacaattattctttggataagctttaaactatttcatgttcaaattcaaattatttattgacgatgtgtagaaatggaactatgttttatatattcactctgtagcagatggtaaatggcctgttaaattccacagtttattttaatagtgaagctgtagatttgtccaattcttgatatactgtaaattttacattgattttttttcctgccttattgcactgatgacttatagtgcaaaactgaatcaaagtagtgacatttgtttctattgctccatctccggtgccacataggatacctctcaagattttacaactaatgttttccattcaattgattttttgagaatttcacatgtgatattgaattcacactatttgatgcctgtctctttccactaacattcttctttactattatttacttttatttatatatgcatatgtgtgtataaatataatcacttgagtccatttggttctgctcctatatacatggttagagtttaacacttgggattggataacctatcagagggcacatccttaggaaagacttgttcttactttaatgcctatagatagatctttatctaaaggtagggccttgtgatatttccctatccaagaaggcatgttaactagtgctgtcatttcaaagaccttctcatgaacttatgggggagggggccaaagactgcttcattcgtggacagaattgaattgtaccagctatgccctgtgcccattaacaagataagatacttttttttccctttaaaaaggtctataagtaaattgtgtgttataaaacattaaaccaactttttaaaacttttgttttaattgtactggttattctgcccgtgtgtgcatgatgtggtggtgggtggagaggggtcatatgtgccacaacaccttggtggacattaaaggacaaatttgtggagttagttctctctttaatgtgcattctgggtatcgaattcaggttagcaggcttccacagagagctcctttgctgactggaatgaaatatcccacttggctagcccaaccatgggttcttaagctcatgtttttcataatataaactcattttaaaggttgttagattttttttttgctaatatattctgattaatatttttaaatatttgacaatgagagaggttagcctgtaaattttttgttttagtatgtatttttaaaattcaatagtaactgtttactatactgagaagaaatacaaattagagttttagctctttttttctgagacgttgatgatcaattctctgttgtatttttatatctaacacctaatatcttcccaataaacacttactgaattaatgaacagtttaataatgaataaatggaaaattacccatgcccaagcgtaagcaaattccagctcactctcccatggtgtgggtaacgtgctgcagacacgggcaggattgtcctctcagagtggaatttctgctgcttttaggactgagtagttacagccgggcccatacagacggcaagcctgaaatatttattagctgagcctttttaggaaaactcctccaattccttctctaagcacactattcaataaatatctggacggtggccagaatgtgcccagccagggaaacctacagcaaggaaatctcttccatctcaccctgaagaaatggagggtgctccaaagcgggtggctgctgaggcaggagactggtaaggcgggtggctggtgacccaagcaacactcagtctttttcacaatgacacctgttttggtctatcatcaagggtcacagtgtgaaaggacatgtgtctacaattgacactactcgaaatcactacacattgtccagctgtccccttctccccaggggctttggttaaatctttccctggatttcagggctttcatggcctcttattttggtcccaatagcaggaattcgctgaactcaaataaaacaatgaatgagcccatgtgggtcttaggacgatcgtagcaattcagcagatgccctgagcctaacaaaggcccacatttagctatcctgacttctttcttcttaagatgaagaattcctaatgcttgagctattcaatgtgcaactgagtgaaagatctttgctgctagaagatgcttcagcaacccttgttttcaatttccattatccttcccacccattaagaaggacattcttcttcttatacaaagaattctagtgtcagtgtgctttcctaactccagagtccaaagcacttaagagaaaacccaacattgcctttatacacataagtatgtttacagttttatgctgttactcatttttactactcactgtggtcagggagagcctcaagacattacaaatctacaaatgctatatataaatatttatccatatatattatatatccatccatcccatgagtgagcaccacaaagacagtgttctagaaatcaacaaaatttcacaagtaataaattacaattttgtggtaaatggtgggttatcatttttagtgattcagtataatttttgtattatgatgatggaatggagattatttctagcaatgcactatgaatccctcaaagccaattataaataagagtaaagtaatagggaaataattatccataaaataaccaaggggatcagaaaatatacctaggtctccattgctttctaaactatataagaaaattttaaaatactagaagaaaatacattttcagcaaatgtatatatttcaagtatgtactaaagatgaaatagagtattttctgtaagggtttacaatatttttctagagctgttggaagtatgcatatgcatatatgcacaaatacatacaaatatctacgcattccttcaaatagtatactgtttgctatcctaagacacagaatcctaatagatccacaggccttcaattgcagcactccaaaggctgagatgagaggattgtcttgatcatgcttcaggtcatgctagcctggctacatagcaagtgcaagggcatgtgggtgtgcttgtgtgtgtgtgtgtgtgtgtgtgtgtgtgtgtgtgtgtgtgtgtgtgtgtgtgtgtgtaaaatatgcctaattcagcagtcctggttctataaacaatagggaattgaaaaagaggcacagagcaaagagaataaaaaatgtctgagttcctgacaaagtgaccttaaataaattgatgaatttgtgagtataaaattctagacctggacacacacacacacacacacacacacacatatacaaaaaaaaataagaataggagaccccaggtaatgcagaagactcatgcagaaagtaatgcataacaaggtcaatgagtttagttcattgaaaagtatcacatatggcaatattagtagatgacgtcaatagatattagtagaaattaccaagtaggctttcagagacacttctgtaacaatatttattgcatttgtgattcctggagctaagattcatttcggagcaactgtgtttcatcttttgaagtggaagtgtgaatgttctgctacttaacaatagcaacatttattcttctgtccgctttaggtggacactttaggggtgagcataaaactagtcaataacgcaaaggaatgcgcactgcacatcagcaagaacccgtggactataaacagagaacagttttactgtatcaaattcttaaataaccttatttctgaatgcagaccttaacttttagaaatgtctttatgtttatactacctaggcacgctattttcattttaacttggtcaaattagtgaattattaaaatatttattaattgataaagtttttagtagattctatgagaacaatatacatgattaccaatgaatttataaatgcatttcttaattggctaaatcttacaagcaaacaatggaatgttccccacttttcaacaggagagcttctaagacacagaacaaggaaaatcatcactatttccctttgaatttcaggaactagggttcctctgatatatagctcagacttggttggtatttcctatgtagcacaacttggtcttgagtgtgtggcgatcctcttgccttagcctcctgagtgtggtgattacaggtgcacgcccacacgtgtcacagaaaattaacaatatactattattagaaggaagaactagacatttgcatctatgtgtactttctttaacacttttataacatttgtcatatacaacagacacctcagaagaactgtgtaacagataagaagagtgggcagcaactcaggaaatggtggtggagagtgtacgaattacatgctaaactttcatgcatttttaaacgattcataaacatgtatttctcaaaaataattgtttgtgaacaaagttggcaaatgagctttcctattacattttttcaggtgacttccctggctgtagatgtctggaacattaaaaaataaaaaagccccaaactaataataatgacaataattaataattaataaccttcattcttggaaaacctaacataattgttcttatttatgtttcagtttccattctggaaaggtgactttctattttaagacagctagttttcctaattaggttgtcacctcacttgtgatgggcatttagggactctcagataacaacagaagtgaaagtaagtgaacacaaaattgcagatgcctgcactagtgccagtgtgtgggagggctctagttctgaagggactgtggagaaagagagagaaataaaacagcccagacccgtgtgctctacccccgttaagactcggtcttctatgaccagacattcacagcaagaatcattccctttcactctcagcccagacttgaaaggatgccaatgctttacttagaggtaggcgggggaagaaacacaaggtaagaacagcatggcagagttataaacgtcagcatgggtggggtaagaggcagagtgagcagcaaggcaggactctcagttccagcatttcgatccagtccacctacaggtcaagtgtaaaaagaaacctctacattgtggtgaaatacacattttcagaattgacatggtatagtccaccaaggggagagcattctaatctaaattgaaagaggacgtcctacttttatctgtgtgactcttgaagagtgtctgcctactagggagaaaaagctggaaggcaccgactggggttcacctgcttgtgggtacccctgggctgagagctgaagaactacattatatcggaaggtaggggtgaggaaggaaggctgagctcaaggatcagccaggcaaagaactaggcttagacacttgggaccaagaaatcacggaacaagatcaagaccagaccccagccactaagagagccatgtaagtcctccttaagatggtcctccattcattgctccccgtcctggtttattggcccttctcagagaacttaacctgacagtccatgaaaggtgcttggttgatgccttcaaatgagtgcctccacgcctgttctcaagcagagaccccagttctgcttaccatcccactacccttcttgtggggcacttgctacactctctctccaactatcagttatcgggggggggggggttggttttgttttgttttgtttttaaagtttattgtttgaaaatttcaaaaattaatacagtggatttttgaggagcctaggatgtctttagcagtagccacacagcccccaagagaaaatgaacccttctgaaataccattttctgggataattaaagaaaattggggtgcaggattagtaacggctctgccaaagctttatccacagggtatttttacacgtgaaatgatttcgtgtctgggtcactgagaggcatttatccagaactgactgcctgaataaaagacataatcatgctataaattcatttagcacctgcatctacctttcagactgtctaaaactatggcctaggggttggtatcagtgtgcaatgctgaccaagacgtcaatatgacaactgtgggcatgtaattccagtactctagagactgaggcaggaggatcatctacaagtttggcaacatcttagttccagaccagtctggactttaaaaaagaagaagaaaaagaatcaaatctaatcgattattttatcctatttctagctattattttcatctgtaagatcaatgtgaaatgacagcctcacttaaactctctttaacccgcaaaatatatttcacacacatatcaaaatatcacatggttcctcaacaatactatatttatgtctttctattggttaaaaataaatctaatttaatgttttgaacaaaagaatgcttaaaatagaatgattctctctgtaactatcttgaactggattcttgtcttggattgttctgtaattttctgaaccatgtgccttccaactataccagcaagtcagagacaggacaaattacttggtaattctatttctggtttaatgaaattaaccaaaaatttaatataaaagtgaagaaaaatctcacagacttgtaaaatctcttaaatggattttagaagcagctcactgtggtgatttttaacacatttataaccaaaacttagcatttaccatcagcgaaaaataaaaacaaaacaaaacacacagcaacaactaagaattctctttcaaaatgtgttcctccagacccttctaaaacgtgtggcagaataaaaataatttattacagaactccagcaattataaaagagaatgtggacatggtattttgttgttattctggcgtctggcattcttctcttggcataattgtaataggaaattaaagaaaatgcagagccatgaatggcatttcaggtggcggcatctgggctcacactgtgctggcagcatgttgagcctggcctggagcctgacttggccatttcgtagctctgtggctccgggtaagtaatttgacatccctgtgcttcagttcttttttttctacaaaataatatcatccccctgacacaaacctgtctcactatatgagaaagcagtttagaaactgtaaaaacctatcctaaaagaatatcctaattgttgagctaattgcaccagggatgaacactgctcagtgtactaaacaacacattcctcaactaatgtggctttattttctactggagacaagataaatgaagaagatgaactgaagaaccaggctgtctccctcttaggctgaaaaagtcatcttaaagcacactaggttcattcctgcttatgattaaacctctgtttttcaaggattgagctatgccccactaataaccttaactacaaatggttttgtactgtctgttccagaaatggcaatcttttttttttttgtttcaaaaagttaataaccatcttgcaaccctacctttgttgcaaaagggttgttatgactaactcttgttactacctcttgttacaaccaccttacaatcatgtctttgttagaaggaacttgttatgcttacattctgctcctgtaacccagattatttggccaccaactgccccagtttggaaacccttgcccctgagccgcaaaactcttgtattcttcttacccaatgctcatcattctaaccctagtagaggaggcagcccaggtacaggaattttttaaagcttgctttaatgaattgcttgcttttaataatttggccatgatgatttgggttggtggtctttctctttccatcgttgggactaacagaacacttaaatatatctttatctttaaattattttgaggctcttcagacaaattgatgactatgaaggccatagttagtgaaacccacagaatagtttcctagactcggtatgttagtcttcatgatctaactaggaagtctatgctctttaaccctgcactaccatagtgcacagctgtagccaatcttctctttatacctctgacacagtacttgggcaacacctttgtgaaggtattgcagtccataatacttctgacacagtataaatgacctttattttgtctcatactttgatttcctgcttcttaattgaactcaggggtggtggttttgtttctttctcttggttttgtggtctcacgatctcctagttccccattctctgtgtctctatctgtgtgtctgtctgtctctcaccacacacacacacacacacacacacacacacacacacacacactgaaccagtcactcgatgtcctaacttgcatccaaaaaccttcagtaaggtttttgacatagtgtctgctgagccacagttcctgaagtggccctgtacagtgcttccaaggcatacttcaatggcagtcctggattaatctgattgctgtattgtctgtacatagacatttaccacaaaagaaactactcactcctggaaagagatgccaaacctctgatttaaaaacataaaatgagtaattcccaaaatatagtttttctccataaagcccataatattctaattaccttgacataaacaaggaaccctgtaaatcttactcaaatagtctattcaaaagccaccttttcctgtgatctgggtgttctcatctgcccaaagtcctccatgacttaacctcctctgtttactctaccacccacatgggaaggagcctggcaaactatataccaatcctaactctgtagcccatcacttttcttaggtgtacattgagtgagcccatcagacttcctggcaatagctatcaattgcaataaagagcaaagaaaggcaaacagctctgctctctctctactgagtgactggttccatgacagtgataagctaaacacactcctattcttgaggatgttaatgacagtagaaaaggcaaagacaaaagcattagactcatagcataggaagacaagggagttcctaaaagtatgcatccagcctaattgcaaatgacaagctcactgactgataagcctttgcagccaccatcacacataggtgtacactggaagtcaatcacagacctggattgttcatccacctgacctggatcaatgggatcaatctctgttccgtcatttttcttcagtgttccaattctccacttacacggaatttatctaactccatcaaaatggctctgctcagggtacagtgaagaatttaggttcttcatagtttcagctgtaaataataaatcatttaaagcaccatttttaatggaaatctatagccaggttgcagatgcctatgcctgtaattctagcattcaagccaaactgagctgcatggtgaaaccttgtcaagaatgaaagaaaaggaaagaaagaaagatgaaagaaagatgaaagaaagaaagaaagaaagaaagaaagaaagaaagaaagaaagaaaggagggagggagggagggagggagggagggagggagggagggagggagggagggagggagggagggagggagggaaaatacagtgaagcagaagagggaggtgtgtttaagactggatactcttctagaaaatcaaagttctcagttctcaatgcccacattggcagatcacagccacttgtaactccagctgcaggaaatcagatgcccacttctggcctacacatacacacacacacacacacacacacactattaaaaataaatcattttttaaagtttattttcgttgttgttgttgttttttgttgttgtttgctacatccagtccaagtgacaagcgcgataggcccccaaaaacctgggtgctgtaccaaggcaaaaagttcacggaaacgtagtctcctggaactgtggcatcctgtataaggaatgctccaatgtccttgttttagtggtaaacggatctgtgtgctttcccttaatattgctttattataagtgcctctatttgatatatagctaagttagattctaagcagtcagtccttgagccaatcctgggcatggatagctaagtcactgccctacacaggaatttaccattatctaggaagaaggaagttagtgatctaagaaggaaccagagtagatacttagaactataggtagctgagttacacccttgcacaagtatttacaatagcctagggggaaggtggactatacaatagactagaatgggaactatggcaagggcacgaagccctagcccctggcttctaagtttaaactgactttaggtggggctgtttttgattccagttgttaacactgaattttatcccagttggttcctgccagtccttctgtgtttgcattcctttgttttgtgtaataattcggtaacctctttgtaccttgatggtgtgtcacctaacttccctattttcttctgtatacaaagtttgatgctccatttgacaaattacattcagatccagcacactctcttgtgtctgtgtcggtctgtcaattcccgccaactctatgcccatctgccggaacctctgattcccacagattgaggggggccgattaggcctggtcagtggcagttgttgttgtttgagacagggtttctctgtatagccctggctgtcctggactcattctgtagaccaggctggccttgaactcaaatccatctgcctctgcctcccaagtgctgggattaaaggtgtgtgcctccaccacccagcttttttaaagtttaaaataagcaaaacacagttctctagccctagatagactcaggtaaaaattctttttttatttttaaatttattaatttatttattttacattccatattttatccacacacacactctgtccaccctcttactgcttcacatcccattcctcctccccaccccttgtctccacgtggatgtccccacccctatgccacctgacctctaaactccctggggcctccagtgtcttgaggattaggtgcatcatctctgaatgaacacagacccggaagtcctctactgtatgtagcctcatatcagctggtggatgctgtctgtttggtggtccagattttgaaagatctcaggggtccagattaattgagacttctggtcctcctacaagatctccctcctcctcagcttctttcagtctttctctaattcaacaatgggaattagctgcttctgtccattggctggggacaactgtctgcctctgagactttcagctgcttgttgggtcttctggagtgcaatcatcctaggtccctttttgtgagctctccataacctcagtaatagtgtcaggccttggggcatccccttgagctggatcccactttgggtctgttgctggaccttcttttcctcaggtacctctctatttccatccctgtaattcttacagacaggaacatgtcaccaaaagaattatccataaaggaaaaatcaatttattgaacttcatcacatttcaaaatatttgaatgccaaagaattttcctcagatgaaaatctgatctaaagactggaactattcataattcactttgtggaaaaggcctagagtctaaaacagacctgataaaccaacacaatggaatgtcactcagtaggcattctgtctctcatgtatgtacatacatacgtatgtatgtatgtatgtatgtatgtatgtatgtatgtatatggatcctgtattaaaacaaaagatagagacatactaattaagaataatacccttctaaatgaacttttctattgaaaagagtaaacatgaagtcttaaataaaatagaatcttcaaaccatgaacttgtagaatatggctagcactacagtcctgactatatagctgggttgttggaggctatcaagtgactattacattaaaaaatgctacccatcccataaaattttattgtaaatgagattccatatggtcattattaaactatactttatagtggtaatgaaacaggtgttatttttagtgacaaaatcccctgggctgcatccttgtatgcagacagctgcagtgtgtcacccttactctcatccctctccatgttggaattcaacaaaggggacataagtggatgtgcaatcttaggttctaaagtaatacatgttactcagagtcacaggcagaggacagaggagacaaaggagacaccactatccaaatgtagtacagtttgagtaccaaaataagcaatcatgctaacagtttataacatgaatgaaattaaaattcatgatttcatagaaggtaggtagacagattaatagaaatacatacacatatacgcacacatacacacacacacacatgatagagagataggctggcagacaataggaatttttccttatgataaattccaactaaagaatgtacagaatagatgaagagatgagagaacagagaaagccagcagccattgccctaactcacaagcacagttaaaagcagcagcagcgtaggacaccctgacatcagtgcctcctggtgtgcctagaaagacataacataactttcatggcatttaggctgtaaatgtataacctgggtctaatccagacataatgtcagacaaacccaaattgagggacattcgataagtagtcacaactctgaaaatgtcaagatgaagaaagactgaggagctgtttcataataagagaccaacaagacataacaactgcatgtcacacaattctgatgagccccacaccagaaagaaaaaaacatagacatgaataatgtccctggggcgctgacaacttttgaaagtggatggggactagacactgagatgctagccactgtcagtctccacactcagatatttgttctcagtccaaaggagagagttccttgttaggaagtaaacaaataaaagaaaagatgagcaatgtctccaacttaggggggaaattacctttggttccttggaaaggacaatttttttaaaggtttgtagaagagccaatgacactagacacagtattttttatatgaagttttcatagaggaaacatatctaaaatgtcttattgaagaagcagtaatgaggaaataaagagaggaagaatgcacacccagagacagagacagagaagatagagagcagacgaaagagagaagaaaaagaaaatgcactggcaacctaagcaagaaaaaaggatgcaaaaaatcccatgcttttgagttctacatttctaaaattaaaaattacagaaaaacaaaagcagagagatgggaggggaggcatcagcaaaaggaggaataacaaggaaatgtctgcattgtatagggatcactcacactgttgcctctgcaacaaagtccactgtgtgactctttcatttacacagggcttgtagtgtcccacttggatctctcacaattgagagtatcacacacacacacacacacacacacacacacacacacacacaccttgctttacagagaacagagcagaacagaggtatccaacagcagttaagttctaaagtaaaatgcattaaaatatgcttaaaatataaaagtacctgagactgttataaatattctctcatggagacttctacaacctcaacaaagatctctgaaaagaaagttcaagaacaaagagattaaaatagtctccgttcattgattgatgatttcagtgtgccaggcactggtggcattaagccagttgtaacctctgtgtgtagtgaactagaaaagagaggattttaaaactcacctctaagtgtactaagatatcgtggtcttattacaaattaccatcctttataagttttttcattttctgtcatttatcactttatagcttcctgctagccaccaatgactgtataactccatgacaagaaagtaggtgtgcacagtccatctgtacagccaggtgtgctaagacagcaaaaagctccccaggaacactgcaacaggaggatgactgtgggccctgctctcttgccccaggtttagacagactgagctgtccttgtggcagtcgctccctggattaattaactcagaattaactctcaatggcaattcagatttctgcttttaatttccccctgtgctgaaaaataaataggtctaaccacatttccaggctcctttgcatgggctttctgtgccttatagcagggcaagactcgctgggaaacatctggaccacctccaagtgggtatttagtttctttgttgttgttcaggataacctagctaaccgcaggccttctccaccaccacactgcaatgtacctgaactagagccaagatgccatcccacaagatgtacatgagaaatgaaaaagaaagaagaaaatgagaaaggaaagagccagggaaaggaataaaaattgtgaatattttctcattatacattttcctctcctgacttcacaaaaacgtgcagacctcgagtgcactgtcctatttgggaatacctctgctctctgcccagcccaagaagattataggattattagcatgaggtacattcctgggatcccaatccctggggcacatgcacaggctttcagctttgggagggaagtgggggcagggtgacaaatgcctttgggggtgtctgaagacatgcagatggctttcacaggcttgtgccaacctgtggtttgtacacttcctgccttatccataccaactctgtgccaacctctttcccccacacaccccaaaataagttagtttctgctcactcaagcagtacaggcttgaaattttctaggttatttatttattttcttatattcttctctcacacattacattttgaatgcagtttgccctccatccactaatcccagtccctctcctcccttcttttctccttcagatccactcctcttccatttccctttaacaaaaatgagcaggcatcccagggatatcctccctacatggcctaacaagacacaacaaagctagacctaaaccctcatatcaaggctggatgaggcaagccagtaggaggaaaagggtcccaagcacaagcaaaagagtcagacactcctcactgccactgttagaagttcaacaaaacaccaagctacacaaacataaagtatcaaaattctaacatagaccttgaaagatcaattctcaatttcatatggaaaaataaaaaacccaggatagcaaaataataataataataataatcctatataataaaagagcttctcagggtatcacaatccctgatctcaagctgtactacagagcaatagtaataaaaatgcatggtattggcattaaaaaagataaattaagggaatagaattgaagaccccaaaacaaatccacatacctacagatacttggtttttgacaaagaagccaaaaccatacaaaggaacaaagaaagtgtctttaacaaatggtgctggtctaactagttgtctgtagaggaaaatgcaaattttgtacaaccactccggaaatcagtctggcagtttctcagaaaattgggaatagttctaccttaagacccagttatactactcctgggtatgttacccaaaagatgctctaccatcccacaaggacactttctcaactatgttcatagcagccttgggcataataggcagaaactgaaacaacccagatgtccctcaaccaaaaaatagaacactgctcagctattaaaaacaaggacatcataacatctgcaggcaaatggatggaactagaaaatatcctgagtggggtaacccagacccagaaaaacacacatggtatatattcacttataagtggatattaaccataaaatataggctaaccatgctatgatccacagactcaaagaagctaaagaaggttcaaagaaggatacctaaatctcattcagaaggagaaacaaaacagacacagaagtagatgaatacagagatgtgggtgaagaggagaaagctggtggagatcgggtgtggggagaacggaggtgggagtaagaggtctgcgaagtaagggggaatgagaagtatctctaggacaagtcagcgacttggataggggagagtcttggagaatatgggggtgattctagttgagactcctaacagctgagaatatggaacttgaagtggccaactcttatagccaagcaggacttccagtggagggagggggacaccaacccatccacaaaaccttggacccaaaatttgtgctgcctacaatattttcagggataaagaaggagcagagattgaggggatggtcaaccaataattgctccagcttaagatccaccctatgggagacagccaacccctaacactaataatgatactctgctatggttatatacaggagcctagcataactatcatttgaaaggcttcatccagcagttgatggaaacatatgtagagacccacagccaaacatcaggcagagcttgggaagtcttgtgaaagagtcaggcgaaggactgagggagttgaaggagtcaagagtgccacaagaagacctaaggagccaactaacctggactcataggaactcacagaggctgaacaaccaacaaaagagcttggactgaacctaggccccctacacatatatagcagatatgcagcttggtcttcatatgggtcccctaacaattggaacaggggctgtctcagactctgttgcctgtcttcggattcctttcccctagctaggctgccttgtctggcctcagtggcagaggatgtgcttagtcctgatgcaacttgatgtgccaggtcgggttggtaccagtaaagggagctcacctctctgctctctgaggagaattggggggggggcatgggagagggaggaataaggagtagggtagaatttgaagaaaagaagagaggtgggttttgataggaatgtaaagtgaataattaattaattaattaattaattaatgtaggacagaatgatgaacctaacttacataaaatacaatcctgttgaaagaaaatctgagtactaggcttgaggtccatgagatggatccattttaatagaactttgaaaatagaaagtaatttcacaagggctggggatgtacctcagtgagcttggcaacctccagagttcaaagtcattcttgactccataaagagtacaaaccagcctggcttaagtgtgctggtgagatgctcagcaggcagaggcatttgctgagaattcccagaacggtgttgtggcttgcataagtcactctttcttcccttccaggtgtgggtgttgtgggaaatattaaaaatcaaactggcaagtccccacgcttgtgccctgctactctttgcctcagtggtctgacccgccatgctctggtgggcaatagctgacctgtttttatctcgtggaggctctgactcaaaactccacaatctctccacccacctcactaagtccccactggcaggtcgttaccacgccaacccaacagttcaaatcctgaacctggatgaaccactgcgtgaagaaaaaaacaacacaaacttagatcagaaacgatggtaactcaatcgctgggtgcagcaactaaaatcctaatcttgtaagccttattaaatctaaatcctccggtggtgaatcctgacggatctgccattgaaactgggagacatttgaagctgcatcttgtcctcacactacttctatacaaaaaggacctaactctctcctgatacctctcttcctcagtccaacccagaagtccctcctacttgcccggtgattggctcctttatgcattaggtgattggttcacaagaagtcgccttagtatgactcattccttgtctgcagctccttccagaagagcagaattagcctcaaaatacacatcgcaccaggcccatccacaacatgtgggtccctaggatctaacccaagtctgcagatttggaggtgtgcacctttccctgctgtgagatctacaaagacctgaatatatagacttctatagcatatgataaagatattattttatttcatctgtacatacagtcacaaactttaaatggctataaatatgaccacacatgcttatagccttattagtcttactgacttcatcttccggtttctaaaaaggattctaacatattctcactgtgattatttgttctccttctccacctaagagatggattgttagggatttgtttccatcaagcagtgattttgtaagaacaggttttctaacaggaaaaatgccagccacaccagaccaaagcacagacagcaaggcggcccttgcctgctccgtgccctctctgtggctaggctctgagtgttctaaagagctatgttttcattctgaactttgtcactttcctctttttccccaggtggtagagacagtgtgaatgctcacaaatatcagaggatataggccacgtgaaacacaatgcacaaggaacagccagtggaactgagaatttcccagagtttggggtcagatacacaggactaggaccatcaggcccaaattcaaactttgacgataaaggaaatatcaaatactaaaagataagacattaaaaggataactaatttagaaaagtctctttaacacatcagcaaaatgagagagaaatatgcaattgagcagaactctgatctcagggatgaaatcccaagcctggacacactatacagaaaagaatgcatggggaagacctcttctgtcagagacagtttgttggttcccacaaagagaacaaacattctataaaagtcatgtggactcttttacataccatcaaatgagacagtgagaaaaaccttcaacattttataacaaacacagatgcaaagtccttggctgcccagtttttttctcatgccaacatttagtacaagatcaggccagtgaaatacaaacttaaggaacagctctgctaggaatggaagtggttcatacttcagatagtttttaaccatccggaattatagggatgcaaaaatctgcaggagtgaatcacatcttcctattaattagactcttcctattaaacactagtaggcagttaggaaggaaagtagataaattggagtgtttcttcctgatgagactaccaaagtatgtaggacacattactgaaaaataaaggtgtctgggtttagactgagtggctatatgtaaactaagtaccctcctagttcacaccagctacctcagaaaaattatcggcatccctccatttagcctcaaagtggcaccagccaggtgatgcatcgtattaaaagataactctaaatatctgattgctagaggtgggttttcaccctgctgtgccagtttggaagctcagctagcctttctttcactaagtgttttaccctgttgtcaacccccaggacaggcatattgtatcacaagcgtgggctgaatgaattcatttctgatggagctcatggtaatttatttaatacgtactaagataaggtattacaaatccatggcctcagtttttcttccttgatggtttcttccagaagcattaagaagaaccaactcaagtcctttcctagcacaactacaatggtccaacaacgacgctgatgctcccaaatttagtcactgaattgagacactgactttcaggatatctgagaaatcctgtctagagttttgtttccctacaaagatgaagccatccagtctcactctgccagaccaagaatatttctaccatgggatacctctagcgcaggaaattccagttctaagactcagacatgaatgcccatctattattgttaaattgcgtgtgttcagaagtagttttttcctgttggaggtagacagttcaacatgtacattgtggtttccagaggtgatgaaaacatattctgtttttagatactggaaatgaccaacgaatctaaaaaacagtccacttaagatgtttttaatgtttcatttttcatatgatataaaatattgtgctcagaaatcactgaagaaaatgcatggcttatctcttttgggcaactggcttaaggggcactcaagatcaataaattttggtatttgggactctctcatgagaacaaatcagtgtatttcgatcatcctgtgacatcctgaaacagtcctaaagttgtcaatgtcctccatccttaccgttcagttctcttcgaaaatgtagccacaatccaaatagagaataacactgaccctgaaaatctttccagtagttaataactcatatcacatcaaattttgtctcattaatgatccaggttagaaagaaagatttggaaaatgtgaggagggggagaagagagacttaggaaagcatctcactcttctttctctgcctttaatcccctgcatgaaaaggaagctaacagaggccacactgaattgaaattgaggttggtctttcttttgtttttataattagattctttgagactatcagacagtgtatcttgattatatacccccccagatccaggagttcttccctagtaacccaactttggctctttgtttcttcctaccacttggagtacaatttatgctgactctctactcccaggtgtgtgggttcctctacggctggaggttgatccacctacttcttgctttggtgaggctgagtgtgaatgtgtgttgagtttggcctctttctcccttgttcatacgcatcatttaacaactagtacatacttggctttctatcaacattagtgtccatagtaaataaagaataattattaaagcaatttccacaaaactagccttcacatatcagggaagttctctttaagggattttgtttaatttcttcctcagtagagaaaccaaccgggtttgaactaggcagactatctccatctgtgctttcactctaaaatatagttattaaaatttaatagcaaatttcacagataattaagaacccaactttaaccttacactttatgagaggagatttgcattcatttctaagttatgttaattctatttttcaatgataaagcctctgaaatggaaatgaaaaataaagaatgtgaaattattaatttcactgggaagtataaagaaaaacataatagtctcaaaaaaaaagagataagctcaatttttatcaatctcaaggcaatgggcagagtcataaccaaggacagtattgcctgtataatcgcctggatgctgtcacacatttagatattgatggtgaggagaaattaaagactcctccaaagtgaaggttggagggattgaaaggatttcaaagggattgaaaaaagtaaaaatagggaaactatgacttttgccttgcccaatggatgaaagtaagctatcagatgccctgctagtagtttaagttagcaattagagacatggacctagagaaatagagtagagtatgtgcaatatacagagacaacagttcggaattcattccagaatggcacccagtgaaatggtttatgatgaactataaaaaatctcacactataccaacaccaaacacctggggcaaaggacagggaataagagaaggaaacattcaaacagaaagacagggggtggagggggcaagaagttaacatggagccaaggaagaaaggtccatattcgatgagctgatctcagctagtatgctccaatcttgcaggaatagaagagacctgggtgtagaaaatgcaatgtggtgggtgcagtaccgagctgtgtgtgccaaggacctcatgcacactttccaatggatcgggagaaaacaggattacacagaaatatcactatcaggctcagtcttaatgactatcttaccttgtatctcatttatgtcaagcatttatctttaagctgcagaaagtcttttgaggcttagagaatacttttttcaattactgtagtttgagcattttattgttctgtcacatttggaaaggaacagaaaatatggcagttgcaatagtttgtgtctttgttgctgtttcgcaatatgcccaaaatcgtgaccaaaaggagctcggggacaaaagtgtttattttagcttacatttccaggtgacactttaccattgatagaagtcaggacaggaactcaaggaaagaacctggaggcaggaactgacgcagaaaccacagagaaacacagattattggttcctcttccatggcttgctcaactaccttccttagatagagtaacctctctggggttggaccctcccacatcaattatcaatcaacaaaatgccccacagacatatccacaggtcaacctcatagatgcaatcctcaattaaagttgcctcttgctagatgactcatttttgccaagttgacaaaaaaatagccagaacagcactctatggctggtatttgtgttaagcctaacctgtgtctgaatcatagggtgagactgttaggtaccccaatttttgagtggcatagtcagttttagatgatgtgagaatgtgggtttccctttcctgactttaataactttccatatttggatcaaatgttatatagaccttgaggtttcaccctttaattgattaaatatggaaaaattggaaagaacacatggctggaatttatatgaccatagtgctgctatgtggtgagggaggtggaaactagagagaatttctctccatgtgtgccatctatctttcagtgacttccctgatcatgttatttatctgcattagcatttttgtggtctagaaattacaaacaatttttaatagtcctctgaaaagaatgtgaagtgtggagcaatctgtggaaaacacatttttgtataattctgtcaggatctagaaaaaatatcttgttcctgcagttcacttctgcttaggaattggtccaacaggagacagaaggagaagctgaaagttggagaggctttccctcttcttcaatagactatactcacgccttcagtgcttaaactcatgctgctgcttctagcacttccaggtcatgggggacaggacaaaggtctactagctgccaataccacatttaatgtagcttatataagcctgttactttgggaacaacaaaataaatcaagtaagactttcgttctcagggctataatgttcaacaacaataataagtaacagcaggaaaataaccaaaatattacacaaaatgtgacgaatgactgaaggagttcacatttctactttttaaaatacggtaaaatagatgtgtaaaaaagtacaacacacaataaaaaatatagtttcttggaaagatattttaaatatttctcaaaatcattattagaaaaataataaaggaaaagtagtccatgagagaaaacaaaaaccacatgagagtgaaattatagaacaaggtagaacataatctggtgtttccttcatcagcatctgtaaattaggctgtgagcatcattctgtacactaggatggagtgtggtggtgtggatgagaaaggacccatgggctcatagagtcaaatgtgcagtttccagagagaataactgttcaggaagaattaggagctgtggtcatgttggaagagatgtgtcattggaagaaggctttgaagtttcaaaagcttagcatgcacaagctcagctttctctctctctctctctctctctctctctctctctctctctctctcttaaaggaatgtacaaattctccaaattgattcatttttctatggaattttacttgcataaagttttaaataaaactaacaaggcatgttagacgctaataccactctgatctttaaatctcattggacaggagtcagggggatagggcatggcaggggtttctgtgctactgagcatgtttcatgtttcttgctttatatgttggccaaagaggactggttataacagtttaccaggcagaactataggttccaggatagtggtgagtgtgacccatcacctttgtagatgacaagatcatattgcaatgttaaaaggttaggcttgcccaccatctcttcagatgcatgtttgaattgagtaaaatgtgcagaagaaaagaagtttggggtctatactattttagagaagtctggcaaacattaagaagcaagtggcccccaccttaaacaaatattttggacaataggaaagagggattacacacacacacacacacacacacacacacgtagttttcaaaataagtaatatttcattgtcaccacagagcaagatagtacaaggaaagaaaaactcatgcttagctagccctgggaaatgccctaaacaaaacctaaagaacttaaacctgactatggagagagagagagagagagagagagagagagagagagagagagagaaaggaagaaaggaagaaaggaagaaaggaagaaaggaagaaaggaagaaaggaagaaaggaagaaaggaagaaaggaagaaaggaagaaaggaagaaaggaagaaagaaagaaagaaaagaaagaaagaaagaaagaaagaaagaaagaaagaaagaaagaaagaaagaaagaaaggaaaactatgatcaggcagtatatatttatcctagcaatacaaaaaaagaacatagaaatataatgtaactctttggaatagtgaaaccaaaaagaaaaaactgaatgattatcctcacccaaagaaataacaattgatacattagtaacagtttttagctaagtaggaccagaaggaactttcttagcttcttcaagggtagttgctcaaaaataccacaaaaccctacaaacacattactcaagtttgaaacattaaaacaccagtatctttttttaaaaaaaaaggaacaagttaggatgtccccaatcactgtcccagaaattaagaagtcaagtagacacacacacacacacaatacccaagtaacacaacactacaccgcagggaaaattatgcaggtgttcatagtgaataagggttcataactgctaaaccttctacacatttgttcaagcctcagaagtgggaggtattgtgtgtggactcaggaaaagttaattggaaagcaatgggttaaagaattgataaacaacatggggacacttgcctcagaaaggagtcaaagctgcctctgttcttattttctaaagaggaagctgtgtttctcttctgaaaggagcatgggagaggctgcgagggcagggagaagaggaagagtgagatttgtccaccaggttgctttcccatgttctgttttgtatgacccccgccatgccaaagcatgactgtaaagctactctcttgaaatgtcaacgtctcattgttttctaaatttatctggggatttgagagtgcttctaacttcctgttgtcccactgaagtggatgaattggcaaatgcctggccagaagagggggagttctgaagctcccactcagcaagccttggcaatgtcttgaaaggtggaggaaaaatggggaggggtatcctgtttgtttacccttctccttggcaagccaacctggtacttgcccccttacccatgagtccagtgaatttcctaaccctgacaacattgtagtgaccgtgctcctgttaactgctagtgagtgacactcagtgggtaccaccccaccctccacctccgactgccagtggtgtagggctcccactgctgttctctgtcctaaaatcactatccttaagaactcactaggcataagtaaaaagtatccatctctgcaaccagctgaaaagatgcacggctgtgccctggggtaatgtgaaagctcgatggtgcctctccaatttcctctttttctatttcaagccctagaccctgagaatgtgtctgtatgtgaagacggatcctttacagagacagttaacttatagcaggatctttaaaataggtctgttgtagttaggtttctgctatgagataaaacactgaccagatccagctttgaggaagaaagagattgcttggtttaaataacaaatctcaggcgggcattgagggaagtgagggcaagaactgaagcagaagggagacgcttgcttgcttgccctcaggctcccattcagtggtctttcttatgcttcccagaaccacttgcccggtggtgacaccacccacagtggttggatccgccccaacatcaatcaggaagcaagaaaatgtccctcacaccaagctgatggaaaagatttctcaattcaagttcactctttctggataactctagtttatgtaaaggtgatcaaaaccaaacccatacacgatcctaatccagcatccagcatgcctggcatcttcttacaaagactcacacagaccagaggatggctgtatgaggcatgacaggaagagagttatcggcaaactgaggacgtagtcctcagaggaaccaaaatggttacatgttggtcctgaacatcttctgaatgccaagataataaattcctaccagtgtctctacttctctctgatgtctgaaagtccttttttaattcaagaggaaaacaggagaccagacgctctgggaacattggtaactgctctgagggctccaacttctaggttttaagaagtattactccttttatgaataaaaggaataaatttctgacctaacttccaagtgaaacgctctgtttatttagcaattaagagagcaacagaacataagatcgatactttaggcaagcagccttgcaaagttcctggactcagagtccaaaagacccttggtagcattccagttgtatctgtatgacagcagttatgcctttagaatcccaggctgcttctcttctgtaacaccctcttgaatgatgctttgaatattgtgtgagaattagagaaactaactgtaagagtttgtcctgttctcagcagagatgatacttgacaactggtagaatgatagttgttattgttactattgtttaaaataaacaaccttacattgagcctgaaaactgctaaagatccaacatgcactaacccttaaccataccttcaactaagataccactgagagtctcgggaccttaagtagcctaagaagtaaccatgagtttaattttatacaaaattttatgtcgttggcaaattacaaattttccctgcatcttaaaattcttataaattcccttgccttttgttgcttgactttttgaatgaaagccttgatagcagactttattcttgttctagattttaacaaagatgctattgtaagtattttgctactctgtcctatgtttattctaggttattttgaggcttaagacattgcattctcaactataattgcttattatgtgtgatatgtgtgatttatttatgtgtttcctgtgcatttatcaagatatttatatttctgttaacttacatcttcaacactgtgaatggcattcatatatttaaaagtgtttgacttacctacatctcagagagtatcctgcttggataataataattcattatttattgttaatgtattgctgggttccagtaactaatttttaatataatatttttatatcttctctaataagtcaacattctgcataaatagttcaattttcacctgtacctgaatattctggaatcaaacttgtatttaattcataaaatgaaagaaaaatattccctgtgttttatcttttgagggttagaaccaatccccaacacctgtcctttggatgtgtggtggaactcacttctaaaattgctggggataaggtttttctctctttttgtgtatgtgtttatggtatctattcaagtgtgtgtgcatgatgaaatgcatacaggtgtgtgagtgtgtgtgtgtggggggggggggtaatctacacatgttcttgggtgcatatgtgtgtggggggggggggatcctgagaagaatattgggaatctttcgcctctgctctgtcaccttattctttgagtcagggtcttataaccaaagctaattttgtaagctttagagcttacaaaactggcaatgctcagaaccaccttgctttggaaatctcctgtccccaacttccaagactggaatcataggcgagtcaccatagtctccatcattttcatgagctctggtgacatgaacttaggccctcttgcttagcaagcattttagctctgagtggttcttcagcccctaaggttttggggttttggtttttggtttgttttcatagaaagactctactccaggtaattactctgaatcctataatagctatgggaatattcaacgtattttctagagtcagtcttatgcactgttttctaaaaatatacgtattttatctaatattcccaacttgatagcctacagttctataagctaatatctcttaaataaatacagaatctgttattatagttcccttttgatttcattcattctttctccttttgtgtttcatcaggaaaatctttgtcaaatgcattaagtcttttgagcagtagaatctttgtctcctgtactaggagaaacatatttaaacattgttcaacatattgagccctatctgacatatcataggatgtgagtgtagggttagggaaatggcggaagtcataaggaaaagtgtgaccaaagaccaagtttaattagtgcctatggcagaagacattattataaacatggatctttccagaagaaaaagggacagccgggtaacaacataccctctacttgcatcactattcacttttgactcactaaaagaaagcacagatcttaaaatgtttgccaagtcatgagcatttccttttcccttctagtgattttaataataaattttaagacctctattttcaacaacacaacggactctagtgttagaatcaagtgaccgaaaatttgctgatgttttttgatattggtcaataactgatcttgtggcatgcagaactccatcaccgttgttctttttctaatctggtgtgactgatgtgctgagggtgactgggacacacaaatgtaccagaagaggaaatgttgaaagggccataggctttgcttgtgttgcttaatgcagtccttcggatgcttgcttgtgaaatggagacatgtgatccactcttacctttagaaagaactctctagtgatgagtatttctaaccctcacatctgtgctcctacagcaaacagataagaagagaagagatattagagtatcctacatgtcccctccacaaatttcatccatgtattccataggagttctctggtatggtctgaggtatctgagaatgaggttagttgcaagactccataagagggaaatttacggttgggttttctgtcaaaatcacacacttttgtaacccttaacaaatcaataatgagtcatatattacaatgttttaaacccaaggtaaatttctgagtacagagtacaggtacatgagttcaggacctgaagttcaagtttctagagactcttcctggcaacacaagggatcatggtgaagcaactcaacatgagcactcagataaatgagtgggaagaggtcccaacactactggcaaccggaacttcaataagaagattgctaggctctctggcaggaagacactctccacctggaagtcaagccaggcagatgagataaagaagacctgtgtgttggagatagtagaagaactagaagataaaatataattcttgaaaatacatgaaaattgagcattatttaataatattaaacaggatgttttaaaaatacaagtgatatatgcaagtgttgtgcatatagcatggtaggtatatgcacttgtcctaaatatttataatacaactatatgccagtgtctagcatgttataaaggcctaaaggtattttaagaaagatacataatataaagcacattggtcagggaattaagatctcaatttttgattatgttattaactagctatataacttcaggaaaaccattgagtttctttaggtctcaagattgtcccctacaaacagaaaagaaagaagtggccagaaggtcatttctagttggagactctacatctccttcagtgctacaggaagagtgggccctggagaccatataagaaggtttgctcaaggaatcactgaatagaattccaaaggcagagaagtgaagggggtgttcatggagtagcagctggtctcatgtggctgagaactgggcagcagaaagatgacaaaagagataagaatgggtggcctgaaaatgaccactgcaggtgtgaaaggtggagtggagatttctagtttctttggagacacagttgtgtcatgtgatgtttttctggaaactgtcttatgagtagatgcttttgctgaagcaggcatgtgggaggatattttgctgagaacagacacatggtgtttttttctggaaccaggctgaaaaaaagggcatgtgatgttttgctggagcaaacacttgagagaacacatgatgtctagaaaagtcataaatataacccaacagacagtgcatgacactgtgtggtattggttcaccttgccactctttgctggtaatcatttttcatgacttcatagatagattaaaaatactagatagatcaaaaaccttctggtggtgttctagtggctacttgatgctaccctagactcagaccaattggcagagcttcacagtttcttttggattgaatggccaattgctggttcgtgaatggtgtttgtaagtggattgagctactactgctaatttaagtgaagtgaactactgatatcctgaaaatgaagattagatgtgccccaaagaactatttctatacaggtccatgtcctcctttgccctattaacttttcctttccactacctctggcaggtgctgggctcaaaggcagcttaaagcatttaagtacactaactaaagtagaatttgaaaaatacaagcctacagaaagatgaaccggtgcagctgaaggcaagcctgagggatccaagttcactgtcaagacaaatgaagaggtaggaaaatgactcagtgggtaaaggtacatgctgccaatctgacaacctgagttcaacccccagagcccacatggtagaaggacagactccctcaacttttttttgaactataccttgaaatacatgcctcttctatccacacttctcagactaagtaaatataaaatcaagacaaatgatgtctaaatgccattgaaaatcaacctatattctaatatgataatttgatcttgacctgcactgttcattggaatagataaatagaaagatggtgtgtgtgtgtgtgtgtgtgtgtgtgtgtgtgtgtgtgtgtggagagagagagagaaagagagagagagagagagaatagtttcttaagacagtgcttctttatgtaacccaggttagccttgaaccttgatcaccactaaaggttaatagagtagaattgagaaattctcagatatatgataaaaaattattgtcatggtgctttacagtttataaagctataacaaacgcttggtcctcaaagtcaacatagaggagacaccccagatgtaatggaacccaaagcaccatttgaaatcaggggaaaaagccagtttaggcataacggaattgataattcatacattcatgggtttacaaacctgagaatataacaaaagatgatcaaagattcaaaggaggcaccaatacatttatatacaaagagctcactcattagctgtttgaaagctctaccatgtttactcatgcatctgttagagattgacactggactgtatgacagggatgaaagttacagttagagaatctcagagcttaagacaaaggatcccctacttcttcctctactggaagctcaggtactcaagtccttaaatgaatgaatagcacagataagtgaaattcccacattaccccaaaccagttaccaaacatgaggatgtgggtgtcattcattaccacagaagactctggggccagggtgacattgggtatgctagtcattatgtggttaaaatggggaaagaaactaacagttgcatggttcctggagtaagcaccgctactacatttagtgtccatgagaattttgaaattatactaattacaataatacaattctcctctcctcttgggtgagtaaattggattcttagcactttataataatatgtctgaggttctagagattcatgtggtctgactgagaaatgtctttttggtctgcctactgtttggtatttctgatagactacaagaaggtaagaaagactgctgcaccaccataagcaaccacatgaccacaggcacaaagtgtctgtgaccttcagagtttcctgtgacatcctgaccatctgtgtgaagagctgcatgttatgtgagcatgagctttgctgcttaattcatctcactatcagtgacagccagcacacagataaaataagggcaccctacctggagagcatgggatgctcatagggacatgtccctgccagaaagaagtatgtccctggtgtgaggaatcctggttcactgagtcaccctggcattgctgaacaggcaattgcatttccaacagcatggaatgctgagtgaagaaagcaaatgaataataaatacatgaatgtgagcaatcagaaagttgatgagtgcacaaaccttcattgcctgctatataagcctaaactcatagaatctggtacctctaacttcacagactgctaaaccctaaggaaacacatggcattgcatacatcaccaatatccacaccaaacttaacaatacccagttggtacagataagtgccaaacctttaatgtccttgtcttaatacagataaattgtccacaaaatgggcagctttgccagtgtcacataatctttcctgacatctccagacaaatggacatataaatgtcaaagcccactaaagctgccatgaagcctccagccatgactgtcaccatagcctcacttctgtcatccccataattctctttcactccctttctggacactccaccagcagccagatcatcttcttgaaatacagatgttatctgttgagttcctgtcccaagccttctatgtaattagaagagttaaaactcatggccacagccaacaacccttgtcaggcttgccttttgtttacctaacagtcttgctatgttttctcacgctgtgctaaaatcttaaccaaaagcaacttgggaagggaaggatctgtttggctttcaggttatggtccatcatctagggatggaagggcaaggactcaaggcagaaacctggaggcagggactgaagcagaaaccatggaggaacactgattatgggtttgctgtccctggctctcccaattacctttcttaaaacccaggatggcctttctagacacagtgctgcccataatatgctgggctctcccacatcaattacagtcaagaaaatgcctccatatacatccacacaggccagcctgatgtatgcaattcctcaattcaggttccctcttcccaggtgtgtcgagttgaaaagcaagtgtagccatcatcacaacaactcatatctgtgtgtcagagctttatcacctaactcagctttgccttaatgataatcagtttctccacccctagcctatccccttagatttcagtcaccttattcttgcttaaatacttataagaaattatctttatatgacttagcaccatgtgtgataaatacatccaatgggatgtttcaaatgtttattcaatattggttgactgaatggatgaatgagcctgcttccctttccatgcaaggatatacgttctataactcttaggatctagagaatcaaattatcaccatggacacagaatgactcaccgtgacccatattactcactttcccgctgccagctcatatcactgcatcttgtctatgggattactctgtcgtactattcccagtctaggttataagcaaagagtccatcttctaggcccactgaggctacaaggaacatcagttgcttactttgcacaaaattgtccctttgacatcttaaaactttgaaaccttaaaacttcgcaagccttttaaaaagtcttacatttgtgccagggatgaaatgagggcttccttgaccattgacagggtgacctgagaggagagaaggagtcatcaaaggaggaggaagccagatgcagcagtcaagggaatcttgcagctctgactgactacctatcaggtcacttctttatttatacaagtttcacagaacaaaggcagactattgaatccaagtacagattatgtcattttgtccctggatatgtgtttgattttcactatgtctggggttacaaattcagtaattagaaagtacagatagaacagattttattttcagcccaataactccaattaagaatctaaagaatgtctctgccaacgcaaacacatatattatatgacagcctgctttaggctggcagtatttgctgttttaaagcactctagacaaatagaagatgttataaacagtcttttaatgaatagcaagcactcatacctaactccttttaatatatcattacatcattttgatggctattcttgattgtcaacttggctatatttggaatgaactacaatccagaaacggagtgcacatctgtgatctggatcttgaggcagaaagacaacattgcctttgatccagattttgtggctggaaaagtcagcttttgatccagatcttaagggggaatgtgaagtgggatgacacatacttttgatctagattggcacacaccttgatcttgaaagaaaagcttaggtccaggcatggtagtacaaaccctttatctcaatacttaggagacagaggaatgcaggtctctgagttctaggccaaagaatctgaagaacaaattccaggatagccaagcataggcaatgaagggaactatgggaaatagaaagttgatgaagatgtaattgaaccaaagggccatgttctaatccccaaaagcagcagaatttagcagctttttcctcatggctctggatttagagtcaaaaatagaataagagggttgtagaaactccattctgcattacatatggctacaagactatgagggacaaggaatggaatgtggtgatttgaataggtttggaccccttagggtaatgtatttgagtacttggcatatagaaagtggcactattaagaggtgtggccttcttggaggaagtgtttcactgtcagggtaggttttggaattatatatacctcgagcttggcctagtgtggaattcaatccccttctgctgcctgcagattaaggtatagaacgttcatctcctttgccagccccatttctacttgcatgctgccatgcttcctgcaatgatgataatggagcaagcctctggaaccataagccagccccaaataaatgtttgcccattcttaggcaaactgtgtgaaaaagctgtgctgacttcatgactttccctctttccagtggatatggctgggccacatttgtcataaagtatagggtgtaatttaaaatatcacagctcatggttcacatagtagcatttattcaccaaagtgcatttcatttcttggctaagaaagcatgctagtgagaattgaacttcactctttcaaattaaagtcaagctcaaaagacaaaacaaagagcactgtgtggtttatctaagagagatgtggaagagaagcagaaaggttgtaagagccagtggggaaggatggtaccaaggaaacagaatcttccagacacagctggactgatgcacatatggactcatgtaaatttactgtgacagtatgcacagggcctgcacatgtctaaaacagatggggttccagagttgatgtgggaatgtggacaagagctcctattctttaccaagaagctatcattaactgacaactgcttacaaaggaaaacatctctctccaatgaagtctcatcggatacattaaccatgcttaaaggcggcctcatgctcagcaggtggtgtccaacataaaacaaactcaatgataatttcaaagatttttttctcatcttgctttatttgggcatttttcatcttactagtcttttgcttctaattttgtgggtttttttgcttttttctctgtgtgtgtttctcatgatttgtctctgattgtttttaaattctggtttgtttgtttgtttgtttgtttgcctgattttttaaataaaagaaaaatagcatggagctgggtggataggaaaatggggaggttctgggggggagataagtgtgatcacaatatattgtaagaaaagattattttcaataaaacacacagtaaataagcatatgtaataataacaaatgtgttgtcacatacttgcttgttatctacatgccctgaaattgttcaacttagctggaaaggagagatgctgtgattaaatgtaacacctgacagtgctagagacctgaggtttgtactctgcccttctctttttagagagagggtcagattttatgaaaagaggagcaaaggttatgctctggaaatagaattgttacattcaacttagagaagaggaagaggaggaggaggaggagggtggggaggaggagaggaaggagaagaaggagggggaggggaggaggaggaggaggagaggagaaggagaagaggagaaggagaaggagatggagacgggaaggaaagaagaagaagaagaagaagaagaagaagaagaagaagaagaagaagaagaagaagaagaagaagaggaggaggaggaggaggaggaggaggaggaggaggaggaggaggaggaggaagaggaagaggaagaggaagaggaagaggaagaggaagaggaagaggaagaggaaggaagaagaagaagaagaagaagaagaagaagaagaagaagaagaagaagaagaaggaagaagaagaagaagaagaagaagaagaagaagaagaagaagaagaagaagaagaagaaggaagaagaagaaactgttcccagaaaaagaatccataaaggaaactgtttaaatactacaggaaggaagacaaagcctgcacatgcctacatgccctgcacaggcaagccagacagtcagtgacacccagctcccatgttaagccttttctgctccagccctcacaccactggggaactcagtctccctggtcttcccatcacagaagccattcctgtatcccagagctgtacaggtatgaccaagaccccttgttcattttcaaaggctcacctggtggtgaccacattagatgtcagatccatcaaaatggcattgcagtagctcagtgttaggatgaaatagcttcagtttcttctctctctccctgacagcactccccaaccctgctatttctcctcaacacgctttacacacacacacacacacacacacacacacacacacacacacacacacacacacacacagagagagagagagagagagagagagagagagagacatgcacacacaaccatgaacacataaacatgtgcacacgcacacacacacatctgagaactggagaagttgctctatttccccattgaataattcattcaactgtggtttggaatatgccaaagcaagttctaaccaaatactttatctctgggtttgtcttccacataatgtatgagtcacatttggaatcaaacaacttaaattttctgtctgtagatcattctctcctacaggttctcacatcaggaagtctctttgtccaagtctacctaagtctctttgctgggcctcaacagccatgagttctttgaaggttactctgtagctgttgtgtgcataaagaaagagggaaaaagcaaggctcgggggtgagaactaatgtcatcattccagtggctattagtagatcagataagaaaaacatctatttaattcctaggtgaggtgtattgtcgttccacagtataagcattgattgctgcctggatactggtggcttcatatgttattctgcctccaccattgaggagtagcatttgtgcgtaggtcttgtttgtttgtttatttgtttgtctatcttaaagaagctcctgaaagaacataacatttttatagaaaggactacaagttagcattttattagattgtaatctattgcttaattgagacctgaaaatgctctctgctgatatagtgaagtcaaaaaccaattgtgcttacttccaaattctttctagttgtggtcaaattatgccacggttcattgtgagattttgggcaattgcttaatcataccaagctcagcttgtcctggttttaaaaaatggagcttttgatttttatccagtatccaacctgtatgcacctgaagcaaaagagctcagcagagaagacacaaaaccttccccaatcttcatgcatattcttttcattaaaataccattagttgctgaagatgaacaatgcttgcaaaccagtggtttggggaaagctccagggaatagtgttttccatgcacagcaagatgtatttaagatgtcacagtggctgtaacagtgtgcaaaagacctgtgcaagcaccaagagacaaaataccatcatgacggggaaaagacacgcacagaatcccatcaatagccaaggagctattagttgatagctgctgggaaagagaaagacatcttttttaaaaggggaggggttaactgtataccatacataccaggcagacccaaataccaagacttgctggataacacaaacagaacttaatcaagaaagaagaaagaaaagaagcaatctcaaagttgggtatgaagggactggagtattgaaatggcggtaaaagggcctcaaagaagtgaacacattcaaaatacaatgctgcatgaaattctcaaagaattactaaaataattgttaaaatacaatgtgggtactagagatatggctcaacatttaagagcactggcttctctcttagaggaactgggtttgattttcagtatctacatggtgaaaactgtaactctagttaaacagaatccaatgccctcctctggcatccctaggtcctgggcatgcatgtggtacatagacttaaactcaggcaaattcttacacacataaaacaataaagtaaatttcaatttacttaaacaaacaaggtaggctacacttgagaggcaacacccacatatgcaccatgcatgcctttttactcacacacacaaaaatattcactcacgtcataaaagtataattttatttgtattaaagatcctaatatttacatataccttcaagtacaactgggaagacatattatcaatttttacttttatcataatgtgtaacaccatagggtacaaattaaggaagaagagtgtttcacagctaaagaagaaagacccagggttgtattgtagagtccctggctaggatggaggggctaatgataaactctgaggtaaataaatggggtcagaggtgctgtcattgctcagactattgtaactattattgctatatttcaaataatttccaggtataccacctggaaagagtggtatgtcagagtcacagagatctgaatatacacaatgggaggtcaggcttaacttcagctgtgagtttgagcaggagttgacttttgtttatttatgtaggttgataatttcaatgttggtagctaagtgtacaaattccaaaatttcataaatgagcaatatatggaaagaaacaagggaggggacttgagagcatggcacgggctattgggaaggaggaaggcacccaaataaaggaaacagaaattgtgggaaggagagaaaaatgttaagtccgtggacatgatagtggtagggtatatgcacacataaaagtgtcacactaaaacatatccatttgtacaattagcacctgctagtaaggataaaaatgaaatgtgttgaagctctatataaaacacaaattacttggataaaaggttacactgacaaagccaataatttccacactaaaattaaaaaaataaaataaaaacaaaaacaaatatccttcctcttgatagttgccatcatgagtctttggactggagaccttgactttctctccatcatctgttgccgtcacacagagcacagtggcttcctctgtggtctctgcagggaaaatgttgcactgttctgccgcagatatcactcaagccatgagcagagcaggaaccgggattgcgccacgctagcatgctagcacgagcagaacgccctgaaggcctctcaaatgcgtcatcctgcattgaccatcccatgaccttgacatcccatcatcttttctcatgaggactatgctggctaagttttgccaacttgacaataaagcttagacatacatgaggagagagaatctcgattgagaaactgcttccatctgactggcctgtgggcaggtctgtggggacattttcatgattagtgattgatttgggagggcttatcccactatgagtggtgccacccctgagaaaataggactgagctgtgtctgaaaggtagcaagccaaggagagcatggctcagtggtctttgctccagttcatgcctccaggtcttgaccttgagttccagccttgccttccatcaataatggactgcagcctgaacactaaagaagccctttccttctccagcttgattatagccatgctgtttatcacagcaacagagaagcaaactagaacaaagaaagagtgcagaacctaagaaatccactcattagcaaaagtgaaagtcaagaaagaactacggggaaagtgcattagaaaaatacctctggtttgaaacctaggaaagaacacataaccactctaagctccagcttcttgccccatagctagagttaatagtccttacttcaattgtgcattgaaaatggtaaatcaacagatataggcaaaaagcttgatctgggtaagttatggaactggtctgcaatatggcggccgctgttcagacaaccttgtagatgtctggtataggctggatcaaaaagatttgaagtgaccaacatgtcctcataattttgatcatagatgattcagatttagtcaatcttcagggggcttgaaggagtattattgtgaagtatttaagttgggattgtctccaaaacaccccccaaccagtgggacatgaggtactattaaaaccgaactcccctggctttccagacacacttagccaggaccatgttatcaccagccaatctccagaccaaagactttaactttacccctgtagtaacttttcccaaactgaaagacccttattctaaaaaaggaaaaaaaagtgatatactcaggctttttaaagagacttcaagcatcattaccaatataggagttaaaagttgatcattccaaaaaaaaaagaaagaaagaaagaaagaaagaaagaaagaaagaaagaaagaaagaaaggaagaaaggaaggaaggaaggaaggaaggaaggaaggaaggaaggaagaaagaaagaaagaaagaaagaaagaaagaaagaaagaaagaaagaaagaaagaaagaaaaaagccgggctctggtggcacacgcctttaatcccagcacttgggaggcagagacaggcagatttctgagttcgaggccagcctggtctacagagtgagttccaggacagccaaaaaaaaaaaaagtagtaggaaacactaacttcagtattaaaaaagaaagaacgaaagaaagaaaggaaggaaggaagaaagaaaactgtgtttttccttgttgcccttgaccctaaaactctgatgaagccaaatttttttcttcatatctttggtgtgccagaacacactgcagcagagtgtgggcataggcttgaccgtaacttcttttgcactcccagtgtgatcagtgcagtgataaagggcaaaactttgccatagcacttttttctaatgacagacagacaaaaatggggtggatcatgatgtgaagggaggtaggaaggaactgggaggagtcagggtatggaattccataattaaaatacattgtatagaaaaaaatctactttcaataaaaaaaaaaaaaagtcaattccccacaggcttatggaagccaaacccaatgtaggtaagccctcattgagactcctaatcccaggtgagtctagcttctgtcaagttgacaactaaagctatccatcacataaaaaagtttaaagtctgaaatttaataaaattatgcaggtagaaatgcaaaagaatcagagggaaatacagtccagctaactgtggaatgtagaagacagggagcccatggaaaggaagacgcacagttaaagggggagatgaacttcagcagaaaatcatttcaaaagcagtgtgtgaacaatgatataaaacgcagcagaaaatgcagggggggagaatatttgaaaaggctgacagaaagttgcagtgagaatttccggattcttcgtgacctattatgctttcagtcaatgtagacttgttatgacactgttggatcccttccacagataacccacctttgtgtttctgaacctactgcaaggtcactgttccccaggtgggttcattgttatgtcacaacaccctcccgccttcctatcacctatagcctaaaagactagggtcacactgctctctagtttgactacctaaagtcttccctactatcacacatagagaagagctaccaaaacagcaagcaagcaaagactaagaggtcatattcagttggtactcaactctggtgcttgaagcatcaacaaactttagcaagcattctgtaaaagaattgagctcaacggcaagtcctttctatcactccacttcttgagaaaacattaaaaataggaggtggaggcagagaggagccaaggtccaagatcaccttcagctacgtcaggaatgtgaggccagcctgggctacatgaaccctagtctcaaaaaataaaaaatgaacaaagaaatgaagaaaagaagaatgaacagaaaccacaaccaatctggataaaatgtatagggtaccatgtgttatggatggctatgctggcctttgaaggaattcaagcactctagaaacatcacatttaaacaacttaagacggaaatccaaaactctacccaatctgatcacagctttcttctctaagcattatctgtttctctctccctcttaaccattccgtcgataactcagatttaaatgagtgacaagcaagtacaacatgtggcagacatccagacaatcatgacaccaagtgcccaccagcctacctctctgttaaccctctctgcctctgatccttagctgacctggttcctctcctcctcctcaggaggcctttgctgtggtgattaaactcccatataaaacacctggtggagtgaatgcaggtgtctagatgcataccaggaatttgataagtggccgtgaatgatgaaggtcgcagtaagtcatattttattgtccaactgaagatgagtgtcacaacacactctcatgataaccctggcttatggctcaggctgatgtggttattataatatttggccttgattatgtattatatctattagatggaatccctctcatattaaatagataaaattcatattagaggtggtctcatattttttgccccccagaatatgttccgtagcacttaatgatagtagtaatttctgtatgaatgtatgtgcaaatttggtggacctaagaaaacatctatagtgagtgggcagctgtggtcttttcattgccagaaatattaatgcttatggtagcccaaatggaaagtatgtggtcatggattctccttctcacacagccttgacggtaccttgactttttaccacatgggctgaattaaatccattcctatcagaagccaaagggtggactttatcttcattgccccaccagctcatcaacagaacacctccagtgcccaggcctccacttttgcttttctagctatagcctatgtgagagccaagccaagactttgcctctggatactattaactggactattctggaaatcagctgggctgacgggtttctggcaatagatggttttggcttatggcttgactatgcagagaagtgattgcatcagtttgagaggtaatcagcaaataatgtcagagggaaatacatctgtcttctttgatggtggtactggaaaccaaaagacaaatgacaatctggaaatagtgccctggtagaatccgtgataatactaggaagtaccttgaatacacaagatggaccacacatgtaccacccctggcacagaggaaccagtgcctaggaatgataagtttcccagtatgactaactttttgagtgactatctctcgagtgactatctctctgacacttttcccctcgtggtgacaggaaatgaagtgtcaatgcaaggaaacacttgagctgttctgaagctcatcttcccttaacaggttttctgaggcacaagcattctctgcagctcaggaggctcactatgttgctagttcccactctggggagagaacaaggatcaaatgtgtggggagactcgggaacgacactccttttggtcactagatttgttaggtgtgtagaaattatccttgactctgtatatcagaatgcacttctaattgccaatgaggcaagagtaaaaactcctcattagctactaaaaaatccctatttttcaggaaaagtcaagggatataatggtccactttaaaagatagtattgaaaagaattttaaaattgcttccaactgagacaatggctcagttagcatagtggcttgtagttgcaagcatgagcctgagttcaaatccaggaacagatctcaaaatccaggtaccagattcctgcttgtagtcccagtactgagaagaaggagacatggatggctgggactcactggccagccagcctagcctaatgggcaagcaccaggtcaatgggagaccttatctcaaaatcagatgagaggcattcttaaggaacaacaactaaggttgtcctctgccttgccacatacacacccaagtatgttatctatgtgcacacgtgcattcacacatgacctacaagagtcccacaaagagaagcaacagttttagtgtggatgattcaagacctgcactttcctatggtcctaacatgcagttttatactaaggaagatgttaattccatcagatggggtccctctattgattccagatgaagcttcagtgtaggttcccttcagttgactcataacctaaggtataatgaactaattatccagcaagtgataacgactttcactcagacttctcactcagactttaattatccatgtaataaaaaaaccaggagttagccaaatacctctgctcaggcaggcccagaaatgcactgagggatgtaaggggagggaaagaaactaccctgcctccccatttctaaacgtgctcccatgtaatgtggtgagcagaattcacctccgtgttagactgtctgggtacctgtgagccttggagggagatagggagggacacttttaagaaacaagaccacgagggaactctagcttgcttgatttatgctgtgaacaagctctgaattaaatgagtgaagacagccctagctttgcgaatcaccaggtgcaataaaataagctttaatttctggtgcttttgtgggtttgattttgttctgttttgttttgttttctgtaaaatgaagaggtttccagaaaacaatcttgtgacctcttggctacacatctagctgctaagctctaaacaaagagcagccattattctccactgtaatttcactatataatacaaacttctaaaacatcaccactgtcaataaacactaaaaataaaaaaaaaacaaaaaccaaaaaaccaatgcaacatttgtagttggttcacataactcaaggcaaatgctcctctctccctttatgtttgtcttgctttgttagatgggattactccactggtacattaagccgttgttcttttacaaaggacatatgaataaccagtatgtcagacatatccactggaggcaacataagtcactatgtgagaaaaaaaaaacaacaacactagactaaatgacaaagtttgtgattagagattaagaacattaaaggaattctgggaagaaataaaaacaaaaacaaaacaacatacaaaaagcaaacagcagtcctcacaggcattggctgaaagctcgcactagcccaagcagaaacaaaagagtggggcgtcatttctgagtttccaaattcccctcttcagtccctttccaaacttcaacaaaaggagtcatcatttatcacatttgcatgtttaagtcttcactctcatattgtgcaactaaagacaaatgcccaaagaatttctgacactagaaaatacgtggtgacatctttggcagaatatgaagaagcagggagagttcggtacttctggcattgccctgaagctgaagtgtcctaaactgggggcaaggatgacagcaaagtccttttacacatgcataaggacctgagtttgcaacccagaacccatgctgaggaggcctaggtggagtacatctgtaatcccaaaaaccagggatgcagagactggtgacgcccttaggcttactggccagccaccttagactagttagcaagctccaggtctgagtaaaaaaccctgtctctgaaagcaagaggatggcttgtgaggaataacaatagctttcctgtgcatgtacacacacacatgtacaaacgcacacatacacagacgtacacataggcacactatcctaagctgaaactgcctatacgagcttttccatacctagtagtccaagtgttgaggtaaaattagaggttcaaaatacttatctaaataaatgaaagaggtacctggtttagtctcatcttcctgcttctgataccaggggtcagggtcctggatttcctttttacttgtgaggcctctactccagaacaaggcaatcccaactccctctcagtatgctgacttatcaccctctcccagccttacctccagattacttcagtgtttaagttttctggtcatttagctctttagtactgatcttattttctgagcaggactcatgtctagtctaccatctggaaggaaggaaggaaggaaggaaggaaggaaggaaggaaggaaggaaggaaggaaggaaggaaggaagggagggaaggtaggagggagggagggagggagggaggggaggggaggaaaggaaggaaggaaggaaggaaggaaggaaggaaggaaggaaggaaggaaggaaggaaggaaggaagggaagggacaagaatatagaaagtttttcgaagctatattatggataggatgtcagcgatgccacaagatagaagagtgagcagcttcaagtgttgggctcagtatctaaaagcccaccactgactagataggagccaaaagcaaggaggagagaagctcactgaggctgagatcttagatttgcgtatgatcgcatgaatggcagtgttgatgtagtgagaaaggatagaacagcagagaaaactccatgtaacagctgaagcttgtattaggagcttaaataatccaaggaaaatagttctacagatattaagtgcagccattgtatttctacatataggcagtcatctatgaaaatatgacgcaatgctcagtcaatgcagaagttgtaacatcctaatatactcaaatttcgtgtaacttctcttaaatggcaacgctaaactgagttacttggttttcttgtcacttgtggctttcaagttgtggttgtctcaagtaatgtgaggcagcagtgttgaacttttacactatctgatctgtctaatatccagccccattttcatatcccaaatattataagaaacattttacttttgtataaatctctattattcagtgccttgatactttgctggtattttgaaataaaatagaatttaccccaagaatttttgaaggttttacaatccctaccactatagaccatatttgttattgtcaagtaacccctgtttgttaaagtcagctaagacgtgtttgaaccttctgtgagtagccttctttccccagtccacccagtgtgctcacctatagacaaatacaatgactactactgcaacctgtacaccaaccaatggtcccatgcaatggcacacaaaacctcattattgagagagacctctacataatccagacagcatccttcccaatttgtagatcaatacttatgcagacccttgatgataatgctaaaagaagggaaaatgtataaccaacatgccagatatgcaatgtgcttagaagggaaaacgttgaaaacatataatatgcagatttaaactctgttcctgaagaccttagtctgaacttggtcagagttaaactgtaagtttgctgatgtgaatatactataactgctccatccatttgcctgcaaattcatgatacctttgttttttaataactgagtaatattccattgtataaatgaaccattcatcagttgaggcacatctgggacatttccagtttctggctattatgaataaagctgctatgaacatagttgagcaaatgtcattgtgggatgatggagcatcttttgggtatatgcccaggagaattataactgagtcttgaggtagaactactcccaattttctgagaaaccaccaaattgatttccagagtagttgtgcaagtttgcacttccatgagtaatgtaggagtgttcttgttccacatcctcaaaagcatgtgttgtccattgagtttatcttagccattctgatgggtatgaggtggaaaatatgatctgcctacaagacgtccaaggacaaaaatagagcagaaatggaaggaatggccaaccaatgactggcttaaattgagaccaatcccatgggcaacaatcaatccctggcactattaatgatactctgttatattttagacaggagcctaattatcctctgagagactccaccaagcagtcaatagaaaaagctgcagagaaccatagtcagacatcagatagagctggaagagtcctgaggaagagttgggggaagcattaaaggacccaaagagcacaggaactccacatgaagatcaacagagtcaactaacctggaccctttggagctcccagagagtgaaccaccaaccaaagagcatacacaggctagaactagacctcctgcatatatatagcaaatgtgcagcttggtcttcatgtgggtcccccaacaactggagcagatgctgtctctgactctgtcccctgcctgtgaatcctatttctctaactgggccaccttgtctagcctagccgcagtgtgagaggatgtgtctagtccttcagtgacttgatgtgctgtgggtggagagcagaggatggagtggtgcccatggaggagttacccatttaaagaaggaaagggagaggatctgtgtgatggggtcagggactgggggagaaggggggggtattgggatgcaaagtcaataaataaaaattaatggaaaaaagtagtatgattgaagttagtcattttcttttttacccgttctatttattatcacaactaatgattacaactcttgccttgaatctcaattcattgtagacaaattactctgagatatacttgcatgtttgcatgcatttagttcctatattcattctgtatattcatttataaaggcactttaaaatgtattacatttactgagtttgtatggttgggggggggacgacatatgggtctcagaccacatgtagaggtcaaaggaaaacttgtaggagtctgttctctgcttccaccatgtggatccaagtggtagatctcaagattgtaagatttagcagcaggggcctttgcttgctaaaccatcttaatggcctcttttcaatgttaaggtcaatgacaactcttctgcgattactattatttcccctgctttgaatacaatgtatagaaagtttagagatgttaggaaagatgctcaaggtcacaaaagaaatatgattacagacaacagcaaacacacgcaggcttgcttcagaagacagaagaagagtggagtcgtttctctgagtgcagagcagtattcctagaaacaaacctggagatgctgcttctccttcagagcagaactagtgctgtggtgtaaggtagcaatagaatggcaggaaaatagccaagcagtgacagaagaactaacatggcagcactgacgagaacgacggcaggagggaatggagaaaagacagcagagttacccttccttcacacaggttttccaaatcaaaaactcaaatgcagcatgcagatatccattcctccatgaatggcagcctccgcctgcccagtgagatgccagagtacacagacacaggaacaaggcacgctctcaatacaatgcattccccagtgtatgacgtttgtgcaagggcacaatggatggtttccagctgtgattataaagcgacattgatcctatgagactggaacactgtgactgctacagtttgggcaacatgtcccctgtagggcagcacctctccctgacactcaggaaatgatgggtatgttgcagctaagtctggcctggtatgagttaggaggtgttttctgtcttgactttgaagcaaagtcatgctttcctaagcaagtctaagaccaaaggctcccccaagttctcagagcttcgctagatgccaactacagcacatttgttcaataaacaacagatatgggctgagagtaaggttggtgctctgctctgtgcatcgagggatgccagcaagtaaagacaccgcaccttatctagcagaaaattaaacactgccttggagtcacatggaagccattgccaactctctctctctcaagtgcttgggccaagataattctcgagggcctcactcacagtgtcctgaaatgatctgtgggtgataactgcaattctcagacatctctgtcactagttctctaacctggacccttcagcgtgtgtgtatcagctcgcagtcaagtagataacaagcttccaccttagtcagaatcttttctctgagctgattgatctacctacacatagaatgcaggttttcctggtagattagagcacgagtcttgttttgacacatttgtgagtagaaaactgggaaggtagaaacatacagcaaactagctgggtgccctggaggcactctaatctttccttggctatgggcctggcactctccttgtcggctaaagatatttccctcctagaagcctctctactttcaaaaatacctcctttgaccatgccactaaaaacattgaagcccatcagtctttctccatcctctactttattaattatcatcacctacaataaaacttgttttcatattgtctgtcttctcccactagcacgcccagacgagagcctgtgtgccttctgttctctgctgattgcccagaccaagcatttaggaagcacttaatcagtgtacgttgagttaaaacaaaacaagacaagatgaatgaggcaaacccagttgttttgaagccagagatcagttgtctgagcaggaaggcaaacattagtttgaagttggttctgcccactaaaccacgcagatgttattttcttttcatcctggcagcttgtgcctcgctcccttctcccggggtgtgtttagcctcagagcctcaagaaggatttaaacaaggcttattaaagaccaagatttggacgcctgcagatatccaggctcaagatcagacttgcggtaaaaccacagacaggcatggaatggctgtgggctcccccatgatcaaagcctggtcataacagaaatggaagattatctacacgaccgtgagatacccgggacacttgatggtttcaaccacagctggttttgttattgaaaacattacatgtataaacacatgtgtgtgagatgcacagaggaaaagcttctgctacatgaatatgtttactctaattggctcaattttggttatgtctttctatgtacaaattatacatatatatgtgtgtatagattctgatctctcatataatagtcacacacataagaaatttcaagtccacgtggaagctatttttatttatttatttatttatttatttatttatctttttaggaatagagtgttcatgacttagagagcttgagcacagtagatttgaaggttaaatgtttcacagcctctcgtttcctcattctgagtgacgaaaagcaggaacacagggaagggaaatggtttgcccaacatcccacagcttatcgacatatgttacacccttagagaccactaggcatccacgtttcctgctcatgagtaccgtacaggaatcctagagagacagaaggcaaacccacaccccagtgcaagggcacaagaaggaattatacacaggctcgtcacaatcattcatgcctgtgcactcacgctcatgccccatctacaccaaatgaacagagagtgctcttctcaggtgactgtggaagtgtctgactttacagccttcttgaaactagacaaatacgtcaaactaacagtacatgaagaagagagtaaacgaatctaagttgtagcctagttgtagttgtcgcctgcctttttcttcatctctctacctggttcaacatgaattagttatctcttttcactcgccttccctttgccctctcagtatatttaaatatcagtgtgagagatgattctgacttttcagctttttagttgggtgaggcacctgagctcgtaatgtccagttagcccttcctagggtagctgaagaacacagtctcctctcactctattgtggtccttaagaagggaggtgtggtatgacctccagagaccaccacgtctgctccttaccactgggaaggccaatggtatctaagcaataaagacctgagataatcttagacaccctataatacacacatcccccaactagcatgtcaaaactgctgacatcaaaactgctgatgtcaaaactgcctatgatgtcaaacccactgatgttgagcatgctgctccccggctttctccatacccctttctttataattgattctttagtaggggattttcagtcctccaacacagttcaatgctcaatctccaaagctctccctaggccgaccctccatctgggaagccttggaatcttcccgcttcgatttccttagcagatgcccatctttaaggcgtgtctcatcattgaaagcttactgattgggtggacgcttcactctttctaaatttacaggaagcttttgtcagctttcttttataactgcaatctggaatgatgggttgtagttctaagaaaggaaaagccttcttgttcaaggctgaccagccagtatctagaattacgcttgaactatagaaaaagctaagacatctattgatcaaagggtggattattccaccacgcgccactctaatctttctcctataaggctaaagttgcctagagttggaaggagcttaatatctgttatactgctaaataactaataaataaatataagactataactattaaataaaagcccaaataaaaaatgcacattcaggctgtagaaatcttaagtaacagcccatccattgtaatttttaatcactgcaaaatatcttgtcacaaaatgttttatatttacattttacatttacactacaatattttacatttcctcatcttaaaacaaaagaaaaccactatagtgaacattcagatgttaattatgaatctggagagcacatgagcatatgagaaaaagatacaagggcagttgtagcattagttgggtgtgagccaatgtactgccccaaaatgcaggtttcagatccagcaatacagcacaaaattcacagaagattcagtaaggactatgacaaataaccctggaattatttaaagtaaaatgtgggagatttcatcaaacataaattcttttttttttaagaagctttcgtttattttttaatttttaaatttgtgcattacaggaaacaaaacacaagggcaatctgactgccacatctgtcaccccattgatcaccagggttgatttgactgatctggctggctaggctggtgtccccttcctccctcatggatccatgtgcatctctcctgaacctgcgcacttggttaaagaggacaaccttccccaaatagagcaggactggtctttggttaagagtaggtgcgcttccctgctagaacctccaagcataaattcttaatgaaaatttaccattacaactagtatgtccaatggctccacttatggccatctttttttcttttttctttctctccataatattccaggactgacgccatctatccttggtgtggacttgataatcccttactctttttcctctagacactttgagataagtctcacaccgtaattaatgtttcccatatgttggtctcatacccgcctaagcatttttcatgcaccatctcattaattcttatgagaaccttcaaagataatttgcatgattacccccattttcagattagcaaattcagtgcaggaaacttaagactctgaatagaataactcagattaaatgagtcagagctctttttggtcgtgaatagccatgcatttttaaaatatctatgaattcattcaacatttgaatgtttagcaagcacaagtcatgaaccaggttgtatgaaggctttggagggaaagtggaaaacaatcaggcactcaataatccttctctgcattattttattttctgttgcacaaggtagatcataaccataaactcaagtctgaaaactaagctaagctgtcagaggagctataataaagactgtggcatttctgtgccagaaaagaacattttgcaggagatttcccaatggcatctgaagaacaaatacgaggtcatttttaacacagaactgggctgaaaacccatgtgggaggcattctagaaaggccagtgttcaggggccatgctgagaagggtccctacaccgtcatcagctgctaaagtacagtgaggggacagaaagcctcggggaagaaaagaggacctatggaaccaggcttgttttgagtttccctagctgccagctctgaaagaaagactgggttcaagccatctaatttaaaagtgatttcagagaaatggatgaaggatgagaaaacagagacagggcacagaggacattgataaaagaacattaatgattggatttcaccaggaacagacagagcccattcctaccagggactctgagagaccatgaaggagacagttcaaacacctgggtctgggatggccaagaggctcatggagtcacttgccaaatgcactttggtttttctagtccaggacaaccttgtcccaagagaccacaccagtctcttccttccctatgtctgtatccaagtccccactataggtaggtagaggttatgtccatataatgggggaaaggagattaggcacaacctgggacaccgagaaccagaagttcagcaaacaaccatacaaggaagtggaaaagacagctacagatgagatgctacatgagtcaagactctagagtccagatggtcagactccacttacaagatgcatattgtgagaaaaaaatcactaagaaattcaaggcaacctaagcagaacattcacatgctatctccctatgcaatgtgtggttttctgtgtctgcactggccatagactcataaagtcaaccgttagtctagggcatagagaatggtcccttaggctagtcttgaagataagaaagggcaacccatgtgagcaagggtaaaacttggcatagcaggtggttagatttggtatggtcaggtagaatggggtaaactggaatgaatctattatgcatcaaccaccgaatgttactgagcaggtttttttcttaactaacttcatttattgtatttatttatgaggagatgtgtgtgccatggcatatgtgtggaggctagaggataacgctgggaataagttctctccctccaccctgtgggtcatcagactgggtagtaagcacatttacccactaagccaactcaccagccctggagcatcttttttggagttttgcaatgtagtctgcctctttaacaaagaatggggatgctcagtctacagcttgagagggaaggccatggatcaagaacacacagagtgcttttctagggaacttaacagtattttttttttatttgatgcagggtctcatgcagccaagactggccatgaacatgtaatataccttaggcttcccataagcctctgatcctcttagcctctgcccctaagttctagtactacagttgtccatggccacactggcttccatggtactgcagatcaagcacaggactccatatctgccagtaaagcagcagtctaccaggagcaacccattgctagtcccaagagttcattacaggagataaaaccctccagatgtggaaacaaaccacacctcaaagatgacgcaaaaagtctcctctgccatacataatgtttccaggcagtgtgtgtgtgtgtgtgtgtgtgtgtgcatgcatgtgggtgtctgtgtgtgtgtacaggcacatgcctacatccatgttagagttacataacttcagatctctgtataaagctactctcatatgccctcaagaaatctcaatattcagaagattctaaaacagaccccaattttatattcaagatatgattaaatctgagttttctttcaacaagtccccagaggttgggtatgagctcagccttggcaggagcctgcaaaacaggccttgctctcctccctaaaagcccaagtaccttgtcccaccaggtctggctggcctaatttggaaagctgttctcaggatttgcctgtttgatctgagggtgacatcaaagaaccgatgcaccatctgtccattctcacttttatgtttgctctttattgcagccattcacaaatagaggcttatggaattaataaactcgagaaaggagcatcattaactatatctctgccaggtgttctactggaacaaagagaagtgtggatccagctccaagctttgtggaatggagaaggctgggctgcttttggatagaagcctcatcccactgctgataacccatgacaagtcaccctgtgtgtctctggaagagtctagatatcactggagaggtgcgatatgcacttggctgttccctacatgggagtctaagacaaccatctacttctgaccccagattctctgatgaacaattttacattaacatataaacttatagaatatgggtggttctcggcaatggtcccaaataatccaaatgggctgaataaagtcctggaaggctatctttgaaaacttactgtaaacttaacaaaagtcttagtggtaggacttttccatgcccctctccctaggtgagtagggatgaagtccagactatctgtcctaggtcttgtctctcacctgtgtttccatcaaatagaaaacagaagatagaagagaaaaggagtcagaggtaacagggtggatgactagccttgtagaagtctgatatatagtgggtcctaatgaacatgctggcagcatatcatgaatgactctcaggctcagagttgcaaggagtctatatctgtgagattataacattctaaatcctaccagactttacatacactacaccctaacaagacaagagaggtgctggattcaaagctccaccttgttgtttcattgtttttggttgttgttcctattcatgtttgtgttcttatttttgtttttgttcttgttcttgttgctgttgttgctgctgctgctgctgctatcactgttatttgagacaggggctctctatgtaagactaggctgtcctggaactcacagaaatcagcctgcctctgtttccccagtatgccatcttgcctggcaccttgttgattctatagtaagtacatgagtggttcagtcaatgtgactcctgccagcccagcacagacttcaggcagagtctatgggccaggactccagaattagaagatgccagctttgggaaatcccgagtctcttgctaggtggtggcaattcctactggaaatgaaaagcaggagattagtttcctcttctcccaacactagtcctgccttcacccaaaactcaccttgcccaaaagatctacaagaagacagttgcagaacaactccatgtcactaaagttaaagttgttcacaagatgtcaccataaagaaacacagagctgagactcactgggacgagcttaggtattgggttaaagatagactcaacaatttatgacaaaatgccaccattgtcttcaagcaaggtctgccccccccccccaaggaataagttctgggatttgcagtgttctggttgcagaacccctcctgagacctgctgtttgtattcctgttggttgaagggtccgagaggatcggatccactgtaggacattcacagcacaagaacacaagctgttctgcctctttcgttcacagcaaatttctgatttctggtttctctaactaaatcacttcaaaacaccaagcctgagagtctcaatgcactattctaatacttaggaggcaaagagcagaattatacagaaataagaacattcactctagcaaaggtggcagaagagagctgaaaacagcaacaaaagcaatagctttcatcttcagcttgacaaacattgaccactcacctggaagactttagcactaagtgggaggggggaggaaagagaaagggagggggaaggggaaggataggagggggagggaaggttgagaggagagagggagagaggagagaggaagaggaaaagaggaagagagggaatgaggagagagggaggagagaggagagagggggagggaatgagagagggaatgggaggaagacaaggagagaggaaaagaaaaggaaaggagaggagagggggcatagatatttgaaatagatgcatatggctttaccacccaagggctaatgcctaacaaaaatggtgtgaccaatctctctaatacaaagcctggcacagatgttgctcaaattgaggctaacaaggttaaagtgacccagaactgactgagcagtttcttaacaacagtcaaccctttaagaggaagtcaacttcagaagtaaaccacaaacacaaagaaacgtgtaaccagccaaggcaaggtaattcctgccatttagatttattactattgtcattcctgactgttgtacacagcattttgtttctttgagtttgttcagtcctgactcctaacggcatctgtcagccacatgcgtctttggatcttcagcaacaaagggctagcatggagctaaagcatgtgacttcgtgcacatggctggctgcaaaggctgcctccattcctggggccacatttttctgcttttttcactctggttactgctcatgactggcactaaatgattcttgtcacttggcaacagggaacctgcatagatctgactctctggatctaagctcaggaccaccctgaatcgttgaaggagaaacatgggaggggagggattgatctcaccccaactttcctgtggttagtcaaaccctcagccacgtttaagcaacttagaaagcctcccaaatgtgtcatcatgacttacaataacgccttaacgtttgacaaagacggcgaatccaatgcctggttaatggggaagtgggtcctcgtgttctgctccactgacgttggtcctccaactttggttgtgtaattactatttagacttttcagggccttttcagaaacacaggagtatcccctcagctcccacctgttaagaccctctgctaaaccaacagtgccacagaatcgtatcccgtttctgattttagccaaaggatgttcccaaccaaagagacacatattagcactataagtcttgtttatttgggggcatccacatggagacagggggtaaggaggaggtataggatgtggagcagtagaagggtggaagggggtgcagggaatggaatatggaatgtaaaaaaataaattaatttaaaaaaataaaaaaccatatacattattaggttcataataaaaagctgagccttctcttttcatgctgattatcaggcaccaggatctgcagcatatttcctgcagagctatgagttgcctgcctggaatcagagacaggctcaagaactcaagcttcccaggtaagctggatctcaggcaatggagagtgcctgcagcagttcaccacagcttccctccaaatctgggaaacaccagttcaggaacactggcgtctttttgtcctcatacggtatctaggaaggcaactgcagtgcacaaaatgagcccctggcttaaccacattgcctgggaatagaaaggatgcccttggaatcctaaagaaggccaccccaaagcttgatctccagttgcatgcatcaggcaagtagacacaggtaacctaggagggttagcacttgaaaggagttccttctcccgtgtcattttgaatgttctggcttccttagccacaacccaagagaagcccaggagccatcgatctgaaacatttcaaaggaagactagatttgtactagacccttcatgtccctacacagtaccctacccacaagcatttgggttgggcagcccaccatggccagtgcgatccctaggctgccacccaccctaagccccttgtggttttgactacaccaagtaaattttcttgaaacatccttaacacttctggatttctgctttaatatcaatacatttattttttactaatttgcttgagaaatagtctgtattaagcaggagtttgtttgtagctctcatattccaaataccatgtttgacccagaatatgatggagtggaatttctggagtttgccatctactctggaaacaaattaagacaaatcaatgatcataaaatcgaatagtcacatcttaagaggttccatatgcaccatgttcaactgtgtgcttgccagagcctcaatgctggctgacagagtagccaggacagttactcggtgggtaagcctcaggaaacatctacagtctaaatgtttctagctgcatttaatcaataggaaaactgaacttcagactacaaatggatgagctcaaatatggaacctagtctaactacagaatccactttgttccacttcaatgtttctaaacagcaagtgaagaaaagagaaagggaaaaagaaagacacgatatcaaactcacatgcatgagatgttattgtcttaattgatcaacttcagctcatcttttaatattcagaaatgtctcagtcacaggtgaggtgctgtaagatagtcgcactaactcccagcctgtggaatccagcctctcagagtcaccccaccccccattctatactctaatgttctctctaaagcatctatagccacacactctgaaaacagaactagattccaagagcatcttttagcttcccaggtgatggatggcaatgaggagctgctgtgtggtacccaagatgccctcttgaatactcagtaaaagcaaacaacgtatcttatacactgtcttagtcatggtttctattcctgcacaaacatcataaccaagaagcaagttggggaggaaagggtttattccgcttacacctccatactgctgttcatcatcaaaggaagtcaggactggaactcaagcaggtcagaaagcaggagctgatgcagaagccatggagggatgttctttactggcttgcttcccctgccttgctcagtctgctctcttataaaaccaagactaccagcccagagatggtcccacccacaaggggcctttcccccttgatcactaattgagaaaatgccttacagttggatctcatggaggcatttcctcaactgaagctcctttctctgtgataactccagctgtgtcaagttgacacaaaactagccaatacatacacacacacatgtacacacacatgcacacacacacaaacaaacaaatccaaatacgtttcttggctgctatcttaaagcttacttctatccccaatttctgggaagattattcctacattgtgcccttaggaggaggtgtcctatacacacctaagttgtaaactcctccaccatggataacacaccacctggagatgactcggggagtggagaggttttctctcaatgtccaccttcccacataatttgtaacctgatacttgaccagcctttaattccatcatagattctgctttccagccatcttataaataaacacacctagttcaaagaggtgggtttttttttaagataacagaaaagatacctttatttaataatcttcacacctaggtactatataacctggacattttatcctacttaaaacagacaatatttccactggaaaactaaatagtcactgctcagagcctgaggcattgggaagagagattagaggagagaaaggcaagtgttaaacactaaggcaagaggaaatgaaataacctcccagcatcttagccccagaagctgccgtgagcctgtctggggcctcagccacaggaaacgccaaggctattactcgccttcaccattgggttgtgttttattgctattcattaaggagatcgttcccatcagccttatcatccccttcttggctctccgtccgtttgagtcagacctgaaacatttaccttcacaaagactgtccaatcttttgtctagacacatacaacttctactagaactctgctgagcagggtcagagaaaaagctggtaaacacatagactttatgtggcagctgaccagtgtggacatagaagtaagaacagaggagacagaaaaggggggtgggggagctagaaatataagtgtgcaggggagctgaaaacacaatgaaccctctttgattgaaaagactgagcagagaatttagaggacctttgaaagagcttacaaatctccactgcaacttggtctcaaagacctccaggacctttgctcattctgttgcctctgccaggatggctgtagtcctcatcttgccctccttttcctgcagccaacttttctttattctgcaagttgtattctaaagtctgtgtcctcaggaaaaacgtttctagctaatagctcaggtagactgccagtgtatcatctcatgactttgccagtaaagactcacagcactgtaattaaagggtgatgtctacatggctatttggagaatgactacctagggtcattagttgctgagtgttttctaaattgtcttataatgcacctaattgcaatttctaagtggtactattacaaaagcagtgtacatggttacactaaataattaatgttatctccctggctagattttcaactccttgatggcacaattgtttaggcctgtatatctttggatgcctacccacaacctaacactgcatccaacatgtagttggagaccaaaatgctacatgttacatgagagtgatctgtagggctcccaatataaaaggggagaagacagtgagaagttaccctaaagatagattgtgcctatttaggatggacatgtggctcccaacatcacagttgccccaaagactaataagaagcctgttctgatctaacatccccaacacagatttgacagattcttattctaatgctgctttgatgggcaaagaagaaaaaacttagtaatctgcttcattacacaatggtagaaacacataaatacttttgtttttctacaatgttagcatttttagtaacagcaaattcacaaaataggatggtttccttggcagcaatttcccaaatcatgctactttctttgataaccaaccaagacaaacctaggttcttttattccaatcttaattactaatactaactttaagactgcacattcattacacatcacacagttaatatacccatatatgcatatgtataaattcctatataaaggatgaggaagatgcagcagactttaaaaagtttcaaagaatcctgaggggctgaagctggggactaattgagctttaaagatagtatctttgagaacaagataacaaacctaggctgggatgatgataatgatgatgactacgacgacaatgatgatggtataaagtcaggcctcgggatcatagataaactaaagaagctaaaagcagatatactaaatctaatagaagagaaagtggaaaatagccttgaacacattggcagaggagacaatttcctgaacagaacaccaatggctcaagctctaagatcaacaattgataaatgtgacctcatgaaactacaaaacttctgtaaggcaaaggatactgtcaataggaaaaatctgcagcctacatattgggaaaagatcttaactaactgtacatattacaaattgctaatatccaaaatatataaagaactcaagaagttagactcaaaaaaaaaaacccaaataacccaactaaaaatggggtacagtgctaaacagagaattctcagcagatgaatcttaaatgtctgagaaacacttgaaatgttcagcatcattttcatcaggaaaatgcaaatcaaaacaaccctgagattccaccctacacctatcagaatggctaagataaaaaaaaaaactaaagagacagaacatgctggcaaggatgtggagaaaggggaacactcctccattgctggtgggattgcaaactggtacaaccactctggaaatcaatctggctgtttctcagaaaaccagtaaaagttctacctgaagacccagctatatcactcctgggcatgtaccaatagatgttccaccataccaaaggacatatgctcagctatgttcataagcagagactggaaacaactcagatgtccttcaatcaaaaaaatgggtccagaaaatgtggttcatttacacaatggactactattcaagctattaataacaacaagatcacaaattttacaggcaaatggatggaactagaaaatatcatcctgagtgaggtaattcagacctaaaaggacatgtatggtatgtactcactggtaaggggatattatccataaagtataggatacccatgatacaccccaaagacctaaagaagttaaacaagaaggaagacccaaacaaaggatgtatgaatcccacttagaagggagactaaaacagtcatgggaacagagggaggaagggaactggataggaggagggatagggggttggggggttagaatcaggtgtggatagagacataagagagggccaggagaatgaatggaaatctggagctcccaggagttgggggagatctctagaaaatcccagaaaccagggatgggggtcaagagtcacccaaaagtcaatgtggatgaccttagctgagatgcctgacaatgaacctggacatggaacgttaagagaccacttcctgtagccaggcaagaccccagtggagggatcagggcaccaacctacccaccaaacctttgacccaaaacttgtcctctctacaagaaaagcaaggacaaaattggagcagagaatgaaggaatggccaaccaatacctggcccaacttgagacccatcccatgggcaagcactaatccctgacattattaatgatattctgttatgcttgtagacaggagcttagcataaactttcatgagagtaaggataatatccccttaccagtgagtacataccatacatgttcatcagctgattgaaacagatgcagatacccacagtcaaacattgaccagaggaggttggggagtcttatggaaaagttgggggaaggaataaaggccctaaaggggataagaactctacaggaagaccaacagcaactaacctagacccttgggggctctcagagactaacacatcaacaaaagaggatacataagctggactggacatgtgtagcagatggtcttcttagtctccatttgagtctcccaacaactggagtggaagctctccctaaagctgtagcctgactatggaatccattccccaacagagctgccttgtctggtgtcagtgagagaggatgcatctaatcctgcaaagccttgatgtgccagtggaaggtggggtaccgaggagaccccaccctctcagaggggagagggaatgggaggaggcactctgtgagggggggactgggatgggggcagcatttggaatgtaaacaagcaaataaacaaataaaaacataacgtcctcactcaacaaaagaagaagtggtaaaggctgtagaggcaaaaggcagaatcaggttcagaggaacagatggacaggtaaatggaagttctaataaagccacttcagcagtgtggaccaagctgagtcaaagttcgtagcatagcctggagttctgtgactactgctacctttgcacacatgtcaggtggtcaggtgacaggtcagaggggtcatctctatcatgtgggtgtcttcctcttcatggggttcacatgagtgagtttcatcctttcctcagtctgggtatccaggcagtactcaggtctggtttcctgacatggttctagtggtccatgtgctcctacagcaccaggttacactggtcaatctgtagagtgatgcccattctactcttcagattaagttatggatcagtctgtgctgcagaggtggtgtggaacagatggcttttgtatgtctatccaggtgcagggtcatcctatagtctcaaaatggagtcaaatgttgcttgtaaaataaagtacctaaaggcaaggtacagtttttaaaaaaagtcactactttgtacaatatggagtgacttaaggcaggacatagccttatctcagctccctggtcctacaaatttctagtctgaaagaaaaaatagcctttgattatttcaaaaacttttgaacttcatattttaacgtgaactcactaagaaaacagaactattattgggtagtgaatcagagtatggtctatgagccatcttctctgtggtgagccatattacagctgccatttccccaggatatcccgccattgagcaaactagactgtacatgttgctgggtagatttgagttccaagagatagtataggctcaatgaagataactatgactcacacattctttaacaagcccaatgcccagctgcgcgacaaaatactgagatggacacatgccacatgttaagaggtctattacggttaaagtttgaaatgtccccacagattcatattttgagtgcttggtccacagctgatagtgatagttttgaagactgtggaactttgggaggtggggcttgactaagggaagttggtcgcttggagtggggcctggttcctgctccatgcgttttgcttcatggtcctttatgatgtgggtagtctttgatgcatgcttcccctgctaggatgagtccagaaatcctttctctgctgtgatagactaatccactaaaacacgagccaagacctgtcctccatagggttgtttatgtcaaatatctctcatcacagttataccaaaatgactagtacatcatgcctgaaaggcctcctattacccaggagtgtccatctctagtttactttgcagaagaggctcactcaagggctccagtctcagcaatctggaagtatccccaccttcatcctctgatgtaatccaacttgataagtgtcctacgccctattgccccctcataaatccctcctctagccatcctcctcccttctttatcttcaaaagagttacataagtacctcctcctccagatagtaccctctacaggccttttcaaggccaaatatatagtcatttcatatacacattttcattaacagactgtcagggtcagctctttggggatcttgtataagctcagtggaagtatttaatgacatccttcatcattaaatacttttcaaagcctgttagtttaatccacattcttagcccatacatcaatgtcaaaacagtgagcttctcaaaagctttgagcatggatagcctcaaccactgtgctgctggtagtgtgtcagctttaattgtttgaataatggagtctgtgatgcttaccatagtatctagccttctctgtatgaaaaagcaggttacatcagtttaggatagggcctacaaccatttggaggtacagcacaaagttcataatgtgcagaaaggattgtatggaaagtcgattcaaatagataaagatgagccagttcctctgaatacagtcctagaatacctatgtgcacttggccaagaatttgctagacaatgtcctcatgcatcaaaagacaaagcctgccatctttgcagcagtctggtaggaggatccatccataatgagagggttcttttcttattcaacacaactcgtctttttatccatgctgtgctatgtaaaaccaccaaatcctgtttgacagggactatcttccagtacagtcccatccactgttcatagaacaggcaaagctcctgggactaggcctcctgcctatagaggctattgtgaatggtatcagttccctggccctttaattatggaaggtggagggagagacagagtgtcaataaccttcagtaagatgatctgtgtatgatctgtagtggttaccatgccacctgaacaggccttggcgtccagtgttctatatactcaggaagccatgttgccctgacccactcatctcagtattcctagagagaagtagtatgtaagaaggcttaagttgcctgttgcataagaatctcaggagagctgagtctgccttcccttcccttccctcaggacatccttgaggagttgtctctgccaagcctctgttgagtgtgcaaccccagggaacacatctcagcctttccttttgctaccaggttagcttcactgaatccttcatgagcatagagacaatgaattttggttgacagttaaactacattgagagatgcctagaaaagagataacatttactggtaggtgtgtctgtgaggatatctgaagattggggtgtgggtcataaagatgagtgagaaaaaatgcagatagcaccatctaagagttggaggacccagatggaataagtagaggaaaagaaagggaaggctctagtgcagtggttgggtcacaacccatttggtggtcgaacaacccagtcacaggagtcacctaatactatcagaaaacacagatgtttacattatgatccataacagtagcaaaatcacagttttaaagcagcaactgaaataatttaatggttagatattaccaaaacatgaagaactgaattaaagggttgcagcattaggaaggttgagaaccactgctctagtgtagaacacaaaagtgagcacactattaatcacagctgtcaccagtggataacagacttagattcttgagccattaaatgcagatttttcactacccagtaattttccaggttttctcaggcctttagtcttggctgggggctacaacatcggtctttcttgttacagcttcttagatcaaacagctaacgaccagctttcctggctcaccagcctgcagatagtctttgcaggtctaagcggcctgaccatgtaagccaacttactaaatcctcctttaattacatgtatttcttttgggtctgttccactagagaaccgtgactttatgtcaatacaaccggagggtgagggacaggcatggggagggatgatgttggggaagagtgaagaagaattcattccttccacactatcactaaacacaaactcagccatttaggagaaattaacacatcaactcttttaaaaaagccaaaagcaggttttatgtgcatctctttaggaagaaacttcaatttaaacaaaccaagttgagtttccaaattcacacctagaatataagcgaggatttaattttgtgtctttccagtttctaaggctctggttttgaccctgaaattttctggggccaggggaagaaatcaagaagggctgggaagtcttctaaactgtatgccaaactccaagaaagatgagagtgaccttaaaatgtcagaaccctgatcttggctcgcacctataatcctagtactcaggggactgacgcaggtggagtttacgagattaggggcataccaagctattcagtgagttccaagccaacctgggctacagaatgataccttgtatcaaaaacaaacaaataaataaatcttaaatcccccaaagtgtcaacactctcattcttgctgggaactcaaacacaacagtcttaggttagagcctaaacagtagactgtctgactggacaataaccataaacagtctttaaaactcatcttacttgtgtccgtgggagaatgaaaacataaaaaatcaaaccaaaaccatagcttggcaacatttccagcaatgtaagagggttaaataaacatgactttgggtcagagaaaacaacagccggttcagggctgaggggtcttcaagacacagtcatgtgttgagaagtatcagaaggagctgaagtttacaaacactaccctccagctttgcggtaaaaagccagttggggtgggtaaatgttttgaagggaattaggtatgaccgagacaacaaagcagggatatctgtatgtacacttccatctcccaggtccccacaggatccatgctgctggtcagtctcccacatgcagagggcaggaccctgctgggtacgctcaactgccggatcacatcagagagcataccaccagagtctgggactctgggccacagaggggtcattgagaagccgtccaaaggcagtttgtgtctcacgtggatttggcaagctctgaaggtcacatgtcagcttgccctaaagcctgcagcttccgctatgaacttttcttcccctttcctcaactccctcccaccacaggctgcaaagagttccgtacagtctcctacatcaaagaatgccttttgtttaaagagtggaagccactccttctgtccctctaccatatatggcttaagaaagtgaaggcaggatagaaagcaccccagtatttgctgtgttccctttcaaagcctgccctgtttgcagaggggttatcatgtgtccacacaggctgtttgccacaggtctgaagtgagcctggtccttggtgacagtactctgaagaaacttcagaccgtgtgtgtgtgtgtgtgtgtgtgtgtgtgtgtgtgtgtgtgtgtgtgtgagagagagagagagagagagagagagagagagacagagagagagagacagagacagagacagagacagagagagacagagagagagagacagagagagagacacagagagagagagatccatgattcctccaatattaggatacagtttctctggttttgctaaatcctcaatgggtgtacctcctttctgtcaggattttccaaatatgagaaaaagcaaagatgaatgcccaatcatttccggcctgtggggaatatttttttaaatgggtagggagaagcaccactttggaaggtgcactaaaatctctactgtggaaatacaccaatctttgaaaccttttctaccctctgtatctctcgcacagctactagaatactaaaaataaaaaaccagatcagaagggaaggaaaggaaagagggaaggagggaaggagggagagagagagaaagaaaggaagaaaggtcattctaatttgactttgttttcttaactcacttatttttcccacaaaatatttccagactacctgtaagccaagcttctgcccttcctggccagtctatcagcgagtgttggtatgaaggggccactctgagactcctttagcagtagaaagtgcttctatttgtcaactggtgagataacttctaagaaaatagctcactaaagtgctcacatatttcaaatattattattattgatacaaataccaaagcacttgggattcaagaccagaggaatgcaaaatcaaagcaacttcctttcaaatgataatgacattcaaataaatcaggagtctccgtggggtaggtttttatgaacttgatacaagcaagagtcacctggagagaagaaacctccgctgataaaacacctccatcagaacagcctgtaggcaagtctagagcattccttaatgattgatatggaaggcccaccccctgcaaatggaaccgcccatgggcaagaggccctgagttgtataagaaagcaagatgagccagccagtaagcagagcttctccatcgccttgctccagttcctgcctctagttcctgctctgacttctcttcatgacagattaagctctacgatgaaacaaaccctttcctccccaagttgcttttggtcatggtctttatcacagcaacaaaaaccaaactagaatagaaactaagtcaggtgttggcatgctatggcctacaaacaaaattcagccttccacacacagttttataaataaaattcccaggaggacagccacctgcttatgaactgcctatgaccactctcactgtagtggcagagctgagactccaacacagacatgctagccaccaaagggctaacccccccccccaatctgcccatatatggcaaatagaccaaagccctagagtacaccgtctcataacttatgtttcaaatgggtgacttctggttctttgtaaacacttgatatatctcatgtcatggaattttttaaaattagaacttccttttgtgtagtagaaagaacatttgatctctccatttagggataataatcttgcttattataaagtaaatatacaaggcacaaatttaaagtatggctattttcacacactcacacacacacattttgtgtgacctttcccatactggtgtgtgttgtgttgatgagccatggacagagctctgaaataaaaatagcagaattccccaatgaaagtttgccagtgtcaactgtgaaactgccactgggtccagctgagggcagcacacagcaccccactgatctaaggtagcaaggtaatgccgggtgcctcatcagattgccattcccgttggaagaactgggtctcttctctcaggctcccttaggccacacttgatgcgcactttcactagaaccagctcaacttctgaggcacaaccccaacccctgagatgcagaataagctcagttcatacagcgaccatcgatgcctgagacccaagctcagctcatacggcaatcatcagtgcctgagacccaagcactttccagctcgttgctctgcgtctggaccttgctgccctttatttgataaaatgctctcagaacatctgccttaagttcaatcaggtggaggggtaaggggatgggagacacagcagaggctaaaacttggtgatcagattgctatactgagcagcatagactgaggtgggattcaagtgtcctctggtggttggaggactggtatcaggaaacaactgccattgtatgctacggtgaagagagattgcttcaggatgcataagcctagccaatcatttctagaaaaatatatgaactgggagtagaaataaatcatctggggctcacagaaggcatttttgtttttccgtaaactactcctgttgctcaaaaattcatatagttcctggaatgttccagactaaagggcatgaccttcctatcaaacttcagtctgtctagtatggtctgccagccatcatgtgatgtcctacagtgagtctgtgacacagaaatggcagtacagagcagaccaaccaggaagttcacttccaaagccctaattctagggcaaaagcacacaactacctcatccaaaattccatcagagccttatccaatctgaagtgaaaacaacaggaaaagggtgggcagacatgttcctctcaaccctggacccaaaacacctactccagatgaaagagaggaaaaatgaattcagacatggaggatgaagaaagtacaggctaccccacattcctttcatcccaggtttccttcaagctactgttgatcactctgaaggtccacccataagctgtacacaagcaatgcactggctgtgccaaagagagagagtgaagaaaaacaaacacagaatctgaatatgaagatcatctttgccaaagccaccagtgtggctggtacaatcctcatgatggggaaagacatttgttccctagctcatccatattctgtcactcacaggcaggctcctctcatgtttcttaggaagatatcctcacctataggaaggaggatgttaagagaaagtcatagtctcttcttccgaggtagcatgtgcaccttgttttgcacccctgactgtgataataagcagactaaccaggaagacgccagtgaacgatacttgatacttgatccacatgggaacgaatgcacgtctccatcactgtctatgctaaagagagccaaggctggcccgactaaatcctgacattgctttcaggtctgctcccttcctctctacatcttggccctgcccttagtccctttaatccccagactgcttatcaagctctgcacccaggccaacaccctatcaccactgtctgggtctagacttccttcagcattacccgccgctaaaatgtgtgccctgtgtacttcacgttaccacaggaaaatggtcagtgttcaaaaggagctgacgaaatacttccctgaatagttcttggacaaaagaggaagccaattttgcaggttcaggggttttaaagaaaaaaaaatattacttttgaaaaaaaatgtttatgtcaaaatgtaaagaataattaccatcttttatatttctgaaatattaaacaatagctatagttacctgaaaaaatcataaggaatcatactattaactgtctaactattgactgacctttaaaaaaaacctatagtatacataagtttgtctatgaaagcacatataaagtttaaatgaaatttttgcatcagggctgacaaagttccctccaagagccaaagaccaactaacaaaaacctcaacactaggcttaagaagccctctttagcattgttagtcagggctgcccacgaaactctctgactccacaggctatgactcgtcccttgttcgttccctgcccagagcagaagttgagtccctattgctaaagacaccacacacatcagacatagagcccaaaggcccctgagcaggagatgaccagaaagcctcctttgagaactagctttcatggaacccaaagtttgctgttcttacagaggatctgagctcagttcttagcacctacatggtagttcataacctcctgttactccagctcctgggaatccgatactgccttctgtcctttgtgggaactgcacatgtgtgcatataaacacatacatacatacgtatgtacatacgtacgtacatatacatcatatacatacataggcagatgcatcctaaagtaaattttagggatgaggtaattatggaaaatatgaaaaaagaattataatgagcaagggctcatgtgttgcctgtaattagactattaaagcaatgtgatgccagtacagcagccaagctgtacacaacagttgtattactgtctaggttctcaaaggggtcttcaaataaattcaacaatggaaatccttgatttaaatgccatgctagttgcaataaaaaatgtgagtacactgctgggggatcactgcaaggagcgtttcagtctcccatggctggtcggcagctctggagaggccccagtggtggcgaggtatgctgaggctcaccaaactggtcagagagcatgcatcctggtagaaagagataaagtcactatggggaccctgaaggagcttgatctgtgattaaggggccagattgtgaaggggtctcaatgttttggggatgctggagttcaggtattttcccctggggaagcaggggttccctgaatctatattttgttttgcaagtggtttgctttgcaagtgatgtgcggtcagaagcggggctgaaagccactatttgtaagctgtgggttgctgctgaagcaaggagcttatgtaacgctggctttgttttggaaaagctgttgtggcagctgtgtggacatgcatttgaaatgatggaataaactgaacctcagaaagaatgtaccaaaggtaacaccacaaactaatgcagagtatctctggcacatggaactccccagccctgcccaggacccctttctccagaagatggaaattctaaaggccagaagacaacttctaaagtacattatatcatccctcaaagtgatcaactgtctattctcctcatgagacagaccctattcatctctcattgtagataatgaggaatacttgagctgcctgagaactttttataaggacaaataatgactacaagggatttagcatggcagacctacatagcaaaatctacagtttggtgaaagaaaggtttcttcttgttgctgttaactcaggatttcctatctattgtcatagaatgaaagggcaacattggtttgaatttctaaatctagattgttggttttttgttccctctccaagaatcctaaagcctgggtcattctatcagtgtgtgtgtgtgtgtgtgtgtgtgtgtgtgtgtgtgtgtgtgcgcgtgcatgtgtgtgtagtgtgtgtatgtgtagtgtatatgtgcctacatgtgtgtatgtgtgcatatgcactgtatatgtgggcgcatgtgtgtatgtatgtgtatgtgtatgtgtagtgtgtgcatatgtgtatgtgtatgcatacatgtgtgcatgcatgtatatgtatacatgtgtgcatgcatgtatatgtgtattgtgtgtgtgtgtgtgtgtgtgtattcatactatataccattgggattccttatgtgattaggaagttctttagcaactccacagaagagtactccatatctccattccatgcctacagatggtaaagactttggtccagcaatttctactctatttacctcagactgcatgagcaatacccaacagaggtttcacaatatttctactcagttttaaatttctaacaaatgagtttggaatattctcctaaaaagaaacaatttcatgctcatagccttgacatctcttctgttgcctaaatctaggatttgtcattaactaggagattagcagttgaagccttatttttggaagattgacaggagaaaaggaggaaagatgggggaaagtgaaagaacacactacctcttttaataactcccctctatcatccgatacttaagaattaagaatttcccctaaatgttagtagcaatggcaataaatgaagcaaaaaagcactccatttgatctcagatctgggagcaaatttgatcctcaaactcagactctcatctcagagtgatggttaaaatccctaccatgaagatatgtggttagtgctcccataggtctggggaaaatgacagacacttcaaacaatcccttaatccccaggaccgagagtctagacctataatattacagtctagtgggtccataggaactgtgtagctcagaaacacagggtggcacaatttctgaatttgtagaaggcacagccaagaacagtatcatggcaagtgtgagacggtatcagccaaggcttattaccctgctttaccctagagagggtcctgtctcgctaatttcttccttagtgttctccaaggtctgaagttgacacttattttctgtagatgttctgctctgtgtgtggaagccatgctgatttttagaacaccttatacaaatggggacaattgaatgatgtccatccattttttaaaaccaatttatgagacaaaatacttgtcatactgcaaaattttcattctctctcatattaggactcagtttgaccctcccttatattgtttgcatgttcttcaatggtgtaatgttatataaatgaaaaaaaaaaccctatagattccatgtgtgacctcacctatatagaatctagaatattgtatgaggctcttatgcaacttttctcctcacttgtacagtgagagtacacattgcacatagagcatgaagcatgtagtggctggcatccaagattatacgagaaactgtgagtactgtgaatttccattgccaggttaaagttttaatagctacaaaagtcatctagagcaggggttctcaacctgtggcttgtgacccatttggagtcacatatcagatagcctgtatatcagatatttacattacagttcataaaagtagcaaaattacagttatgaggtagcaatgaaataatattatggttgggggtccccataacacaaggagctgtattaaagggtcccagcattaggaaggtagagaaccactggtctcaagcttcatgaggtgcagagtcctcaactcacacctaagcactatggctcttcagggaggaaaggggttcaggaaccttcctttagaattttagtatcacacggtccaggcttctgaagattactgtgaaacccttctcatgagttctgcttcctgtacaaatacttttgtttagttgctcttctgatgccttgataaaacaccatagccaaaagagatttctagaagagaattttgaattatggttcccagtggtaagagtctatcatggtaaggatgcagggcagggagaaacaggcatggcagccaaagcaggaggataagagttcacatcctcaaacacaaacatgaaacagaaaaagtgaaacagaaaaagtgcaaggctttaaactcaaggcctatccctaatgacagacttttccccccaaggccacacctcctaaccttccccaaagagcactaccaactgttaacaagttatgttaaaaaataacctaaagaatgacattcaagaatccaaggttgacttctattttgcatgcatacatacacatacacacacacacacacacacacagagagagagagagagagagagagagagagagagagagagagagagcatacacacacagcaatagggatggaatctcctatcctacttgtctcatggttttattcttctcagctccaggattctttcaaaacaagttgaacaaaacaaccactaaacaatcatttatttagtttttagtgggtttggcttggtttggatttcatataaagaccaaaagaaaaaaaagaaaaaagattattaactctacacagtggcctcaacaaggccttgaactccctgcctcagtttccctagaatctgaaattacaactctgagcctctaggcccacttgcttagttagggggataggggcattcaagtggcactctaagtgatccagtgtctgactctggctctcttcttttcgatgccagccacaacccaaacaactctaaacaactaatgaactctccagaaggccagctctgggagcttcagctcttctttctcgcctgtctccagaaccttcgtttggatttcattatgtgattcggaaagcactcttttctggtttcctgcaactctgtgagcaaccagatctctaggcccatgtgacaaaaaggcccttgggcaagtccaccaggcacacttgctccaaagagatgccctaagcccacctgtccctgactccagatctggtactcattttccttttagaggcaaagcccattcagtgtgtattctttccatcatctggcaaaagcatgtttactctgacaccaggtcatgtgacaacacttcttgcaggctcccttttggtaaggttcttctttctgttctgtctccatagcaagagtccatctgcaacggcatttcagtcccataaggcactaactagacttagttccaggtaaagattccttgccttaggaaggggttggatgactctttctgggactgataaacacttcatttatctaagggttcacatgaatcccacagggatgatatgagatccatctgaaagtccctaaaagctgcctggactcttgattgtgataagtgatggagaccttaatgaattcatggctccttctgcccttcactctttattttatttcttcagtatattagcttgattccatgtgtcctaggcagaattatctcaaaggacatatgagatacatattatgaaagatcagggtctggtcctccaggaaaccagaaatctatatacttctcaactgtgcacagcctcagactcacagtccaaaatgtctaacagactccaagcaggaagccagaggaaaggatgatggagaattggaggccgaagtcacctcccattgtctcttaagaatttcatacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattctaccagagaactcctaaacctgataaacagcttcggtgaagtagctggatataaaataaactcaaacaagtcaatggcctttctctatacaaagaataaacaggctgagaaagaaattagggaaacaacacccttctcaatagtcacaaataatataaaatatcttggcgtgactctaactaaggaggtgaaagatctgtatgataaaaacttcaaatctctgaagaaagaaattaaagaagatctcagaagatggaaagatctcccatgctcatggattggcaggatcaacattgtaaaaatggctatcttgccaaaagcaatctacagattcaatgcaatccccatcaaaattccaactcaattcttcaacgaattggaaggagcaatttgcaaatttgtctggaataacaaaaaacctaggatagcaaaaagtcttctcaaggataaaagaacttctggcggaatcaccatgccagacctaaagctttactacagagcaattgtgataaaaactgcatggtactggtatagagacagacaagtagaccaatggaatagaattgaagacccagaaatgaacccacacacctatggtcacttgatcttcgacaagggagctaaaaccatccagtggaagaaagacagcattttcaacaattggtgctggcacaactggttgttatcgtgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaatcgacaaatgggacctaatgaaactccaaagtttctgcaaggcaaaagacaccgtcaataagacaaaaagaccaccaacagattgggaaaggatctttacctatcctaaatcagataggggactaatatccaacatatataaagaactcaagaaggtggacttcagaaaatcaaataaccccattaaaaaatggggctcagaactgaacaaagaattctcacctgaggaataccgaatggcagagaagcacttgaaaaaatgttcaacatccttaatcatcagggaaatgcaaatcaaaacaaccctgagattccacctcacaccagtcagaatggctaagatcaaaaattcaggtgacagcagatgctggcgaggatgtggagaaagaggaacactcctccattgttggtgggagtgcaggcttgtacaaccactctggaaatcagtctggcggttcctcagaaaactggacatagtactaccggaggatccagcaatacctctcctgggcatatatccagaagatgccccaacaggtaagaaggacacatgctccactatgttcatagcagccttatttataatagccagaagctggaaagaacctagatgcccctcaacagaggaatggatacagaaaatgtggtacatctacacaatggagtactactcagctattaaaaagaatgaatttatgaaattcctagccaaatggatggacctggagggcatcatcctgagtgaggtaacacattcacaaagaaactcacacaatatgtattcactgataagtggatattagccccaaacctaggatacccaagatataagatataatttgctaaacacatgaaactcaaggagaatgaagactgaagtgtggacactatgcccctccttagatttgggaacaaaacacccatggaaggagttacagagacggagtttggagctgagatgaaaggatggaccatgtagagactgccatagccagggatccaccccataatcagcatccaaacgctgacaccattgcatacactagcaagattttattgaaaggacgcagatgtagctgtctcttgtgagaccatgccggggcccagcaaacacagaagtggatgctcacagtcagctaatggatggatcatagggctcccaatggaggagctagagaaagtagccaaggagctaaagggatctgcaaccctataggtggaacaacattatgagctaaccagtaccccggagctcttgactctagctgcatatatatcaaaagatggcctagtcggccatcactggaaagagaggcccattggacttgcaaactttatatgccccagtacaggggaataccagggccaaaaagggggagtgggtgggcaggtgagtgggggtgggtggatatgggggacttttggtatagcattggaaatgtaaatgagttaaatacctaataaaaaatggaaaaaaaaaaaaaaaaaaaaaaaaagaatttcattagaccttctacatggcgtttctgctaatagctggggaccaaaactgggcactagggagaccagaaaattggcttgtcatgcaaggaattataactccaattacagctgtggtctcctcacaaaggtagaaaacagtagatattagaggattgctaacaggctactatcattgtagtttcaaatcacaaagaacactagaatacaagccgggaatgatcaaatgctgacagcagatcagagaacatcatggatgctttgatacatggatatgaaaacgtgaaaggctgaaacaaaagtcaacgtcagaggcaatgtcagaggagagcataagtgaaggggggaagcgtgcagggaactcaggatcatttatccgggtacggggacttgtgcctatcatcccagaactcggcagctcaactgaagtgactgaagcaacactgcgaagtcacagccactctgctccgcagtgaaggttagaatatccatagctacagagtgagtccctgtataaataccttcctacacacacatagaaagaattatttagagccttctagatattgagcctaagcctataggaattgaaaggatagtaacactacagaaagagagagtcaatagttcagaatagaacctagaagcagtatcaggtacatatttgaggaaggatgattatccaatacttagataacacagggctattctgtctggggcgtgcggtaatacagattcaatatagcttcttatcctagcttaagtattttagaaacagaccctgaagcaaggtttatgtgtccaagtccaccaggagctttgatttcaggggaatgcaggtgaaaggaaaaagaaattagataaggatgatgcaaggctacaggaggcaatgtggattggctgagattcatgaggagacacagctagtcatgaccagtcagagacccacacacccacaaacatgcacacacacaccaatgcacatgtgtgtacacacacacatacactttctttttttttttctattttttattaggtatttagctcatttacatttccaatgctataccaaaagtcccccatacccacccacccccactcctctacccacccacttcccctttttggccctggtgttcccctgtgcttgggcatataaagtttgcgtgtccaatgggcctctctttccagtgatggccgactaggccatcttttgatacatatgcagctagagtcaagagctccggggtactggttagttcataatgttgttccacctatagggttgcagatccctttagctccttgggtactttctctagctcctccattgggagccctcacatacactttctcataagcacacacacacatgcacacacacaccaatgcacatgtgtgtacacacacacatacacattctcacaaacacacacacacacacaccaatgcacatttgtgtacacacaggtgtacacacacacatacacattctcacgagcacacacacacaatgaaagcagtgtctctgagtactttggaagagctcaaagaaataaagttggccttttatctcctcttctcaccgaatcatcagccacaccacaagggttacctgtccttgcttccaggttgcattctcttgccaagcctacaactgctagagatgccagccacattctttcctattctggaggtgaaggcgggcccagagactttccgatgtgagtctggcagacaacatgaaagccagcatgacagccagccaaggtagggaagtggtaggttctaaggaaggcagggccaagtgaacccaggaatcctgggagttggaatcaataagtaggcacacattacatgcacagtcaaatcctacaaagattaaatgtatcagtgttttaaaaaaaagtgggagaaaaaaatgttctacatattcttctgtgaagacaataactattctaagtgtgacacagattcaaaatcattaaagatttttttcaattaacagatttaactaaaacatcttcttgggaaaagacataggtgtacatgcaaatgtaatataacacacagaaaacagacaatatttgcatcaggtaaaacaaattaaaggccatgtaaacaaactaaagtagtagtgagctctaaggagcacctgtaaataagtaagggaaactgggcagaagactaaagagcctcgaagccaagctccgatctaccagataaccatgtctacagtggccaaactcctaaaggaaaatcaaatgagaactgcacggggaagggtggaaaccttccagtggacttgattgctttacagtgtgagaacacatttttcaaagtcccaccaaatgaactgaaagttacctgttatgctcttatttctgtagcttcaatcatatgagtttttgtttgtttgtttgtttgtttgtttgttttaaggaaagaaaatcttcgttttcggcctactccagagaatctgagatctttggagttctctatagaaaactacattcagattgaattctaactcatttatttgtacagtagacttttgcttggacaccccaacttcataaaattctggtgttggttcaacttacttcctttaaaaaatatgccgctaagaatgagtgttcatgcctgggaccctagcacttgggaaataaagggtcagtagtttaaggtcagcattggctacacaagactctatctcaaaaataacagagaaagaaagggaggagatgctgttttatcttttcaaaaattatgataaagcagtattaagctacagtaaaaataacatgttacctttagggggctttttgaagcattttcttaaatactgtttaatgatcataagaacattatgaagacagtggagttttctttatgaccattaaatatagattagataaagaacagatctaatgtctaaaatacaataactagacaaactacagctaagttctaagagcccaactgatggttagacttcatggtttctactgaacagtgtgtaacagtggatgtgaagggtaaggcaatgacttgtttacaaaatctgtatctttctggagattcataatggagtttggcagcttaaaaacaaaaaactcaagttgtttgtatccaactttccattaaactgcaatggttaactagccaaatgcagtaagagaagctagactttgcatcaaatgccaaagaactcaaccaatttcctttaaaatatgaatttgctccagggagtaagttccggtattaatttccatggtcatttccccttcatccctgagttgggagaaggaaaacagagatactcccaggacaagatcttctcatcttctactgaagcccagcttcagaaacacatcatcatctgatacctaccaagcaagaagcatgtggaagcttccttgccaagccccaggcaccaggagtgattgaatgtcttggtaggattcaaaatccatccaagctagacaagctcgtcttccagttttggccatgactgataaaagggaaagtaagtaggaaagccagaactgtgaaaagaatttaacacctctgaaagctttggatttgatttctacttaaggcagtaacacaaaaactcaagtaaaatcttacttgatctggtcatctatatttcacttgagctgagtccaatagttccaagttcaaaatagcagtaaccaagacagtttccttgatggtttctactcactaaaacggaaccccaaagaaggcaggggcattcgtcaggtttccttactactttacccccaagtgtctcaaatcctgctcaacaatgacttaagagatgaaaagaactggtggcccaatgtgcctttctgatttcactgagactctgagtgaacagaagaatatcttgtgtgctgacattcatagatccttttggggaactagcctccaacaggcttctccattatgagaaatccactgaaatgtgcaaagtgcctccatttttaaaacttttttggtttttctgtttggagtgcatgtgttgtgcgtgaatgtacgactgtggtatgttgtatgctgcatgcatgtcaatatgcaaatgcacatgcccatgtgcacttcatgaggattattccttcaagtcagagtttctcacttctttgactaggttgactggccagcaggctactaggatctgcaagcatctatcctctcttggtaccatgtgaatccatgctcttctttctatatggctgctgggatctgaattttggtcctcatatttatagaacaaatgttcttacccactgagccccctttccatcctgcctctgatactttcttagctgtttatttgttaatattctgatacatatctcataattactcttttatatgacagctttatgctttgcctttttcctgctaagtctagtgtaagaacaaagcatttcacagattacattccttaaatgatcaaagaaactaattctagagaagtgagacaaaaactaaagccctctcagaaaacaaaatagcttggaaattaaagggagaaattggaacatctggttctgaatgattgtaaatgtatctgtaaagtaacaggtctagggacacagagagcaaaatcaatgggaaaaactggttaaggtgctcaacactgaaatatgacaaaagggtgaaagaagtttgaggtgccctggcagaatcccgccaataccgtaattcattaaggaatgcatattccaaaggaaatgttgatccccagcatactgaggaatagacgctgatcatctacgctccttacaaacacccttcagcagcctagcaagccacaaggaaaagcactctctactcaaaagacaatgtgtgagtccatcctaagaaggtgagcatgtaatgtaatgtaataatgtaatgtaatgtaataatgtaatgtaatgtaatgagctaacacgtcagaaggtaactaggaaagttctcaggaagcttaggcttaggcttaggcttaggcttaggcttaggcttaggcttaggcttaggcttaggcttaggcttaggcttaggtttaggcttagggttgggtttaggcttagggtttaagattaaggtttaaaattaaggtttaggattaggattgggatatgggttagtaagtaaaaagagaaagaaaaagaaaatcctatgcttgcaatgcaagagttggggaatgagaaaccaaagtcccctgtgtagacatccagtgctgtcatctacagaatgggattgacaacagaagcagattcaccatgcccagtctatgatcttttcctggcacttggtgtctttggtcatttaaaaatagtggaggtcccttttttgcatgaccgcatggaaccagaaaatgaatgtgcaagcttaccatgcagagagacctgaataacccattggagaaagtacaatgattccgttgcattgaaacactcaaaattctctaaccattggttttaaatgtgtaggtcattgaaaaaactaattcagaccaatatttgtttagtcctctgtcacttaaaacttaaaaacattgaaaattaaaatatttcctttctttgcaaaaactcaagagcatcttcagctgggctccctttgtcctgtactgtaaatatgaagtgagctttgacaaatcgtcattctgagtttgagtcagcttctagcatctattctttgtactctcattgttgtgaaatatctcagagttcctttaacatcaaggcttgtgtgtgtgtgtgtgtgtgtgtgtgtgtgtgtgtgtgtgtgtgtgctggtgtcacttcccctggactctgtcagcatctccgtcatgcccatttccctctctttacatggtgagtccattttcaccgagttcccagctgaccttctgggatgtctcaaagtgcagggtgtgactcccattcgggtcagtagcagtaaatcatttatctcaaacctaaaattctcttttctttttccagtaagtaaaaggccgcttctccacacagggctgtaactaatagaaaggactaaagggagtagccagagggagtagccagaggtccagtctggtgttctagccttttacccaagagtgctagaaactcattatggatgctagacagtatcttgtatgtagtggccatggagagtggaggagaagccttggagatggagtagttaaaagctatttatcatttatactttatgctggcagacactagctttggcatctgcagaactcttaatccataatggataacacatggagctcaagcattatgaaaaagcataccattctcgtgctttagtgtatagatctgaggaaaataccttttcagtgaaattgaaccaaacatctgtctggctcccagttgaagagcacagaatgtactttacaaactaatcaaacttcataaccttgctgtgaccttgtcatttcctaacagcatgtccctcccagagcagtcacttattggaaactcatctgtgactgttctctatactgcttagaatagaatagaagtatcacaaaatacatttgactcagagcatgagacagcatgaaacacatgtacacattacacattatgcctttctcaaacactcacatgtacaaatctggaacaagaggaagagaagatttggctcattggtcgagttgcatttgattaaatgaactcttttatcctcatgttcttagaaacacataacagatttcatctgatgaaagaaattataattttacagagaacaaaagtgatctagtggcacaatgggacaaagacaaaactataatgtaaaatctgtaaaagagaccataaaagctacactagcttctttggggctgtgctgtcctcagatagtcacctcatcagactatatggtacatgtgcatacctttgcacgtgtgtggagatatagagatgctcccatagagactgtagagtcagccagagtgtggagatggtggtgcgtttgtttcagtgagaggaagtcaccaagaagaacagtgaggcagtggtgggggcaggagcacagtaatttgtttcgagtgtcctccactatgattaaaaaaaaaaaaaaaggtctggttagacctcagtgagaccaagaaattgccaatgtcaattcctatcaacagatcacaggaatacaggcagatgctcaaatgcccaaaaaggtgacctggatgacaaaaatgtggaccctgtagcagtttctcaggagatactgtgaatctgaaagagtggccgccacatgcatcacagcctatgcctgagggtcagagggaatgtatttaaaaacaagcagattctcatggaacatagccacaagctgaaagcagacaagaaccacaagaagctcatggttaaccaggctggggctcacaggtctaaaaccaaagaagcacagatgggcccggaggagcacccacctccaggcaaaggagaaggagatcatcaagcctctgtccaaggaggaagagacaaagaaataaaacttccttcatgtctgtattcaatggcctggtgtggcctcacgtggatcagtcattaaaacaaaacaagcctttgtctgttgccatctttttagagagatatggagggaggaggggatggggagagggagagggagaaggggatggggagagggagaggagaaggagagagggagagagaggggggaggggggacagggagagaagagagaaaggggagagagaggaggagagagagaatagattctaggtttgagggtatatagataaggagtcctgtgtccctagagtttgaatgtacagttccattaaaggcccaatttttgttttagaaacatcaccctagagcaatagagcatgcatttggagctattttgatggtggtgattgcggtcacattagggagtccatggtagtggtgagaatggttgtgatggtgatagttgtagttgtggtgatgtttgtgctggtggaggtcatggtagaggtcatgatagtggtggtgatcataaccttgctcatggtggctctggtcatgattgtggctggggtggttgtggtcatagtagtggtggtggtggcagtagttgtcatgatgacagtcatgcttgtgctggtgagtgtggttagagctgtgattgtagtaatgttggcattgtattaatgacagtagtaagtgtggtagtagtagttggtacagtagtagtagttgttctgttcatggtgctggtagtaatagtgttcatggaggtgatgatgataatggttgtggtagacatggtgccaatggtacttatagtggtagcgagttgtagtagtggtggtcattgtcatagtaatagtggtgatgatggttatggaggtggtggtaatggtagtaactgtagtcatggtggtcatgatggtaatggtagctatgatttaacttaggcagtttttattgtcttttctaggtgaggttgtggttctaattttctcttgctggccagaataccccaaccttgtcccagagtagggaaggaggtgtagggaaggtaaataactccaacagggtcacagaacctactgaggctgaaccctgtcctctctctgccctctgtttgcttcttgcctgatattggagagtaaaagaagaatccaccagctcttacacaatgctgaaaatctgctgttacagggcccaacattggcttcccttgatagacacagcttttcctcactgaactgctaacagagactagaaccctggtgaaccacccaggctttggagggcttccagaagctttgcagaccttctggccaggcactttgggatctgatttgcactatgcttcccaagagaggtcacaccagaacacttgtctctggcttcattatgacactgattggtccacttcagcacagctgctcttccccaggacacaggcctttccagtcttgagtcaaatctgtgggccactgcaccctaaaaaacaaccagactcgttccactgccagactgcaccaagggcttggctaacattggtgggatatgcagtagcaagtggaatgtcccctgtggccctcagctccttttttggctctgtaataagctgagttgcagtccaaagtgacctgccttttctctacatttcttgttttctctttcatttttgctgtggtttattttggtttggtttggtattttttagagtttatttttaaacttacccacagtaaaattaactcttttggtcgatgtttctcagttttaacagatgtccaatcatgaaacaaccactattagctgaatataaataattcttttcttctaaaatgttcctcttgctcactctcaacatgtctaccagctgctaatggttctctgtaacttggcctgaactccagtgtcacacagataaatgtgtatgtaaccagcctttccagtctggaccctgtcccctaacacatagcattaaatgaacaattcattgctgaaaaacatttggataggcattataagatgattatgaataatatccataaacacttgcatgaaagtttgctacaaacatttttgtttctatatggttaggattgatggatcctgtgctaagtgcatgtttaatgtaacaaaattccaaaagtgcttttcaaaatcactgccacattttgcatttcctccagcagtatgtgggagtccacactgctccatgcctcactgacaccaaacatggtcaaggcttctctcttcttgctcagtatttccctaaaaccaatttcagttaggaagctgctaatctaaggaattgcatgttaagagacagagggcatgggtgcagtattctcagatctacaaggagcctagaggcttggcaagttattggcagtaaggagcatcagagatgcccacccagccttggccataaggagtcaaagtccaccatgtctcacaaattcagcaaatacctgtcttgagagctctcctgacataggaagttggaagtgctttttctacagcatataatagactgggctgttgcctagataaatgccttcattctgtcctctggaccgtcatatatttctcagagcatggaaggagctcccacgtaagtgtcacataatggatgatagcaatcacagagatcattaacaaccccaggaccactcagtgtccagaaagagccaacagatcaaagataaatggcagaacaaattctaaaatggcagttctactctttgaggaaaccactaacgtcctggagctggagctacaagtgaagtcagtgctggaaactggaccagaatcctttgcaagagcagcaagcactttaactgcctgtcatctctccagccttccacctctaacaatcatcaagatgttttagactcttacaaggaaaagtaaagaaataagggcaaaaacaaacaaacaaaaaaaaaacacaaaaaacacaaaaacaaccaaaaccaccattttaagtctatcctttgaccttcagtaagatccattccattcactggctgttagccattacctcagctcttgtccaagcagaagagaactaatgtcttgtcaaagaaaggagtattgaagtgtttatgagcaatttttttctaagccataccatctaactttactttgcacagttatctcaatatacacagaaacaaaaccccgttgccatgtaattgagcactgagctcaggaatgagcctccaccatgtgactttggtacaggctgagagtttggatcggtttggttttgtttatgacagatctgatgttcactctgcttcagtctcccatgctgggattagagcatcaccaccacaccctgttaggaatttggatctggagtctgtgggactctttcctttttggatcctggggcccatgattttatccaaatggggcagagcactaattgttttggtataccctctttggatgtacccacatttctttccagcaatagcttaggaagcatatcccaacaagttctcctcctattcatccttttcctcattagaatctctatcaactcaggtctggtcataggaacttgtagcaaacaaaatccctgattgttaatggtaaaccgacttgcctcgactggctcattggatagtatacgtacaacggatccccccatgagctgcaggaagactacaagagatggagctatttattttatgttttgtatgcctgccatgcttttgatgaacaagatccagagaaattctctcccaacaacactgggctcctggaccacactgacgcttgtgattccctcaggtttcatcccattgctggaggaactggagcccccatggagcatctcaccagatgcattcctcgagcaaagaaatcatcctcccttaactgtcaatgcaaaaagcttagcttttcatgtaacatctttcccaagttaaattataaacctaaaacatccctccttggatccaaaacaaaatgacagatgcaaatgtattgaaaccctcaaaaaagtttagacacatacaactactgacgaatcacagaacaagtccttagattatccaaactgtggcctcatagctgtcctttggcagttgtgactgagtagcctctgcctgtggccatcacatcctggtgatctcacagctggaagccacacagtcaagcatacatcctcagaagagtactgtaacagcagctgaagggctcaacagcctggcctgcctttaggactacaggttctctcccctctcccctctcccctcttcttccctcccccctctccgctctcccccctctctcttcttctccactcctctcccctctcccctttctcccttcttctcccctctcccctcttttcccctcctctctccctctctcccctctcccctctcccctctcccctctcccctctcccctctcccctctcccctctcacctctcacctctcacctctcacctctcacctctccctctctcctccaaaactggccttttttgtggaggttctcatttctacactgggctttgtaaaacaaaaagctgaaatagtcacaaacagaagaaggaacagaacctctgagaaaaacctaagagcgtgaatctaggagaaacaagcccaccccaggaacatgaatgacactgggcatctttaagtcagttactgtacaatagaaggtgatcatgtttttatagaattctaagttcagctgcttctcctcactaaggtccactcatctccttccccagccttgggcctctctgtgttctgatccctcctccaggtccttgcatagggttctcttctcctccaccccaccccacctccactcagaaaggattagagtggtccactgtactgacttggaaatctcaacaggctgagaaaccttcaagttctacaggaagaaatggcaaacggtgtcattctcaaggccaaacaaccatcaggccatatctctaggccaggaagcccctgttgattcctaacttctgctccatcagctctcaatgcctccctgctggagaagtgacccagagcataccaatcctcactgaaccccaggcagggtcccacacaatagacacagaacaagccagagagccaactggccacataatcagtgaacaagcacagcataagccagaccaggatgtctaacctaccgttgcagatctcaggggaacatggatagaataaaagaaggttgctagcttccataaagcttccatctctccctcagaagatgaatatgaacagtatcccttagtgttgttagtagaatctgtgactttattatttaaaaaaaaaaaaaactataggcattttagcagctcattgtagttgtcacagaaactccagaatgccatctttatgcagcacttattgacatgacaagagttatcagacccactggtaaagttaatctcatacatcatttaataggtagatctatcactatacttcatttctaaatcagtgactgtctcaataacattctccttagcaatcctgtatttcttatttttaaatttaaaaaaatcaaacatctgcagatgtcaaaaggttcacaaataaaaaaaatgctaagaactctttggttagaataatatatgaatttctatctgccaatcctcgctgggctatttaatccccacagctagggccaactctgtttaaatacactccacagagaagacaagaagttcaagagttcaatggttcaccatgtcgctcttattacaagttctctttggggcttggactatgaatttcctgtaagtagattgttgcctgctctacagttcctctgtgacccagaccttaccttgttactgggctgttgctataagaaatgtctcctggaagtgttaacagccaaggactcttacccaatatgttgggaggtttgttgtgtcgaccttgtttatttccacagaaatttctggtgctgagttgcggccaagagactattcaagagacatttcttgttgaattatgaaaggacagcagtctcttcctggataaaattctagtcggaacatgaatttgcgcatgggtaggaacattgtgcttcatatgcagttaccttatttaccttttctgcccaagggtcccaaacgagtggatggtcagggtctcgtgcacagtacaaaatctaatgaattggtgtgtcttcctctgagatatttgagtattattagaatacctagagaaaaagatcaaaacaagctgtaaaattgcttcttaaccattaaatgataatgtggtcctagataagcaaaactaaaaaatatatataaactctaatataatgctttctacttgcaaagatttgtctctagaggaaccctgggtttggaaagaatcttattatctctgtaaagatcgcctccttctcagtagtatcttgctaaactctggaggttcctgggggactgaacaaagccaaaaagagaagttaagtacatgctcagaacaacacttgttcaaatcccagaggaagcagctcagaatttactacatgttctctcccagcgtcttggaaatgacatcatcgtcagattaacttctttgagttctggagaaataaataggaagatgtgaattggtttgacttcccttaccttgaacatttcatattttgctccaagagacatgactgccaagttcttccctgtggatccagagttctagaggtgcttggtctggtttcttggcacatggtgatgagcctatagtgccggctgctgagctttaaagagtcctgttcagttcctcctccttcagtctctgtgcccctccaaaactaaaccggacaaacagaaaagatttctttccaaattcaccttaagcaatgtggtgtcaagtactggagagattaaagtttccaggcagaacaatttccttggtctctagcttcttacttgaaaaccaagatatttcccacagaggtagtctctgttcctttgttcatgtgccagcctggtgaaaatgcttacagtgtgcagtcaaaatggagtgagtcatggtgtatagttagcttttattgtcaccctcttggtgaggaattatctgggttggcctgtggccttatctgtgaggattgtcttaggtgggttggttgaggtggaaagactcaccctgaaattgggtggaaattttgatctggaccctgaactctgcataaaggagaaagccacctgagtatttgcaagcatacattcactgaaccttgttcccaatgataggtgtgatgtaaccagttcctccaatctgcaactctgacttccctgctatgatggttttgtgctggttagtttttgtcaactagacactacagtcacctgggaagagggaacctcatttgaggagttgcttccaccacattggcttattggcaagtctatgaggtcttttcttggttaacaattgatgtgggggatgctgcccctggtcaagtggtccagagttgtataagaaacaaagctgagcaagccatggaaagcaagccagttagcagcactcctccatagttcctgcctccaggatcctgtaagataaacaaaccctttcatctcatctggttttggtcagtgaattatcataggaacagaaagcagactaggacagactgttgccaggacctgagctctgaaatgaacccattctcctctgagtttcttttctcagagtgtttttatcacagcaagagaaatgaaacaaaggcacatggtgatgaagtcacacttctgaagcttctggccagctagtctgtcatgctcagtagcaaacaaggaccaacagcacctcatgtggaccacagcatgcagacacccacactcacacagaaatgcacacatacacatacgcatgcaattgctaacctagggagatttcttttagtctccattgtacatggcctattagataaatcagagtatatggacccagatataagcaattctttataactttttgggggattagaacagatctccaaatttgtgaaccagacccggaagcccgtgcgttcctctgatacttgtctcatggacagtctgcctcctgcagatatcttttcccttgtttgtatagtctagagtccaggatgccccaagatctagataatctggtttcccactgagccatgtactttgatttgatcctaaacaatctacaggggacgagagatcctaggtggtgatggaatagatacttgaagctcaaggctttagcagccatattcagcatcttgtccttccacaaagttacttcactactatctgtattccagcttcaggcatacatacaatatctttataaaggatggaaataatcaatctattactaagagagtcctatccaaggacatatagccagtgccgggctattaaagaaaggtgctctaagaagacaaatcttgtctctgctgagctttgaaattacatgaaagcactgaatgttagtcagacctctttgccttaatcatcagaaaataactttcaaagtgtttctcaaacatggaagatgaaactccaacttgcatagtgttggcagtgtctgtggctgctccgcacagcgggggtggggggaggtgggtgctggatggaggagactcgagctctagtctcagttcactttgtccttaggtcacagatgctccctagcagtttattacccattcaagataagcaaggtggccctagaagctcctttctggccatgtacaggacatcatctatttatccaaagcagcttcccttacacaggactccaagacagacagacacccagctcctgggacttacagttaagtcatgaaagtcatttctagcagatagctccaaccacagcagaaattcccaggtcagaaaatcctcctgtgttatgttacactttgagcccactttgtgtctgtgagaaacaaaaacccaatgggaaaagtcttttaaacaacaagtcttgactttttaaagttaagactttcaaagaccagcaaaagatgctgaaaagatgtcaccttttattttggtcaaattattatctctgctctgacatcatagttttctgtacttaaagtctgtgtattataaataactgcataaatatgtacacaattaaaatggaactcagatataagattcaacagtggattttgttttttggaaaagatataatcctattgtatcaaatttataagctatttaaatcttgtgcctcttcccacaaaggatatttttaatagaatcatattaactttatacactttctttataagttttgccttaaaacattgtgccttgttttattaaattgttttattagaatccaattctggcttttataacaacattttattctaaacagacatttacttttaaaaaaatctttataatgcctgtatttgctatatcactgcttatctgtttattgaatttattgaatacacaactctaaacattaaaaaaatcctcatgttttaaaaaataataatctaaatagtaacataaagctgcaggaggtaatgaggtgaaaagctgatgacaggaaaaccggatgcatccaacggctcaagccaccagcttctgtgggtcccccatctcgtctcacagtggaagaggcatccatcttatgaggctgcttcctggagcatggatctcaagatcctttcttcttcaagcctctctgtcttaaaaaaaacaaaatgaaagcaaagctttcccagtcagccctgtcccacgtgcttttctagttcgtgccccgcgtcttcacccccacacatttgtccatctgttcacctcccatatcctccacggcgcacttatctctgccattcatcagcactaatccatttaaaccgttcttgcaaagataaacagcaattcctcatgtaaaccccacaagaaactctcagtctccatctcggatgacctacacctcgtgttgaaaccctgacttctccatctttacttcatctccccatcatcctcctctccatctgttttccttccctctccctttgtaatttctcaccccttcaccagctttaatacagtggctctccagaagtgtctctccacttctcaatcaaacccttttggtagatgaacccccctgaattaaatgacagtctagcgctgataacttcacaacttagaaaacaaattttccagagcttcaggtctggatatccaactatgtatacaacatcgccagtagatagatagacgcctcaggtttcaacatggagtgcctttttcctccagcctgaccctctttgatattcttctgcctcagtaaatatgactgtcttctcatgtcagaaaaacaagcatcatcctgtcttccatctttttttcttctttctgttacagaataccaaggtccagttactctatctcaaacaacattttcagtgtatcaatgcttctgccaacattgactctctgtcctctctttcacagcacattcttatcccctcagcttccagacatacgcccctccagcccattcctccattaccatcggctggctgatgtttctgaagtaaagtgtggacctttccgtacatacaaacttggaaaccttcatgtctttcccacttggtgctgcaatagagaggttcaaaaatctactgactaaagaatttaagaggcaaatttacaagtttgtctcaagcagccttttgttttgtttcattacgttgatttgtttgtattttataattattagacactaactctttgactaagtgtattagaaagctaatggccaatatcatgtcagggagactttgtggaggaaaggatcgtggcttatttcactgtgccaaagaaagtcagtcataaaccctgttgggaacaacacagatgctgccgtgataggataattctccaagactgaggaaaaaaaccctctcatacgtcaaaagctagaacactgaccaactcctagcgtcagacctcagccatcagtgaaagttagaagcgaggacttcagattatacctgctcacccctgatgcctgcaaagagaaagcctcaggttgctctctacagctatcaggagaacccagcacagacattcccagacagctacaaacacagagggctgaggcctaactcacagacgtgtaatcttggcctcagaagcaagttactcatcaaaagaaaagtctaggtttccaaagtctatgtgcatatgtatgtgtacagaagtggtgtgtctgtgtgcatgtatgatttgtggagggctaaagtgattgcttatatgatttacctcacaatttacatcaccagcctcatttctacagtgtaaacatcaccactgcttgctcaaccacgccttctttcacacaaaatgtactgagcccagacatttatctagcacttagcttacattggatctaatctctccattagctcagcaactattttctacacctgacagaagattaaactgaggccctaaataaagctcaagttcctgcaacaggaaagagggcagcctggagtagaacctggcctactccagtcctgaagacagccctctttccgtgcaacctccttacgtcataaatcatcacgtttctagttctagatagtaaaaagaaagatgtggaggagaaagtttctgctttacgataaaccacgctgataaagatgattcagtgactatttttgagatgtcagagctgaaaatgtacagattccacagcccaaagaacctgccaagtcccaattgcacaaccaaagcggcgcaaggagccaaggaggccaactgtgtgatggaaaaagcacagatgtcatctgggaatgctcagaggcctgccttcagatggaagagagacagtcttgcttccgccggaaccacggccttataaggccacactaagttacttccttggctgaatcaacccagtgcatactgcctgttcgcttagatcacagagatcctacggcctgagcatcatggaaagaacgcccctgctgggcggtgtgcttagtccccatcctgagctggctcacaaacacctaccttgtaataaagctgctatgagcctttcagtggggacatgggggaggcaagacactggggtcaaagtggagatatttaggtcctcctgggaaattagtcacacatcatatcccttcctctccatttacagccatttatttgggagcaaaggaattctaaatgaatgagaagtcccttccacgccaacatgtgttctgaagttcacaggaagccttctcctctgccttggggcatgcagatgaggcctgctcgcagctgcgcctccagtgagctaatcagacagtacatgcccacaatggagagggctccagggaacagaaccagccatttctttgccttgcttcatcaggcctcctgtcattacaccaaaactctaggaggataaaagggacttagatacctccaagaagactgacccgagaatatgcattaaaccgtggttaagaatctagggaaaaggtcctgcaaggttaaacacacttcagaaaaggaacgttcacactcttgccaagttacttcccttacaaatattgattactctctgcagattatgcagatatttgtctcagctgttgttatttcaatggctttcattctcagctacaagagtaatagagctgtcacaaggagccgattccaaacttccccctgaggtaagtcaccggtgggtgttaagatcctcaggaggggcgtgccaagttccacaagaatcccagtgattctgagatgatggagaatgcaaactctttgtggaaactcactaaaggacttctcttcagtgatcccttgttggtctcccaccattctattaacccaaaccacagtgtttctggctttatcttagaaatcttcactcagtctttgatctcagttaaggtcaggatctcttgtgacaggaagggatgatacagatggtgcagttcaaatttctaccttgcagggcagggtctctctctggtcaagtttcccctgtgcacatcctactatggtagacattcatggacaccaataattattagaaataataagaatcaggagttcaattctaacaggttttgatacaatagtactagattatcttggtatttttttttcactatgactttttatttcgacaaaatgaaaggggatgaggctgtccatgtgttgggtgtcccttgtatttcaggaatgagagtcagagatcaacctgcaggaatcagttctcacaatctgccatgtggaccttgagactcacacttgggtcatcgagtttggtggcaagcatcattacccactgagacacctcatcattctccttcactagaatttctatcaggcaagctcctcacctgccattgacaccgactgacaggtagatcttcctggcttacacttccaagaaaacaatgtgtcttccagcaggaacaattgaaagtatttaacaagagtctctaacaaggaagttcactgcatctcacatcaatttaactctgctcatataaatggttgttcttggggggggggctttccaagcaaaacggggctttattttctgtctctttttccccactttcaggtatatttcctggcttgctgagaaatgtaaaagtgaaagccggaaggagaggaacatctagggagtcatcgctcagaaaaccaggacacctgacttctgacctcagccttgaacttaactagttgtgagactcaaggctaattgatgaatgattctgaacattaattatttgccttctaatttgtaaaataaggctccactctaatgggtgaccctagcagctagagacatagagattgaagtggccacctcctgtagccaggcaggacttccagttgagggagggggacaccaatccaaccataaaacctttgacccaaaatttgtcctgcctacaagatgtgcagggataaagatggagcagagactgagggaatggccaaccaataattagcccaacttaatatctatcccatgaagagggccaactcttgacactattaatgatactctgctgtgcttgcaaacagaatcctagcataactgtcttctgagaggtttcatccagcagctgatggaaataaatgcagagacccacaaccaaacttcgggtggagctcggggagtcttgtagaagagtgtgggctagaagtgagggagcctgaggggggcagggtcaaggacactacaagaagacctacggagtcaactaacctgggctgatggggacttacaaagactaaaccaccaaccaaagagcatgtatgagctggacctagaccccctacacatttgtagccaatgcacaacttcatgtgggtctcctaacaattggaacaaaggttgtatctaactctgttgcctgcccttggatcctttatcctggctgggatgtcttgtcttgtctcagtgggatgggatgtgcttaatcctgttggaacttgatgtgccagggagggttggtgtctgtggtggggcttccccttctctgaagagaaggggaaaaggtaatgggggaaggagttttcaagggtgcaactgggaggagagtagggagaggctatgattggaatgttaaataaataaataaggaagaaaaggggaactctataccatcaactgagtcttcacaaggaataggtgtttggcgtgtttccataagaatcatgctattccttccatgtgggtgggtgtagcaaggtgcacatggtggagccactgcagcattgcctaggaggcatggagatgaggaggccagaatcttcattaaagtaagtgtcccatagctcagaggccactcctgccagactaaacggacaaagtccttctctccattctcagagaggccaaagtcctctcgattctcagtgaggttcaaagctgctggcacatgtgtgagtttattcacacaccctttccacttctacttaagtctgaaattcccaaagttactttataacttccaatcctacaaggcacagcagcaactcaaatcttaattcttttatcaaatattggcagactgtacttcttagagaggaagtgtttggaaacaaactggtttccttaataagggaatccaagtacactgtgtgactcagggtggacaaagttactttgtcttagaaaagcccgtttctttgctcttccctgaggggtggttgacatcacaaaacaaccaggttagaactgctttttaaccagtgttgaaatgttttcctgagtgaattcatacttagatgacacttgctaagaactggataatgtctccgagacagaaagcaccccagagatagtggaggtgaattccttactgcacagtgggaacaggtaagaaatgtttaactagacagtgacagaaataagcaaataagtgttatcagtctgtctcttgatccagtacattttacataccatgtgtgtggctaaaagtgtatgcaagatgggtagtaagtcttttggggctaacaagggtggggtactagctaccctgtaccttcaaaaacacctttgaattttcctaattaaaggagatgaggagatgacgttgcctaaggtaacctacaagtcagtcctcaagtgaacacatgctgcatgtattcgtgtgtgcatgttcatagatgcgagtatccatatcttgggaaatactgatgaaaaaatatgccaaaatacaagtaaaattggaaattaacaccaggagaaattaaatacggaaacatgtgacacaattcctatctatacactacaacttctttatgcagagagttttctggtctcggaaagaaaagagccaagagtggaaattataataaggcactagtttgtgttaatgacatttgattctgaaaggacaatcagaagggacacagactgtttcttcagacaatgtctctggcctctaggagctcgtacacctgagacccagggtatggtggagtcagggacgtttggaggtagtaggatgtgaggcagcagagcattctggccctctgcatgggggtctgatggatgagctctgcttagtctagtcaggctggagtactggatgtgaagatgaagctgacaggagttgaggaacaggaggctggaatcttcatagaaacgaaattggggctttaacctgtaaacagtgaaagccagttaagtgcaagccatgtgcagacaccatctaggccctggaatgtgaagctactcattagaaccaacccagagtttttcctttgattccagagacatcctcacagggatccaacaggaatccaagatagcctaacaatctgcagcagtggttgatacaggaagacacaagaatcccactgggggacacagttcatttgaacatgtcagcttcaagcaggtctgggtatcagagctttctactgagccctgggtgttcctccatgctttggctgtttgccaatcaaagaggtcaagtcaatatcaaagtctgtagtcatgaaactgacaactacctacatacagcttcaaactgggttcactggggaggacagatgaaagaagtagaaaaagaagcttcatacacacacagagaggcataatacacatatattatttatattatatataaatgtacatatagatacatacacatatatgcacacatacaagtatatacatttatacacatattatgtacacatacatgtaacatatgcaaacatcaggtatatgaccaggtactacgctggtcaattcatacatgacacattagcttcatgacaacccagcaaatgaagcatcaatcccactccaccaatcaagatttttttttgagacaggatctcttgttgtccagcagaagctgaccttgaactgcagattctccttcttgtacctccctcccaggtactgtgattacaagtgtgtggtaccatacccagcttcaaggctatttagacttccagtaagtgatgctcccactggctggactgatgtggaccccttctttaattgtatctctaatctttaccatggaaaaccctggaataacacttcctgtattcagttcacagagaaagattacacccccattctccttttgtggcagacagaagctctcaagcacaggagactggatgactcattcagtaagtcaataacagacacaggacaaaaacatttcctaacagttgatccggtattgcttccattagacattttccttgcatcaaaaagatgcaaactcacagggacccatattttctttgttctgtctcccttctagtcaccacaatagaacactcactcccatggggatggagcacaacattcaccctgacattaccaaatcatggtgaccagacagagtgcctttaactttgcatagacgggtatcattagtctacccaccacccctgatcagtatcgagatcactactcttattctgtaccatagaatctatagactctctggattgttggctgtgtccaacaaagaaaagtaacaacagcagcttccagcaaagcgtagttataacttttagcaagaatgactccctgtgtgatgaaataaaaccagcacacattgagtactcaaggactaacctcctgtctgaggtgcatgggaaatcttgactttgaaaattatcaaagactcacacagaaaacagaatgctctatcatgctctctatgacaagacctatccacatgaacccagcctgctgcccttggaaagatggctaattcatcattcaacactttcaaacctggaaccagcaacacctgagggttcttctctaatctagtccttgggaacctcttagtcactgtgatatagatggacagccaaagagttgtctgagattatttcacacacatccatgaagactccctacacctacctccaagaggaaagatcagtactccatgaagacagacagagaaaataatcatggctcacttttgacctgaactagaaaatgccctgtcattctccctcttttctgggcccaggccttataattcacccaagagcactccaggaagtattgagttagtgagcactgaattaatttaagaaggaagatactgaggcaggatataaagaggtggaaattaagggaacagaagtttaaaaggagcattttactaactgaataagaatgtcccccacaggctcctgtgttttgagcatttgttccctagttggtagtgctatttggggaggtctggaaggggtggtcttgctggaggaaatatatcactggtgttgtgtttgaggtttcaaagcatcttcccattctcagtgctctggcttcctgcttggagatgtgagtgcttagctttctgatcctgcctcctttctactgcctgctgcctgctgcttgctgatacgtttctcccatcatcatttatgttaacccctttaaactatagccaaaataaactcttggtttcataagttgccttggattggtgttttatcaccacaacagtaaagtaactaacacagtctagaatctggttacagtttctgctggctgagagttggaagttacttcagcataactagcaaaatcaagacaaaagataggagcctccaaagacaatagctggatgcttgacaagtagatgctctctagatagagctagtgttaggacacttggatgcaattctttctctggagaaggtcatatcctgtcttgggtgagtgttatcatttcctaagtctctcttccagtctgtcagactcttaccctcttgctcctgctcttacaatgctaacatttaaatctgaagcactcacactccctgggtcttcttttttttttttttaattagatattttcttcatttgcatttcaaatgctatcccctttcctagtttcctctctgaaaatcccctataccttccccctccccctgcttcccaacccacctactcctgcttcctggccctggccttcccctgtactagggcatagaaccttcacaagaccaagggcctctcctcccattgatggccaactaggctatcctctgctatatatgcagctagagatatgagctctgggggtactggttagttcatattgttgttctcctctagggttgcagacccctttcagatccttgagtactttctctagctccttcattggggaccctgtgtcccatccaatagatgactgtgaacatccacttctgtattttccaggcactagcatagcctcacaggagacagctatccctgtgtcttcttaacaactgagctaactttgctttacttggaagtatcctgagtcctcttctgcagcctagccaggttccagctttacccaggtggagatccacactagaagcagtctgaagctctcttcagtccctgccctcaatgccttctactacccccttttcccactctattcttggggtatctctaacttagagagtatatagtatcattcaatcctgctctcaaatgaaggctataccaactatgtaccgtgcaaccatgcagaccctcaaatggtattcatggtacagagaagttgaagaaaaagaacaaaatacaatggacaggaagaaggctggaccagaggagactacctagcacaccttttagcatagcctcagggtcctgaagccctcccagtgtctagagccaagagtaggatgcaaacatctcgtggtgttcagcaacaagaaaccagggtatccacagtagtataaatacagaagcatacaggacaagcaggctctagggctagatgccaagttcaagactgtctaaggactttgagttctgaatctactctctggcaaagaaaataaaagctaagaattaaaaagagagagggagggagagaaaataaacttggttttgtcttttcacaaagaagctcttcaacaaacgagccagcaaagccctcccaactcgctgggtgccaggcagaatgttgagacaccagccctagaaggagactaaatggactttcctgctctgggttgagcatttgaagttacccattttgtcaacagcattctgtataccaacatacctgcaaagaaagggaccactgaaagccccaaatctacccggggtgactggcacaccaagcacgaaagagctcttctcaaagtctggtaaggaaaagagaaagaggaagacttccttcctcccagggatcctctcctgcctctgcatcagaatctgtctctttgaatggctttgaagttttcaatttttactttctaggtctatgcctcaatagtagtagtaataataataataataataataataataataataataataataataaaaacataagtagcctctcctctatgccaactcacttcttaataacttcataaggcttttgtctaaaagcacttaccattcattattttcccactctgaaactgtatcgctctcctgtccatcatgtctaataggcactcattcaaaaccatgaacagcctggcccttctatgtctgtgaaaaggaaaaggaaatattctggcagcttctagactttaagaattcactgagtaaagactgccaacatctccttgacagaatgtatacggtgctcattaaaagaaaaaaaaaaagcttccaaaaagtccaaccaaaaagtttgaaacttctccaaggttttaataaagcagtgtggtgtgcgatggacacagtcggcagggactgtgttgttaaggagaaagagctaattctaaactagaatggtcattctcaggtgaggacttcagatgcccgcccttgatgttcttgtattgccacagactagttgcaaagcagactagaaacaaatacttgttacagtggttctggaatgttccaattagttacagtgcttcaggcagtagatacaacaataaatagaaaatagccagggtgttcatgggatgacgtgcatccagactgaccagctactgcccctatttttacctcagggaaccttgtccctctctccacgtttctgtgtcttgagctgctgttagcactggattagagcctcttagatgtgtaagtctgacctaacctttctcctatcttatataaactcagatttctgtgtgtttactgctctaaaaaggagctgagtcaggcatctttctttccatcaaaaccagcgtccttctcaaagaccccctcagcatcagtaccagctcatctctttcagtcttcccatctagacttcccatctccccttcttccttgtattcctaccctgctacggggttttagcatctgtctcttagaatggctttgaagagttttttgaaggtcaatttttatcatctggccctatgcctcattaatttcaaaacaaacaaacaaacaaacaaaaatgttaagtagccgctccaccatgccaactcactttttactaacctcataaggtttcttttttttcttctgaaaccacttaccattattttcccacttgtgaacttccatgttgcctaacaggcccttattcaaaaccatctgcagcttggcctttctatgcctaggctgtgttccttctaccacatcctctccagggacctctattctaatcaatctacttctcatgtcagtgtccctgttcaaactgtcctccatctcacaaaacacaggcctcattcatgacatgattcctttgaccaactcttaggcagatagtcactgctttataaggcccatgccacacatggcaaaatcacaagaaccagacaggcctatggtgttttgtttttttgtttttgttttattttggttttgcccttgtggagttactgtctaaggttacaacagttagctaacctcctaagaaaaggtgagttccttctctcaaaccttataattttaaaatcctaagtagagagaatatttatttaaagtaaaccttggcgggggctatggacagtactcatagtcctagcaccccagaggcagaggcagaggcagaggcagaaggaccccttcaggttcaaggccaacatgagctacatagtaagttcaaggccagccaaggttacagagtgagagcttgtcacacacacacacacacaaacacacagagacacacagcaccattcctttttttaaagtttgtaaattgaatgaatatttttctaattgttttagaaatagatttccaaatataaatgcataaaagaaaggatttcaaatccaaagcctcatcacagccttctaggagtctttataacatatttatccatctcaggatcccacgtctcacagtccaggacccttggcactccccttgctctgctcttctatttttgcatgtggttgtttctgccctccaaacagtcagactcttaatagaagcacacaactttgctttgggttccctctgtgggccttgcaacagtgagcagcagctaagcctcccacgggtgccagaacagataaaagggtgcccagactcaagtgttcacactcacagatgtctgtataccttaagccccccgtaatccaagcaggcttaagcttcaatatccattcacaactggaggaaaatgtgacccttgacggcggtcttcccagtattttgtattcatggtcaaaagaggggtgagcaacacaaaacagaagaggagtgttaaccaacatgtgaactccactagatagagtcattcatttctacctctaagtaatgtttcatcatttggacctcaaatgaacctgtcaccagacatcatgggagcttttagagccaaatccccagaagctttctgcatgactctgtttctgacaactatttttagtataataacaccgcctctgcttctgtgacatttcccagaacaatcgtaaatctgagatcagacagaagggaattttatttggatttaaacttgggcaatgagagggtcaagattagccatattttggatatggaagtcccatggtcaaagctcaggtgatttccaaggagccaagtgaacagctgacctagaaaagtaaattggggcaaaaaataataataataaagaataaaagatagtgcaggagaaacagccgaatgaaagaaacacttgccttgcaaacacaaagacctgagttcaatccccagaacccatctaagaaaaagccaggcctcatgtcacatggttgccatcccagcactggggaagcagaaacgggcagatccccaaggttctctggtagccaccctagcctacttggcaagatccatccagggagataccctgtcgcaaaatgaagtgatggcagacacttaatagaatttgcacatttttagtgaattagcaaatacacaatatagttacctgtagaaagcttggataccattttgactacctgtaattattgagtctttctgcaccaataaaaagattgtgcttgtgcatgtgcaagtgagtgtgtgtgtgtgtgtgtgtgtgtgtgtgtgtgttgtgcacacacacacacagaagttgacatcaactgtggtcttctatcacactctgtcttgttctttaaggcagaatctcccaatgagcctgaggcttgccagtctggctggactgattgaccaggaatctctagggatcttcttgtctttgccttcccagtgctggaacagcggggacatctaggttatggttttttttaatgtggctcttaggggatcaaattcatgtcctcacccttgtgcagcaaatgctttgacaactgacatctctcccagctccttgaatgtttttaaaaaggagtatcaactctctgctggagaattatgactatactctgtgcttttgcatcacagtgatggctactccgacactgcagctttaataactgtaaaaacacacgttaaatttaacaaagttcatctaaggaatcagaaatgttctagaatcctaagcccaggcagcactctaaagagatggtagttcagaatgccccttcttataatgactgtgggctgaatttatggccagaaactaagaaataagaaaatcagacatacagaggtttacccaattggtacaattggcacttgccttatttgggcatctttaagcctgaaattggttagcagtccagctgctgtggttggccaagccttgcttgcttgattactaggctatattcttcaattagatcttaatcgacttacaacccagattaagttgctgttctctacacgggggccccttcatcacccaagtacagataagggttttcgcaaacagcaagccaaattctttttaatgttttcactgggaaacaacgttttcaaggccctacactggcattcattcttcaaggaaaatctcatataacctaaaagggggcgggggtctcaagagtgggaaattgtgccagctgggcctacgcttgtcttctcactgctcacaactttccaagacaggacttatcaccggaactgttaaccatgaggaagccaagatgtaaaaacacagaaagtaattccccatgcctcccacagtcaagatatcacagggtaataatgtgaggctgggccttctggctgctctaagtcagcttcatgaaggccaatggcaggccgaggtgtacttgaagaggtgccagtctccagagactgttactcaggaccctgtgtgatggggaccacatagcaagagcgaaaacttacctctcccggtgccatagatagacaaatccagcacatttcccaattctgagatcacagacttgactgtaagttgagcaatagttggtgattgtcagggagagtccagaaatctcagactcattaggactatggaaagcaaacgaagccacataagccagctaggctgtcgggtggcgatggttcacacattccttctgcctcagccaactgagtagctaagactataaaagcgcatgccaccatgcccatagaaatgtcttttggtttcattcaaattcatgaacatatttctatacactatttgcagctcgttcctcagaggctctggaattatctggaaacagaaccttccatttcatacaaaaagaaaatcttggtcatccaatggaaggtagaggcaaaggagatgaacaaccacgatcattcaattctgcagcatgaattcagggatattattagttgtgcacagatgtggtagccatggggctggacatccctgaagaggactggactgtttggctctaccctcttacgaacctaagaaaaccattcctcatgtggacagaacggccaggggactgaatggaagagggcacacattgctcatcctgtacactgacgacctgggcttcctccttaaccagaaggaatccaaggttccactgaatcaatttgactttttcatgtcaaaatgttctgccatttggtttcagctgggaaagctgacttaaaagaactacttcctcttcagtcagcccaggaatcatacacatcttatatacactcacgtgatcccactccctgaagcagatctttgatgggaagaacttaaatttagcattaaaagagaaaggggtggcagtggattctgctaccagaaaacaaagtggggaggcccaaggtctttaatgcatcaacaggaagatagcagaccacaggcaggtcaaacgaaggcaacagctgtcaccaggactaactttgccctagctatcacacaccttaaatagtaacgttaaccatcttgcttttaggatctttctgtctttcctatgaagctaatattttaattttaattatttcccacaaaacaaaagaatttgaaaacagaaagaaaagaaaccgagatagctaagaaaatagtcgactcaagaatacttgttaatttcaccaagaaatgagaactcagatttaaatcccagagctgactacaacttctgcctcggtttactcatctgtgaaggggagccagtggtaacacctacaccattaagatatagaaagatgatatacataaaaggaagtagaaactggagtcccagcaggagacagaaatgatgcaacagtatgagcaaaggcttactgcaagcaattcttaaatatccgcatgtagttactgctacatgggaataaacaacaactatgaagagtcctctaggtctgaagagaacttgaggaacaagcttagcctcctctatggtagagattcacttggagaagatgaggttgtggctgcagatgatgggaaactgcccagggctgaccaccaggcagtagaacatcaccgagcaagaacggctttcctctgctgctgccaggatgccacaccagggagccactgcctggcctgcctggattgatgggcactcataggcatccatgtgctactggtcacagcacagctcagaagcaagagacaaaaaccatccggggctactaatgtctgttgtgcataattaaatgaataaatattccagtgacacaagaaaagggatgactcggcaggcttgaagcagaggttttataagttggcaagtggctcaggaagaggtctctctgctgtcaccatcactgccactgctgctgctagacgcctgacaccaaagtggaatgcgaaggtgtagccgagacctggtgtccctttccattcccacctagcctgaatttcccccgatcttctacacctgtcgatgggcacagacagtttggaaagcagtaacgcgtgcccacagaaggctgaggtctgatcccccttactaagctaatgtgtactcatggaaagcatccacagtatgttgagtcatgaatcagtgggtcttcccaacgcagaggttgtgtgcgccatgttgtttaaaatcacagatactgaaaggcattacatcccccaaaatatcagctaaaataaaattcattctctgacttccaccttcccggagtgatcctcgtatctgctgcaaataacacagaaaaattaaattaaattaaattaaattaaattaaattaaaataaagacaacttccaagcattatccttaaacacagtaacagacaatcacctttcatctagaggaattcgactcagatagatgcttcaaactgggtaagagccatggattgacagtatccaggacaagctgcaaatgtttcttttttaaaaatctgatgctgtgtgacatctccagcactgtccctcttgcatactgaaggtagactgggataacaccttgacatacttttccgtccccagatcgcatcaagaagagggtgtgtgccataacttgagacaaagccgacagaggattacaggttgaggaccctgagggtctaatatttccagtctcagaatgtgtcaaatagtcctggcaagagcttcatgagtccttagtgggaagccacctcagaccacgtggggaccagcaagaacccatcattattggataaggagtccagggaccagaataaccaaaagatgatgacattctgaaataaagcaatggtgtttgtgtccaggaatttcacttgaggaagcaaacaagggacctccaatttggctgtctgactggcagggaaaggggagcacacttgagctagtatgtacagcggagctctgggagggctggactagagccctttttccatcagcagcttttgtgctccatccaagtccttctgaatgaacactccctaactcttctgcctcaaaattgtccctcctcaagcgaggacatactttcttggtttggggtaaatgctatcaggtggtcaagacttgtggtccgatggcctagaagagttggtcttcaagctttggtggagtgttctagaatctcaaagctctacagcaagatggagtgacttttcagactctgtaccttatacttaaacatgagcatatctaatccagccatctgatccttcaactgaggtttccagggctccctgtggttgtggaaataagctgtgaaccagctaagaagtgagtctgatattccccacgtccctcaccaggcctaggctgcagctaccttagcaaagtctgcagagattcatgtctaggaggcttgaggtgtgtgtgtgtgtgtgtgtgtgtgtgtgtgtgtgtgtgtgtgtgtgtgtgtgtgttctgaagccaagaagccataaaaatatatctccaatggatagaagatagggcagggctagggaaagagccaagctttgtacgaagataatagtcccaccaaaacaaaatgtttcttccccagatgcatccagactccatttcatctgctctgtcccaattccttggatattaacaatagtgacaatattagcagattagaaaatgaatggacaaattctaaaggaaaaatttgaattgtcgtcactctgcaatgttcatacttaagggggtcgatattgattgacaggacctagaatcacctaagacaatcctctgggcaaacctgtgaggaatcatgtagattggagtaactgaactgggaagacccatcccaactggacagtagcaccactgtccgggctgaggccttgaatggagtaagagcaagaaagaaagtagattaaacactaacatcctttgctccccccacctgcttctttacagtagatgtaatatgtcctgtgctcatggcatccacaccctgatggactgtgccccagatctctggccaaaataaacctcccccttccttgagttgctcttgtttgcgagtttcatcacagcaacctgtaactgaataagtactaaagctatgtgggttttttttttttttggttgttgttgttttgggggttttgttttgctttgttttacctgttagaacatttctatttgtttaatttctcgttctttttctccaataaagtcccactaagtagctctgctggctggagctatgttcacttagctgtcctggaactcacagaaatcagcctgcctctgctcctggcacactgggattgagggcaagagaccctatgcctggtgacaagaagtttcctaaggaaggatttattttggattatggttttatgcaacacagcccatcacagtgcaggaggcaactgcgtggcttttcttcatttgcttttcaactaacatacaaaggaaaggtctcaccaatgtattcccaaacttgcccagttcttagctgtctcctccccgccactaccctgaaccccagactccagctctgaaaaataaaaccctgacttctgtgagaaaatggcagacactggacattgtgttaaacagagtggcttttaagaatgaaattttactttgaaacaaaaagaaaacaaagattttgtttctatgttgtgggggtagtttgttttcattgttaatttctttaagtcaaggtcatttctttattttttatttttttgagattatgaaataattacaatatttctcctttccttttcctccctctaagccctcccatatgccaaacacctctccttggcttccttaagatccatggcccctttttccactaattattattgtgtgcttatacacatatgcatacacacacacatacacacacctaaatataacccgatcagtgggtataatgctgcccgtatgtatgctttcagggctgaccattgggcagaggacaactaattcacagtctaacaacccagcattggaaacaggctggaaacctttccaccctctatcatcctcagcaaagctgcctttcaacttctttaaaacataccggtatttgtccaatggaagaagtataccccgcctacactgtgttcacatccacctcctgcccactcttcttttgcccctgcctagctcaagccttggggcacataaccagcactgacactagctggacctggctgttcacataaatccatggagctggctccgaagactggggtcctggaaacatggaagagctcatggggattgcttaaaaaaaaagaagaagagatcatggcaagcttcctgcagccaagctgaacttaatcccgagtggaactgaagggatgggctcctgaataaagccaacgccagatatgggtgttttctcttctgatcagcactggaggacacattagagaattgtctgggctcaggctgtggaaaagtagaaaccatcacaaattctaaagtggtgaattagaagtgtgtgtctaagctgaacagtagctcagtgaggcgatgatgatggggtcatagtcacaatcagctcaagctgcagactcacctggaaaacttaaaatgccattcttagaattaattggcttcgttgtcctagaaagtcaagtgctaccaggtaagtatattagggagttggttggcagctgtgagttataaagagacagtctagagcagtggttttcaacctcctaatgctttgaccctttaatacagttccttatgttgtggtgacaccctagccataaaatatttcactagtactttatagctgtagttttgctactattataagttgtaatgtaaatatctgctgtgcaggatatttgatagctacaggtctagattcacgattctggaataatagtctgcatgggaatcttggacaagaagagtgctgtgttagagtaaactgttgtcccttcctctctctcagaagataaaactttgttagaactgaaaatctgctgctttctcaagctcctagataaaacggccactgctgccagagtgaagccggagaatccaggaggcatcccagtgctgctggggtgtcagaggagacatgtgtgggctgtatggtggtccatggatctccctccattcagtgatgtgaggatgcatcagctcgcgcacaggcctagggatgtgactgtgagcatcctcagcgtggggatagaactcggtggtgagcctgtgtcacttctctttagtctttcacagcttcatatcccaaacttctgttgatcggcatttttggtacaaatcagtgctctctagacagccttggtgagctcagtctaccctgacttgggaacatttgacattccgttcttaaagcactttctggatttctccgatcttggctagactttccttctgtttacaaacttccatcctatattgttcagccaacttgcttctctgccagcatctggacaggagactgtaggctgtcatcatggaaagaaacataaggtcagagctaagttactacatgaaccatggtgaattccagcaaaattacacggtatgagaatccgactcctgacatcatatggttcttgctgagataggctgtatgtggaatttctatttaagaacagaatgttctgtttagaacacttagccatcccttcctcaaagaagcctcaactaagtatcacccaagctatttagataggaccccaacatcaccacctcaatccaggacagagcttgcaagtccaagccagtcagcacatgcttgaagcaaacaacatattttcaagaaaaaataagtcacaatgatgtaacaggatagtatgaaatccagccagggggttaggtcacagagtcatgccagataaactgtggttctgggctgaaggagttccagagcccatctggcaagctactgcaccagggtgagaggtaagttggacaccttccccaggctgacccaacagacgtgtttttttttttttaatttgatagccccaagctaagaaagcacttcgaatagatactattgattttctgtcactgtcaaaattcttactttattgagaaaaccagaggtccaataaagcacagagtcttctcccatgaccctgtcctgagcagctcagcctgtgtggacagccatgtttgagaggctctgaatggggctgaatgaattcatccacggcatccacctaggccaggctctgtccaggcagacatgttaatgtgtctccatcttcagacaactcagcccatcatggtgcaggaggcatctgcgaggcttttcttcatttgctttttaactagcatacaaaggaacaggtatcaccactgtgttccaaatttgctttgaaatactgaaaaatgctgaagccaggaatcagaccaacaacatgggcagcccgtctcatcccagctgtctgtaagaaaattgaagaagctgcaagctagagggtgaccgaagcctcttactaagaacagaagcctcatcagagactgaacaaccattaaacaccgtagaggcagaggcagttcacacacaagcatgcatgcatttatagtgtgcaaaagggagggctacttagcattttcatgtaactcagaactaagagcaactacacagagatcctaaacctatgaccacccttctcctgcttgaatgaagagctaagagcctatcctgggctcctctgactagcttggtcagctttctcagtacctcataaaggtactgtgctcagtacctcagtattgcactaaagaattctgaacctttccaaacagccttggagtacttaagttctacagggctaaaaacaggacagaatacatgctttttactggagagccagaatggttttcatcaggtttctataaagtctgtgcatagacctaagaatacttattttaagagctatgtcctcaggcagccatagtggctggcacctgtaagcacagtccttgagaggctgaggcaagaggatagtttcaagttcaaggccaacctgggctaagtggtgaggtctagtctagcccagccttggcaataaattcaaattctgcctttacaaaatggggtgagggggatgaaccttgttctctacagtacagtggtcaaaatcagtataggatacatatatagaaaataaagattttcaatataaactttacctgcctgaggcagacaaatttggggctggctgctgaattagttgcttaaagaaaacagcatgcacacaccaataggaaaatccgcattcttcccaggtgtctgcctcagtacttcctggcttatgcctggctagcccgagtattggtagctcactctgtgcctccttctaagcacatcatttagggcctagcgatagaagcgtgaaccatcagaagtacagtgttgttctgtgcgatccgggaatgatctacagtggccacacttttggttttgaagcgttttattgttaaaccaatgtcaaagaataaatagcacacagcagacagatagacttgtagatagtgaacactactgaacctggcaccccccaaaaaacagcagagattggaagcccctttaaagcagacagctgaaaatcagagtggagagtttagggcagagcagggtgtcccctcaggtgaggcttctgagtgaaaagacagatagcaacaacagaggtggcatcatcacctgggcactcacaacaacagcagacaggggctgtggaagttgaggcagtcactgtggtctcggcttctctttatatcacgagatgggtaacagtaagcgctgttggacacagtttgcccgaggtctgttctcaaggacatcacgttttttattttggagttgatttgttctccctcccaccccacccccatccacccccagtcacagagctaaggaggcagcccattcccagataggggccttgaaggtcactgacaccaatgtgcttgagtctgaaacagaagggataagcaatctggctttcaaagccagcttctccgtgagctcaacacaggacttaccagtatagcctacatttcaggtgccgtgaaaagacaagatttagaatcagacaggcatagatacaactgagactgacaatcccacctccacagcaattcagcttcctcagcccaaagtacaggatgtgaggatgccaatcaatcgtgctgggcttttctgatgatgaatgaaatcatgcgctcagcatgcctgtggcgttgccaaggatacaggggaagtatgtgttgaggagaaatttggaaagaatgttcttatcttctgggaaactcctgagcatggattgagactgaaaggttattaaggaaagcatctctgttgagatgtaaaaagttggagcgtctcggccacgtgctgcccctactgtggagcccccggccatccatcgttctttctctgacatggactggatagtaacactcccaaaccgtgagccaaaataaggccctcctcccattagttgcttgagtcaggtattctccgtaagtctctaccgcaaggatcaagagtgccttaactccacaaaccaacaatgcacctttgcagcctgtcctgccagcccgctggtcagctgctaggctgtgctcgggcacagatagcaatgtgtgcttttatttgtgttcccaaaggccaaatttggtgctgatttcatattcagttcattgtaacttatcctgccccttctgattcactgacaactttatttaaacacatcttctttaatgttgcagtggtaaggttcctggtgtaaaacagccaggaactagagcctggttttagagcccacactctagacaccaggccacttggctcccaaggtcatcctctcaaacagctgacacttctctttacagttagcgagctacatttttctctaacctgttctttatttgtgcacatacacatataccatctctgcccaagagaaaactaccctgagcgcagtggtcagagaacggcctgctctagagaacagcctgctctagagctgagggagattttcctgtaccctctacttcccttcccctcccagactttcatctcagtccagcttattaggttcctggaaatccaccaccgccttcaccctgatcctcctcacacccattgtttcccttccctgtccctgtattcacgtgtctcaatcctgtgccgcaggttctgccccttccgaggagtaatctgccatttgcctcaaactatcaacaggactgtgagtctctaagagatgaaaagtatacttcattactgtcaagcttctgccaaagctggccactgcaggagacggtcacacattttcattacaaggtagcaagaagtacatgggtggattcatagattcaattactacctgcttaatgaatggtaaatcaggggaaaggagaaaagggctttggacaggacaggtgatgtctgacctcaccctcccagcttcaacagaacatgccagtgatgagcacaagaagactagactctaccaaatgcatagactctaccaaatgcagcagagccttagactcagtccaactcactcacaaagcactcgattagaatgaagagcactgggcttttaagtacctttgtatgctaatgctcagaaaatgttggttttcagggttttttttgggggggggagttattccacatgtttgaacacatttttgcttgggtttgagattctgtaaccagccagttgagagaaacctgccctgcttctaacaaagtcattctaaaaacagcagaaatttccaaactggggttaggaagtatactggctagttttgtgtctacttgacacagctggagttatcacagaaaaggagtttcagttggggaaatgcctccatgagatccagctgtaagacattttctcaattagtgatctagaggggaggtccctttgtgggtggtgccatctctggactggtagtcttggttctataagagcaggctgagcaagccaggagaagcaagccagtaaggaacatccctccatggtctctgcatcagctcctgcttcctgacctgcttgagttccattcctgacttccttggtgatgaacagcagtatggaagtgtaagctgaataaaccctttcctccccaacttgcttctttgtcatgatgttttgtccaggaatagaaaccctgactaagacagggagacatctcagttgcaaggaccaaagctagggtccccaccacagaactaaatgtcaggtgggcacggcagggagactgagaggcagggtacctgaagaaaagaggctagtttgtctatctaatttggtggagatgtgggttcaagtgaaagactctgccccaaagcataaagtggagcttgaggaagacacccaatctctaccatcagcctcccctcacataagcatactaaggctcctactcatgtgtgaacacacacatgcgtacacacacacacacacacacacatacacacacacacaattttcaaaactaacccagtattagtattcccaacttttgacctttgccaagaacatttgatgaatctatgtggcagtaaatctccaacccaagaaagcccaggcaaagacaacacaactcaattgatatgaatacaagctggactggacagatctaccactacactaccatcttccccatctatgagaccccttagaactttcagtttctccaagccaagtgcttctgctccatttttcttccaccttctctgttgtcctctcctcttctccctcctccttctctctcaaactttccactccaccttcccttctcctgtccagtctcggactctagccttttacaaatgaagatggggagaaggttcacaggaagtcacctgagtgagtactgactcattccttgttcgaaacccctcccaaaagagcaaaattagcatcaaaatacaagcagccccagggctatctgcaacatatctatatggaccaatcagactcaagagcgactttggcatgcattagcgtgttgtgtggaggggagaggtgggactgtgctcctgggttgtccaaggtcctggccgctggcattaactcatctgctgctttcctcgtggcttctctctggctgccattaagtgcaagcgctactgcggtcatgaagcccacacacactggctttcagctgccactcctctctgggattttggaggagagcaaccccttggctggctctagcaagcagctgcaggaagcagaatgacatcacctcccccaacaccaagtctctacagggtcaggcgtggatcagccattttttggacagaacacacacaaacaatctacctctttccgccctggaaactgagctcacagctttagggagcccagcttttctttccgtgtgtgccaggtgatgtcagagtgagtgtcccagcacctctgacactctgcaggtgcttcattcatgggacaccatgcatccctaccagatggcggcatgggagacagacactcagctctggacctaacttcatttaaagttataaggccattgggggacagactcgcccatttttttggactgaattctagagatgttgggccaatcataatgggagagataccagggtagggtggggacggagaagagcttctcgagagagttctccacaaataagatttcctggaaatatcttctcacttcagtcatcaactctcaatctgggctatggaaaatcctgcattgtgggtcagacgtggggatggaacaacagttaaagataagttgctttgttccctgaaaggagagaggtctataagacagacaaaatcacactgttctaattccatgggaaaagacaattcttccttcataagtattgctaaaccttagcataattcattctttagacatgaatcttagagagacccaaataattgagtatgaagaccatgagaagtatgtttataatattcatacttttgaatctctgacaattcctgggaaatgctgctttattgtgtgtgaatgtcaaagataaacatgccaaaagtttataaacactaagaaatgtgtctttttttccccaccgtgtatttctaaagtgcatcattgtagctaaataagtctattgttttaaaagtaaaaaaaaaaatggcctggcctggtggcacacagcctttaatcccagcactccggaggcagaggcaggcagatttctgagttcaaggccagcctggtctacagagtgagttccagaacagccagggctacagagaaaccctgtctcaaaaaaccaaaaaaataaataaataaataaaaataaagaaaatgagttttgcagttatagttggctgtactctgcctttctcaggacagacactatacatagattaaattactgagcttcatcaaacttgcccaaattttccagaaacccaggtttcacttgttcacgaggttaggctctttctgtgcccagaggtagccagctatctgctaatagcagctcaagcatcaggggcactggtgtgcctcctcggaaagatggacccttaaaaagatgcagctattccaaaccttgaattccacagcacgaagctgactgaacaaaatggtgactctagaagctgtcaaagtcctcttgttgcagaactggggaggaggagagctaagaatcggaatttctcatcctcagccttcttatgggagtctctgccaatgccaggacctcgaagccttcctcccacccctcctgagttcacctccactgccttctctcgggaaacagccaagctttctatccctgctttcccaccactgacatatctaagacccttccaccacaggaattcacacagcttgattgtagaggggtcctaagcaactgttgtcatggtgaacaggtgatgttgtgatgttgtcatggtgaagaggtgatgttgtcatggtgaacagggtatgggctttagaggaagccagagttcaaccccagttctggaactgcgtgctggagaccttgggaaagtaactgaacctttctgaaattccgttcctcttgtttgaacttatgctaaagtaacaaagttgctagaaggatttggtcacgctgtgttgatgagagcagagttatttatggagcttgtgcagtccactgatgcagagagcactcactgaatcccttggaactgctacccagtgtttgccaagtagaaggctgcagtgctcagatagaactatcgtccttatcttcttagcctctctcaatgcctcccaataaggagcttactttgaccactgcatcaaggtccgggcaggaagcagatggtgagcccccgttgaggagatcttttcaaaggaaccacttgcagagatgactaagggaactctccgagcactccaggactaaccacagcagaaaggtgtctgctcccttccagccgaaggtcaaggagcagagttgttgctaagccaagagagccatagctgagaagacagctccaggggacctaaacccctcagcggaggattgggcggggaggggaagaaaagattcactcccttccatcccaacacttgtaccttctgatctctggctggtgctaccaagggccaaagccaggactggctatggatttcccttgatacaaggctctgctcccacagaatggagcagagacatagctgtgtctggtggtgtgtatggaaaaatatgagatagtcattaagtcaccctgaatattcaaattaacagccctctttcctaatctcctaaattcttcagctactactactactactaataataataataataataataataaccatacatattgttgatatgataataactattatatatattatattatagttatcatatcaacaatatgtaggtaacttctaaaataatgtttaaaatctactcacattttcacatttctgccttggacattatatttgtaccaaggctaaagaaatcctagacttgaaagatgaaattaattcactttttaaattcttgaatgcctgtgcgtaaccaaaagctgtcttggtggtggggccagccctgtagattccacttggccttgaaaagccaggatctacaccccaacactgcagttggtttggatggacaccctgattagtgtcatctggtctcatgacccaagagctgccatgagatccacggacttcaccgaacacggagcacagtgctgcctgagcacagcctaatcatcaccactggcaatgcatgaagcaggttggtaacaataagtcacggtcagtaatccttgctccagtctaccctgtcaccactaaaaacaaacaaacaaacaaacaaacaaacaaacaccactgaatggaaatgggtggaagtaattttggttctaatgagaattttgcaccattttttgctattctagaaactgtactaagggcctcacacagatcaactcaaccctactagccctcaagtgagcatatgttgtagatttgtgttttataaccaatggaatgaagccagtgaatattacgttacttgcccaagaccaaaacctgaggaatggaagggttggtgttggtgttccagcaaccaaactccagattgtgtttgggtttttatttgctttgtttttcttttttatttgtttaactaaaatggaattgtgtcactttccccttccctttcctccttccagccctttccagaaacccgtcctctagcccctcccctgcccccttctcaaatcggtaacttttttctttgattattaatgttaacatgttgtgtccttttttctggttgtgtgaacttggtttcaaggctttgtatcagataaccaggatggaaactcattcctgggatgccaccccaaccccccagtcatcattagttgcttattattctttgtctaggtgtgagactccatgaaaattctcttcatccacatcagcatgcctataggtattgcatcaatttatgtgatgggatactattcagcagtatcttaaaataacatggacaaatgttaaaatctcatattcatattataaaagaagatcaagaccccttagaaaatatactctgtatagttccacttacctaaaattctttgaaatgaaaaagaagaagccattatgggcatgcctgtaatcctggcaggaatgtcagaagattaatgtcagctttggccacataatgagttcaaagctagcctgagctacaggaaacactgactcttttttttttttttttttttttttttttaagaatgtctaatgactcagcccgaagcagaatgcctccatcaaatccctccattcagggctcagggaacccaaagaagaagaaatagaaagagtgtaagagccagagtagatagaggataccaagaaaataaggccctaaatcaccatgagcaactcacacatgaactcatagagactgaggtagcatgcacagggtctacatgggtctgcaccagatggagttctagcgctgaaaggagaagtaaacacatgctcccatccctaactcagtctccagttgaattaaaaattagtgcaatctcaatggaaaaccaattcaatagaagttccttgtcttacaatgttagggcttttcttttcttttttaatttttttctcttctctctgttttaccctataggtcctttgtgtatatacaacagcttccagtttagagtttgtatgggatttctgagtttgtgaatgaatgggtctctgtttcttgtgcctctctttcctggttttatctttattttattttattttattattttattaaagacagaaagtgtaaggacaaaagtaagccagtggttggctgggactggagataaaggggggaaatgaggatgggggtgggattaggaggagcatgaaggaagtgctggcgtgagcagggtttgttatcccgcttgtgttggccacaccatgggcgtagacctttgtcaaaactcatgaaactatacatcttcaatatatgctgtttatatacagttgcaaagttgcccatttttaaaatcttacctttttacaagcttctggtctctgtacgtagacaggcactgtagcatccacacccagcgccctgggttgccttccctgatgagcacgggctttgcagagacccactcaccttcctggccatcttactatctcttgctctttgcctcacaggttcagctcttatttgtagaggcctttgatcagctttttttccccaaatcttttgccacaagcatgcatttaacataagaactcaaatgcacaggcatacaaggtgacagaaggacaatgacagtgactacagagagagagagaccacagtgtgggtggttccatctaccgtttcctctagtgagtcaaaggtgcatagtgtgactgtttctcttccatctggacccactgtgtacatcctgccattttaggacaatcatatcattcggagtgaaaccccagtgtttaaaacacgccttcttttttgtacggcacatcctctaaatgagagccaaattcttcatctaccattcaatcagagagtcaatggtacctgtcacagactggaaaaaactattcattgtgttgaataataatctcttagaaggagatggaacatttgactttcaagtgtaacttcatatccaacatccctgccatgaacacagattagtatatcctgttgtattttcagaataaccccataaggtaatccagacaagctttttatccacacttgacagaggaggaaacagtgcctcaagtaagattgtgacttgctagtcacacagctaataatggacaaacgttccaagaacccagagcatcaggctgtaagtttagtatttcttgaaccatatcgacacctccatacagggccacgtggcttatcagacagaagcattacttctggcctggagcatctttgagttggcaattctaaatgtcctttcacaagctgagcagaaactcgggttaatgatcactggctccttctcactctcgtcttccttctcaattcaaaggaaaacaaatctatccaaatatggtgactctgccacacttccctctcaattagaatcagaatttacttcaatggacaatggaattgaaagctctccaaagtagccttaggaaagaggcaggaaggtaaggccaaagtatgagaaaatgatttcacagactcagagggagacaaaatccttgggaaagagcctggtatatatccacaccaccacagctaggcatctacacatcttttcatctttggacatcctaacgacagcctttggtaagagctggaggggttttaaccagaatgagaaaagcaaacttcctttcaggggttagaacttctccacatgggcagttaatgccccgtagatgagggaggatggatacagcaacccatggggtgcctggcatcctaaaaatctgaaaactaacttcctgtatccattatccaacatgtccttcatgaagaaggacagccatgacaaacaggacattgtctactgtctaaatcaccaattgacagagtctcatcactacatcaattaagactcgattcatgttactctcccagtatgacaagtggaatagaggccatcccatacctgagtcagaccaggaaccagcattggtcatcccagacaacagacacatctatggagaggaggaatataccctgagagctgtatgttcacagaggcatgttcccattcttagtgagcctccatctcagaagcagacaacagtgtttagcatccacatacatcctcacaaatcagacagctggctcatttatgccagttgaggctgaagggcagagctaagctactgcatttttgcttactcagctcagctgcagtgtaaacagaggctccaaggctctctcaggtggtagagtaactatcaaaggaaatgtaccacttggaatgactggtttttttttcccaatttcatgtctgtgggcctcagtaggaaggtcacatcacagtccaagcaatgtgggtcccttcgtacaaagcatcatccaacaggtaccagcctgaggactggcctgcaggtttcatttggctgtgttctttttaaatcaaggcatcatttctgcctatacattcaatttcttctctcctggcccagtagcgaggtaggaggacaccaagccattggctaatggtctgcagatgagggaatgtccgaagaaagaaagaaagaacgaaagaaagaaagaaagaaagaaagaaagaaagaaagaaagaaagaaagaaagaaatgtgcgctctcatgcttcacaccttcccttcagagaagaaaataggagacaggggcttagaatgagacacagacaggttccaataacactcaccttgccagcgcctgaggaaacccggcagcttgcaaaccactcttcaggcctgggtgcgccatggctttaatgcaacattgcaggattttttttttcttttattttccagtggcctaaaagaaacatggtgtgaaatacaaaacacacataggccctggctagttgaggaaacagagggagtatagagcttcactgtgtttatagtatacagagagatgtttatataaacccttccatggagcgcagactgcttttcttctagggacttgaatgcaaagctcttgaggacagttctctgaatgttgtgacaaatgccaccatgaggcttttgaaagggtagacctgacaagggaacctattaccgagacctccagccactagtaggagtaagtccaagggtagtgctgtcttaccaaataggctttggctacctcatcctgaagcaggttgtctgtcataaatggagggcgtgaagcacaaacacagcttggtggctttccagagtgttccttctggtgacaacctaaagccaagatcatttttactctataagctgaagagttggctcagccattaagagtgtgaactactcttacagaagactcaagctctgttcctggcaactacgttgggtggctcataatcacctgtacacgaagttccagggaagcaaatgctctcttctggcctccatgggcacctgaacatacatgcatgcacacacacacacacacacacaccatactcaccacgtttaaaaataataatcttaatcccactcccgtgggcatgcctcacatgtggcccctggaacatctgagatctcacctcagcacagcctctctgcctccactcatggtgacctggtgagaatggagatcaggccctggcagtgccggctactgaatcaaagacttaacactgaattgcatggcgtactcagtgactccttcctccaagctggatctagactggactgagcagctacttggagtaggtgagagccaggtaggcagctatttgaagctcctcccaccagcccaattagccagctttcctttactacagcacatatcagatgtaaatcaactcccaatgaggaacagtttgttttggtttacagatgcagacattttggtcctgttgactttgggactgggcccaagtcagcatagcacatcatgacaggaaaacagggcaaaggaggccactcatgtcccagcagccggcaaagaaagacagaagaggaggggccagagtcccaatacaccatccccttgaagaaacttcctactgacccacttccttccactagactcacttcctgagacttgcactggtccccagtggctctatgggctgggaatcaagcccaaacacagacgcctgtgaagcacattccggaccctagctacagccaagcagcaaccaaccacctgctaccatagggccaggccaggcagctgcctttccacagccacactgctgcctcgctgaaatcccacagtgaccttttaaaataaggtatattcgacaacattctcaaacaaaggccggtgcagaagtccagaaatatgtatttctgtgacgtagttctccagattcctgggatttaaaaaatatatatctgaactttctttgcaattcaagttgcatttttttggatgatagagttgctattgataagttcatgccatcaatgcagttatttctggattcttaactatgtagaccaaagctccaaatatccagaaaccatggtctcccttagaaaattcattatctgcctcatgagaaaatgtctccatacaattaaatgattcagatctaagcaagaccagtacagaagggtgggaatgagaagggctctcactgcctttgggagaacatctcttgttgggttaaacagttactattccaaaatcatttagaaagattcaatctccagttctaggtccccttcaagtggataaatgaaaagatacttttgcttcatgagccaatcagtgtgacaccatggacattagaaagcaagtaagaaattttattatgaagcatggtgactcatgtctttaatcccagcactaaggaggcagaagcaggcagacctctgagttcaaggatagcctagtctacagagcaagttccaggacagccagagctgtgtagagagaccctgtctcaatcaatcaatcaataaacaaacaaacaagcagtccgactttattgtggaaaaggtatctatccattttgcagtgcttttaatcaaagcatgaaatggacttgccgtctgatcttacctgtcacaaatctgtcaggctgctcttaaaattacataaaactctgttctctcatcaaaaataattacttttacttcagtaatctttatcagtaatgactagtgatgactgcagtcagaatttgcagaacatgtggacacccaggatgtggaggggcaaagatatgtcctgagggccttacaaatctacaagacagctgtgcaaacagacaggctgtgggtgaggcagcccaaacagagggcactggagcctgcaggcagaggtccctcagtgggcgaggccaccaggaaggctttccttttagaaacaaaggactgaatagcagagaggactctccttgaagtgggggttttgaggatttcgacaaaggcagttggtggaaggaacatggtgtctgaggaaataaaacttgtctgttaatcaagatggaaacaaaacatctcacaaaggacagattaggaggtgaaggcaaaggtgtaagctgtggcactaactgtaaatgtcatgaaaaccagacctgagtacaccaaggaccacccagatgccacactatcaaattctcatctactctttcagtgccaattcagtaaacactggtagaatgctttctttggttattggtggtagtttggtaattggtggtggtggtttggttattggtggtggtgatcttattattggtggtggtggtttggttattgacaacagtggtttggttactaatggtgttggtttggttgttttcttgcttggtggctttactttcaagtcctgggcacttgaacttagcatggtcagcaactgggaaaacagaagggtttgcaagttgcctagctgcaactaaagaacagaattaaaattccaaagccttaatcacatgataaagcagcaacacaactctgacacaagtaaataaaagaagccttaaccacccgagactgtgacctctagctttaagctgtaaaagcggggacagggattttcagacaagttgttatgtaacctcaaactctatgtaactgaggatagccctgaactaacatttctgcctctacttctcaagtgatgtgtttatatgccacctgcacaaccttcaatctacccttttagctggtcacttcagtttgatctctagtggatcacatagtggattaggtagctgatattcttggtgagaaaacttgtttgattgctagagccttggctcgcagctctaccactgtcctgttgagttgtcaaagggtacttagggacagggccttgttgttttattccattttatagatgaagtagttgggcttccgacagatcataaaacttatgctgagtcacccaacttgggctccagatatgtgaagactgtgcatacatacaatgtcttggccaaaatcccaacgttgtctctctataatctactgcttaccggttttactgttgatttctttaaactttgtaagaaattttggccttccaagtaagcttttagaccacaccaaaggaagaacatcttatattatcaggctgccagcttaggagatgagagctaatgtttaccaccctcagtgtgtcatttgaactccctttaccacctataggatgctggatctaacttctagagttgacaggtatgaaatcaagtttagaagaacgaagtcatttttatttgagttagctagtgagtgacagcattcaactttaaaggcctaagctaaccaacagaatagggtccagatggacataggaaacactgatactcacacgaggtttctcagcctgatttctacttctttaataaccctgccctctaagtcttccagttgggaggaaccttgttcatcatatgtgagaggaaatgaaggtatttgtgggaaagacactcaatggaaccttaatggaaactaagaagctaagttctgagtttcaactgtgctgaatgtatacattgtacttacaggaaccaatggaaaagcttttctgaccctcataaaagcctgaacacctgctatgcaaagtaaggcaacgtgtgtcaccttatcccacctacagaagatggtagaaatccaggaaatccttgggcatggtttagtgtggtggttccactaaccttgtttggaaatagggaaaggtagtctgaacaatacaggccctgggttagccacaaatgcatggagggttgagacaatgagtaatgatatgcctctttattcaaagtcctgaaaccatacatctagctcaaaatggaagggtcgagtcccttcccacaccttctgagttattttttcacagaaagcaatccgtctccagcttcctggcagcttctggaggctgctttgtgtgttctacatcaagagcagaggaggccaggaaagctgcctactagacttggaggactatcaactttctcaggggtaaacaaacaaacaaacaaacaaagcaaactgaggctgggggaaatggctcggtgggtaaaaacccttgtcatgcaagcatgagggcctgagtttgagtccctggcactcacgtagaagccagacatagatgcccaagcctgatatccccaaattgcaggcatgggtggtcagagacaactatattccaggagctggctggccactcaatctagctgaatagtgagtgaagtttgggttcaagactctgtcttacggcagtaaggtgggcaatgatgaggatctgtctctggtccctctccttggtttgcaggtgtttgccattgtgtgttcccattctcctcttcagtgtgtgtctctgggtccaggtgtggtcacttttagcccatctatataaggacacaatcctgttggatcaggacccacaccaacagcctaatttgatgttgatccctatggaaatagcttaccaataaggagggtcatgttctgaggtgctgggtgctaggagcctctagaaagaggacataattaatcttcctccaccatcctgtccacaagatctagttccaaagtttagaagatggagaagaacccccaagattaatgtcttttaatagacaaggtgttctggaggctagaacctgatctttgcttccacagacactggctacagcataaatggaagatcagtttgtcctgtttgtaagtgagcagaaagaaagccaagcccactcccacaagcctttgcaagcataactaatgcatcctagaggtgagagtcccagtacctgaattcttccagtggtggaatacctccctacacagccacatggaggattaaagtttcaacctatgaatttaaatgaaatacaagcattcatctcacagacccatatgaacttgagctgtctgtgagtagcccttagtgcatggatggactggctgccatcggggtgctctgcccagtgacaggatccagggccatctactactttaactgagaacagaaccaactccagaagaacactagcatcttcatttgaagatgattacctatgcaaatggcttatgcaaaccatgtgctcaaggatctgaggcccctctacaccccattaatgagaaccccgtcttggaaagaagagatggtagaaaagtgaatggtggagatttaccaaaaagatgcttccctaacattgaccatttttaaaatcaaaatatctttaaaccattagagtctgagatgccttaactaggaaagtatttttacccagtggaacaagaacagactcaccacagaaaataaagatgtgtattttcttttcacatctaattaatgattaaaattttattctgtccccctcccagaggagaatgcaaacacagtctcccactaccacagattatgcagccgagttcccagaattagggggaaatcacaggggtcagctcatcctgagagcaatggatgaacctcaacctggaaaatctacctttgtcatcatggagtctcctccaaaaataaaaagattggtcaagaatgaggtctccaccaagactgggaacaactgttcaggtattaggctgaatttcagtgaagacaagagatacagtcagtcactgttggcagcaggaactctcaaacctatgacatcacataggctacagtgccacctgcgatctgcagaccagttgccaaggcaacaggcaccatattcccaacatccacttggctcacctcccatctttacctgcgttatatcattctccatataaataaggagaacacccctccctcactctctctccccctcttctctttctttcgccaccttctctctcttccccccaataaaacctcttccacatggaactgtcttggcctagggtgctgctgagacaggagccgacattctaacacatcagtcactgtgaccacacccttcaatgtgaagcatcatggcacactgggtgcctccccaacttcattccttacagagctttccagtgacccccccccccccaaggctatcttatttcgctcccgaacacccttcctgcttgtgatcttacttagcctttccctactcattaatacctctttagagctcagtcctccactcacaggacaactgcatattctgagtcctccagagggcttccttcggccaatccattgccataaagggactctctgttagcacacgggtggggcacataacagctctcagggaagcgataggatcagaatctggtagtgaagcttgtgctaatttcagcagaaagccccagggtctacagtgactgtaagagcattggcaccctggtcctcgagccacagaaacaccatttatggagaagcaaatgggagcctggagcaaatgagccagaaggacagtgaggtcaggtccacgagctcagctctgaggccagggcccaggatgctcaccgccaatgcagctccagcactcacctctgaggccagttcagaactgaaagtggctccttactaacttggggtgtgtgtgtgtgtgcacgtgcatgcgtgagagagagagagagagagagagagagagagagagagagagagagagaactctacaatgtccacatttgaaccttcatacctaggagctgacagattttcggcttaccctggtatcccactaaaagggcagaaaaggggctcaccctcaagtggaaggagaaaaggcagaagactagctttgcatttgcacactgctatccccagttgagaatctcgaattcctcccaggaggcgctcagctctttccttcccttggatgcaggcccagtaggtgatgcagtttggatgtggacaacataaccacatgagcatgatgagtccaagcaggacccattccaaccatgacagcacccctagcagaggcaaggggagccatccacgatctatagaggagtagtcccagggaagcttgccaaagggactctgcttacatcataaaaaaggccaaagaggatggcaacactgagctcagaactctctgaatatgaggccatttctgggtcaagggactactctgatttctcaaggattgtgcttccaacgaaggttttctcacccttaaatctaaggggtcttaggcattgtgtggaatttcgtttactttatcatctgttgtggtttgggggtgaaatgttcccccaggctcaggtgtttgaacaattggtcccccactggtggcgctgatttgggacagtgtaaaacctttcggagatggagccttgctgtggaggtgggaagggacagcttgagaatgtttagcccagacccacttcctatccactctgttttctgttctggatgatgtgtaaccaaccacttcatactattccatatttttgctactgtgccttccttgccactatggacttcccttcaaaatataagccaaaaaaaaattccttccccctcaagttacctcttatcaagtattagtcaatgcaaagcaaaagtttaaaatatcacctaaaatatctttatttatgaagagatttgacatctctcaaatacggattttgaggaactgatggaaatagatttaacccctgtgcttttatgctaaggaaagattctcatccaccaggtatgcttacatacaagaagccacctacataagtcacatcgtgatctgggcctcaatgctgacccacatgttaaacagagagactcaatttcaacactctctgagaaacaacttcctacttaaatatggtacggtgctatccaaatgtgaaagttttcatttcaaatcctgggaatcacttctacaatcctaaccttgaccgacctggtttctcctaatcgcaaacctgattggcatgcccacagagtagaaatgagcagaaaattccagagagggtttaaaagatcaagcagactagaggggcgcatgctctgggctgattcagtggttttgagccattccattccactaattggcaaggaaaaatgaggctgacaagccagggtgattgggttcagagagggcccattcctctgtctgttttttctcctcacactgcccctgcctttgttggtttctctttggcttcctccatctggagtgacaagacaactgctctgaacatctctttttatatccgctcagaggcatctcacccatcttccatctagttgacttgtaaactactgatgggtgaagagagaaactcagtggtccagcacttacctagcacaaggccctgggtttgactccagccggggaaatgatattaattaattaaaagagtgctaatgaccattccatccccagtgtcagcttctcacctctctactggatgccaaatgagcctaaatggctgagatcttcatgatgaagagccctgctttcctgatgcagtgaagggcaagcttcttggggcatgtgttgtcaaagccttgtctgcagaacagcatggactctgctgcttgctaagtagatgacatgcttttcagaactccataggaagctcctgaggagaaacataagcctctctagctggctttgcctgacactcactcgttctttatctcgctatatccatagaaaggctatgtccaggaacccagagaatctgtcccttttcagggaccttgattgtggggtctttgactgacctttgactcagcattactagaggttagagtaggatcacgtccttgtctgttttggatgagggaacaagctcaacagagaaggcatagttctgtcctggctagtgaattgaaagcccattagtatacacacacacacagatatatatatttatgtgcatttataataatagacatttgcgtgctagtatcatgggttacagagtcaagaccatgcatgcccttttcagtgcttcttgtaacagacttcaaatccttgcctctaagagcccaggtgttctggagtacctggggcagacatccccgtgtggaaaatccagggcttcccagcccctgaactcctttgccatccatggccttttaaccccaaaggcatgtctgtccttactcgcctgagcaaatactatgtctgccttataattgtaagcattcagaaaatgagtacgtgagtgagcacagagcaaagagcttgcttatctaggaataatttctcaaaagtcccttttaagggacacgtgaaggagtggtccacaggcagcagaacactagctttggattttctaagcagccttgtgacaaccccaagctaacctctagaagtgggtttctcaaactggaacatctaccaggattaacaggcttcctaattcccattagcctgccaagcctcgctctacaccaaggtgaggaacaaccactgtattgagacacatgctccctcagccaactggtaagccatgtctgcccacgcaggtctcactattatcagcgggaactaacaatggtgtctgttctcctttcacccaacaacactgagctgctcccccaccccaccccaccccctacctggaggctgagcgaagctgcagcagaaatcccaggagaggccctgcccttcctagactcctgctgcatgttagcatgatccagtcagaatagaagactgcaaaacagtttcctttagaaaccctgcctttgttattatatctgcacttaaaaaaaaaagtcacagaaccaagagtgggttcatgaagagctgttggtgttttctctgttatagttgtactgtatggttggggcgcgtgatggggtgggcatttgtagctgttacccatcttcgccatgctcagtcaccccgtggctgtgtctccagatcccctttcttccacttagaaagaaacccaggcgattttcttagtgattaaccctgtagaaatctcaccccagtcccagttaccatcctcaacatcccggggcggggggaggaaaacagaggcccaaatattcccacttagtgtggctttagggacctgtgagagcagctgacataaacctcagcacaagatgggtcctctgaggtggagctgaggacagaatgaatgtccaaaagtcataagagatcagaatagagagggacctatagtgtgaggatccctccttgcagagaggaacaggaagtctgcggtgccataaggagaacggagaatgagtgaagagcagaggaaagcagagggtcagagacttggagccaagcaacactggcatggaggaagagctggttatttaaacctgtagggtagagtacgtttaaaactactagaaagttgccaaaatgcaaatccctgggcccaagccaggcatcctgcttcagcgggcccaggtgggacctgaatgaatcttcagttttgtctttttcacagtttcacagctcggtctaattttggtagactctggattgtcatttgaaaagcaccgagacaggaggctaaagtaatttgtagagtatgtgtgctctgtaagtcacgagagcaaatcccagaagaacggctactatcatgtttactgcttgagaggtagatctgggggacccaaaattagcggtggtccaaacgctcaaggtaaacaggccagtttgataggtggcagatggaacacattaatatatatatatatatatatatatatggaattcctgggctagtggcctgactctaccgtattcaatagcaatgggcagttcttcagagtggggttactatacaaaatgtgtcctttcttccacaaaagtggtggaaagcagagttattgcaaggaagcaattgctcagctgttatcatattccaacatgtatgatccctggtcctttcataatctcaagatgtcactattcagttgtcaaagagctcatccagaaggtaaacctaacatacgtagcaattaagaaaacaacactgaagtatgctgcaaccttgaccatcaagagctgacctcagcccagagcacaaaagtaacttgtgagaccaggagggacctcatagaccacacagaagctagggactaagtgatttccaatgtcttcatcctccatcgtacttgacccctatctagcaggcctgctctgccctgtgtaatccacaccatctgaaaagggcctcagcatcggttctcctcacagcatcaattctcaagttgcacctttgagacccacattcaaactccttccctggctctactcttcatagcctctgcatctatcttccctgctaccatcttgctatatcctttgacccgatacctggtagagccctagcttcaactacagctccctatatctctccactttcagaacaactatgattttcaaactccttctacctcaattgctatcccagcatttgataagcaaatttgtgctctcttcagcctgttctaacctttgcattctggtatcttagtgcagagggcctccagtggccgcatgccgttccttgggattttgccagcaccagagaaaaaaattcatactccccttatcttacgttatttttctgttgctgtgaaaaaacactctgacaaaagcaactcaaggggaaagtttattttggcttccaggtcacgagagaaacagcccttcatggtagggaagccatgcacacaggagcagaaagccagcgcgtcatattccaccaatactctggaaacagagtgaataggaaatgaggcagggccataatctccagaatcagcctcataatcctccaccttctaaagacctcccggcatttccaaacactgtgactagctggagaccaagggttcaaacaccttggcctaagaggaagatttttacatccaaagcacaacccttacggtatacatgtggagaaaaagagaagagatgctgggtaaaggggaaattcagaggggaggattcccattctgagatccctggtaagcgtttcctaacttctgttgctctgttgagaagtcagaggccattctttctttaggctcatatgaagaccatctttgccttgaaggactttccaagcacagccttccacattccagtgaaatcatataggaaaatggaagctcaagtgtaatttacaaagtcaagagtggaagagacccacatcactaaagcaggaagctcagatccaatccgtgacctggagactagaattcatccatacatgcatggaggcaaaacactcaaacgcataaaatcaaataaactagtatttaaaatatattaagaattgtgtctattccttactctctcaaactgtataaaagccactctcccatctcccagagactcccactgataaaaattttcccattgaattgcagaaagcgttattctgggactcacactgcttgcttcacatttcatgggtcaaacacaagcaggtccctttccctcatctcctcactgactaatcagcaaatcaacaaagatctccaagctcgtgggtttgtggggctgctcatttggaaagagtgtggcagatctcaggagacatttttgctcagggtttgcccagagttttggctagtcccactgcattccagattcctagggcttagctgaaagcttatgtgaacagaaatccttctaagcagggaagaaccaagatcgtcaatctaaaatattattgccttccttggtaagtgataggtaatcctttgtaaacagattgaaaaatattctgtgggaaaataaggagatgtagaggaaagtcatttctcggagttcctaactgttgtgatctataattaatctgtggggatgaaacataacctttctcccagagaaaaatgtctgccatcttcacaaaccagctgtgatatggtctctgagaaagaattgccttatcatagacaaaaggccataaggacagacataaaagacaagggaaaaatatatctttgagctgaatggccaccaaatattccaaagaataaacttgtactttcccaacagaaaggcaacttcaagtcctttggtagctcatagggaatggcccttcaggaacatatgaccttcacagcatcaatacggggcctgaaagatgtgtgtctttgcctgttttgtcttaaaatcagacccaggacacggggtacagctttgcctctcgcttttgagctgtcctcactctgccctcccaggtctgcagccagcggagccagacagaaatgctctccaggcctaagaatgcccaggaatcaacaaacctaggtggttcctaagcttatttcctgtattcagactctgaagtggaatcccaggttggcctggctacaaaggctggaaggtaagaaaggtgaaaaaaattctggaaaatgtttccaagttttctatttactgggtagacaacaagccagtggctgtttgctggcctgctgaaggctattttccataaatttccaaagagcagtgtctggcccaagggagatttgaggaggagtggagtaagaagggagaaaagtaagaggtgatttattggtgccgttggcaatttaaaagctggcgtgcatggcaaagcccaaaccatcttgctactgtaggagggaaatgagccaagaagaaggtcagggctatgaaggatggagatgtcatttgagaagcaaactgaagacaaaggtataggttctgaggaagtggcccagcaacttgccaggaaagagagaggtatgtggaagagggaaagaaacggaagttcttgtatcatgaaaagaaagtatatcacagggatgaggaaggctctcttctaatttgttattgaggatgaagaaccaatagttacagtgcatacaatggcatgtgtgatacatgaaagatcaacctgttgaatggcaaagggactcaaatacagagacaggacaatgccgaaggaaatttcctggcctaggtgtgaaaaaggacgcaaaacttttacttcccagtcagagcctcattttttataagttaagtcctctgagagaagatgtatggaccactgatgctctgtaggctccagatgtgaggatattctgtcatccccagagaagcttaagatggagataagatgtggctctgaatcatacagatagtttgtcaggatacccatggtcctttgagaatcaatgaggagggaaccaggacttagcagatatcactgtccaccaatgacagatatgttcctgtgtctctcaacaatgtagcaaaggattctcgagtttggagaggaaaaaacagagttcactttggtgtgtgtgtgcagaaaccagcagcaccaggcctgcagatggagtcagtacggagtgtttggcacagcacggggaaagccatgttgttctttgcagtttactttctttcctgccctctttgatgctcagagaaagatactgaaggaagagtttggacatgttctctagagacagaaaaataagtaaaggggtgggataagtgatggctttgtttactaattttcccaatagaagcttgtaagcaataaacaaggtaatagacaggagaacccaaaggctgaatacagacagaattcaaacaaggttttcacattatagttgtgtgcctgtgattctgggggtcaaactcaaggcctagcacttgctaggcagcaccctaccacttagcatccacagctcaagtttccatttctgttttttacatttcagacactaaatttatggcctctggcttagagtggtgcatctctcacaaagtctgagcactagatgaactggcccggaggcatttgctggtattcgacaaacgccagttagaacaacagagggaactatgaaggacaaatggtttgccaagaaagacaaagggcagaaagatgagctgggaagcacatgcagaagcaaccgaaagccaggccaaagcaaggctaacaacctcagatcactgtgttcctgtgtcatagcatgggcaacaggaaacagagctacagcctgagtggaaactctgatctcaatgtctcaccagaactggttgaaatggatcttggtattgagaatatggcaaacacaccccgagaagggaagacaaaatagttttaggcccagataatgttctgtgctgctgccggcggcattgttcagccatgcggacagacagggcatggggaggatcttatggaaggtaatgattgtcagggctcccagcagaaccacgggagccaggatttaagggatatttgctgcacatgcataaggacatcagttcagatccccgtacccacatgaaaacaaaaagaagccacttaacctgccacagcagcactgttagctggggcaaagatggggggactgcaagagtttaccagcagcctgcttggctataggttccaaatctagcaggctgcccaacatctttctttagtctctgcacacatttacaagtacatacactacacacacatatacactgcccacatatgcatatatacatacatacacatacaaaacaaacagacaaacaaggaagccacgcccagttgtaggagtacagtttgctatgctggtttctttatagctaatgcaacaaatttcaacataatagctatttttgttctaagaagaaaataagtgtgttttttaaaaactgttataattctgagatttgggcttttgctctttgtttgtttttacatctgagatgggcttcaagggactaaaatcaaggtgttgctaagcctgctttcctttctggagactctaggaaggaacctggatttttctgaatcgtttttattatgctgttttgtttggagatttttgccttttccaaactttgaaagtttcacagatcccttggcttgtggtcccgtcctacctttgaattgaaactttctcacatcacatacagacacccttctgtttccctcttcctttgtgcgggacctggccattttattgggttcacctggaaaatatacaataatctccccattttagtcacagatacaactttaattctcctttgtcataaaacctaccgtattcccaaattccagatattaagtataaacatctctgggggctatagttttgcctaccacaaatgccagcaaatcacagtagggtctctccccaagagttatctttggctgaaggcagctgcctcggtgaggcttatgccccagaggaaagcaacagccagtgactggtttattgaaagccaaaggttctttcccttagatatgaagaatcctcaaattcctcatagactaatgaaagccactctaaaaatccagcccccttctccatctcattgtgtccttaaacactccaagattctattctttgaaggtctctaaaaacattattatggtaatgtatgtttggaatgtttcctgggaaactcaggctaaactggtggcaatcagaagtctcagaaagctgattctaaagtaatattcaggagcatcatcatctgtaggtccatggacaacagagactccatcactcaagagactcatgtgtaatatgcacagccctcatgaattacactggtgcacatggtacaacagtcaccaagaaagaggcagagtgagatctaaggagacagaaatgaccaggggctgctgtctccagcacttgagccactccatggaagctgcaaccgctgagctctcgctgttagggaattagaaaaggcaaacccaaggcagtcaactgggagctgaagtccaaatgtggaagacttacaaaaggagactggccttgtgcttccagatgtggaatcagcagagagcaggacctgcggtgtaatggcaagcacagagggcaagagaaatggttgaatttccagttccagatggggctgcagttgggggaagatgggatcctgagagttttttcgatggaaatagtaggagctgatacactgaaaatgaagggacctgcacacagtagggtgctccctcccagactcctgattaggcataggccacacccaaacacctatttcacagagagatcctttataaagcttcatgaggaggaaagcaaaatgactgatttctgctttgagcaggaaaactgcagcaaatgaccctgcagctgtggttttaaagaagagaaaaagaaaggtctgcgttagaatgggctaagatgcaggatgctatggtaatgttttgtttgggtgtcgcagttagggttttactactgtgaacagacaccatgaccaaggcaactcttataagaacaacatttaattggggctggcttacaagttcagtccattatcatcaaggtgggagcatggcagcatccaagcaggcatggcgcagaaggaactaagagttctacatcttcatctgaaggctcccaagagagaactggttcctagcagctaggatgagggtcttaaagcccacacccacagtgacacaactagtccaacaagaccataccttctaatggtgccaccctctgggccaagcatatacaaccaacacattggatatgttaattaggttagccaaaaggaagcttttgattgctatctgtcaatactttgatagctggaccttggtggtcagcctcaggaggaggaaatgaccaaataaaggaatggagcttgggggctagctttaggagtgtactccattaatcctagctctctggcagaagcagttggagtttgagtccagcctggtctactgaacaaattctagtatagccaggggccacacagagaggccctgtctcaaacaaacaacagcaacagcaaaaacaaacaaaccaataaataaattctaggaatgtaatctaatgattttcagcaaggaaatgggactaggaggaggccaggcctaccagagccatgtttgcaaagcccaggcttctgtttgccatgctgggacctactagagccccttcagaagagtctgaaatcccaaaaccatctggtcttcactctccctgttcaatggtaatgccttccatttcttcaaagacaacacaggagtcactggtgggaaaaaaacaaaacaaaacaaaaacccaaaacaagcaaacaaaccaaaagacaacctcattcaggacctagagcaaaatcgctttacgtacacactaagtaggctgtgagaagaaaccagaccctaaaaggacttcaggtgccaagcagcatgggccagcaaatatcagtaggctacaaagcagaactggaggctcagtgggccagatgaagaaaagtgtgttaaaaatatgaatgaagaagaggggaactgccacggggccctgtcctacagcacaggtaccatcacctgtaagcaacaggcagctactgccagtattctgcaaggatgcagggaaactaggggacagcagcgacatccaataagacaaaatccgggagtaccgtgacggtttctgaaaggaaaatggaaagagctgatgggtcaagggttatgaaatccaggtatatagtggaatttcaaaaagtaaccagccaaatatgttctatgggaagtcaagaagacactgtatccactacagctatgagagtagttaagaagagaacagaatgctccctagggatggtccgcccctggggatggtccacagcagggtgggttggacatgaaaataaaggagttattaaccacccaggctagcaaagtcatggatctttcacatgcagcataactcctaactacattccaaatatttgtctgtctttgtatccatatacaagtgtagtcctcacccctgatcaaggaaactttgcttttcaagaaatgaagactattacagaaaaccacagccaatcaaaatgcagagttgtagagagcccagttccaacagctacatccacggtacactgcaacaaaggctctacaaccactgtgggatggtaggggagaacaacttttgtaggagccagaggaacagcgaatagcgaatttactgcaagacggcatcttctaggaatgtcaaaaactacacccatagactcttataagatgactgcttaaacatgggctaaacaaggacaacacagcagacatgccaatgtgggcggagggaaaagtccaggaagcctcaaccctgcacaagtgactacaagcaactaaggaatgctttgagtgggagaaagccttccccagggactagtacactaacgtgttaccagtacctaatggtcagccctgaaagcataaggattaacaatcttacatggactgaccaggttttgtgtgtgtgtgtgtgtgtgtgtgtgtgtgtgtgtgtgtgtgtgcacaagagagagcttgtgtgcaagcaaacatgtaatagcaatcaatgtaaaaaggtcatgaattttagagagagctaggaggtgtatgtaggagggtttgagggcaggaaagagaagggggacaagatgtaattacattatcgttaggtcctgaggaaacccgggacaaatggctaactgagctgcctattaatatatctaaggggatgctggtcaccaggttttcttagcatctgccagcattgtgagcatctgttacagagtcctggctcctctctccacttctaccccaaccctactccctaccctaaacctctccagcctcagaactcagctgtgcttcctccagcttctctttcccatataacacagccattttggccttgccctcttttggctttttgtccagtctcctcttgatttccctccctgtctcctggttccctttcttgcccttctctcttctcttcctctctcactccccatcccccttctcctgacccagtctattattcttctggactctacgcgctcttcctcatctctacaatcaaaaccttctcaagcatccctaggagcagccgtgtcctcattctcattcacttagaatcaaaaataaaagaagtaatttaaaatttaataaaaaaaggagaaagttgtgatcccttgcccagtttctagaactatgaagttttatatattcctccttttgactgaggaagcagcctggtgctctgcatagccaagtatgtacagtaaccattgcctcagtcccctcaagggtcctggggccatttacccaagtagccataccttgaagaaaagagattctgtgtgatcagggagttaagacccacgatgacctgaatagctggtggaaacaagaagccaccataaggccttcctgagagtgaggacataaaggggacagataataagcttgagaaggaacagtggtcatatgcaagttttcataggttttagcaatgacaggtatgactagtgttttttaaaaagtatataaagctagcaaatctgtagttaaataaagcagtaaacacaggggatgcccaaagaaagaaaagtctaactgaggaggagatgttacaacagatgatttggaaatgccaggggccacagggtctaccagaagcaaacattcatcaaccaaccagatgaactaaaagagatcaactctcaaaaccacacaaccacccacagctcagctctaaagaaagacaccatctgactaggctgataataaacaagaatattaagagggtaatcaaaagccttccccaaagaaaactccagacgaagatgacttcactaagaggctctaacatggaaagaattatgcgaaatccccagtcattaacaaactcatctaaacatcaaagagggggaaacatttctaggctcattatctgaggccactgttaccctgacaaaaaagccagttaaagacacttagaaaagaaaactacagaccaataaccctagatgctatagatgtaaaaataataataatattagcaaatcaaattcaatagcgctaaacaatgatatggcatgatcaagttccattgccatgcaggggacaaggatggccaactggcagatccaaatcaagcaaggacacatctttgtaacagaatcaggatcacctctctagaggcaaaagatgcaatgccaaaatccaaccatattttatgataattctcaaaaaaagggtgtgtagaaagaatatgcctgaacataatataggtcagatacaaggatcccacaattaacattatactcaactgtagataatgacctcatcatactcagctctagataatggcctcatcatatttaaccatatttagtggataatgacaatgacctctctcgtcatactcaacagtcagaaataagaaaagaatgcctttgtcacaaaacatcacagttctgcttcttctacccaacccttagcttcgtcatctctcaggtgcaataagttttgaacaccattttctacctcagactttgttttctgaagaataaaattcaatatatatggattcatttaaaagcacccatacattttgatctagtaacaaccctctaagaccgtatgaggaaggaaagggaggtagagacagtttagagtcactgtttgtcctttcacagttacaactataaataacctaaatgttcaataagagggggataaatatggaactctttgcagccattacaattcaaatttcttctaatgtaagaaaatcttcacaacacactttcaaatgaaaacacaggatcctattataaactatataattggtggcacagacctttaatcccagcacttgagaggcaaggtcaagtggatctctgagttcaagggcagcttggtctatagagtgagctccaggacagccagggctacatagataaactctgtcttgaaaaacaacaaaaagtttaaagaacatgctactttaaaaagtgtcacataaaagagaaactgaatgactccagtggagatgtctgaggagaactggaggagacagatttttgctcaattgactaaagctctaccacacagcctagctttaggcaaaacaatggtaatgagctcccggtcccatgtatgtctgagtttgtaccgttaggagagctgagttgtgatttaaccatcttgagacatggcgctggtgaggctttctcaagcagaagcaggctagagacacgtgggaaaggaactctcagctgagacgttgactccatcagattggcacttgggcatgtggttctggggtgtctggttgagcaaggtgaaccagtcatggaaagtaagccagtttccttcctccaaggtctcttgcttccgtttccactatctccagcatcctgccttgaactcctaccctggttttcctcaataatggactgtaacctgtaagctaaaataaaccctttcctctctaagtggcttgagtatttatcacagcaacagaaagcagactaggacaggtagcatcttgccctctgtaattccacccctccgtggacaagcatctttgcaatgtgtggtttgctttactttgccgatttcctttagcaactttactcttggagatttctgatttctttgacaactcagtgagaaggaatgtgcttggtcatccccaccttgaaacccttcaaccttcagacctgtacgacaagaattagaaagaaaaaatgcaaatgaaacagagccactaaagacttctagtgggtgacaaggtgggaaagacccacctggatattgtgagaacgagcatactcttgaaaacaaggtcttacactcttataaacgaattgtgaagctgaactgtgttctgtttttaagacgtcccatgtgcacaatatctcactttctactgagcccagccagaacaaagaagctgacctctttcctcagccaaaccctagacattttctagatgtgaataaaaatcaaatgctcccgttcccagcccctcactcacacccagatgctccaaatacctgggaggaataatggggaagtggaacttatggaaagcctgctccctccagtctagtcctccctcggtagtgcttggtaaaccatagactgggagagggagactgggaggagggagaggggaggttaggcttctggaagaagaagtctgttttgacttctttgtaccctcaactctattgaagacagtcagtctccaactgtccctgtcatgtcccttctagtcatgggtggcctatctggaccatggatgaggagcgcttccaaacaagcaggacccacaattctcagtaactgctaagatgtgctgacagcctttgcagctcactttccctctgcagtatggtaaagatgtaagaatgggctgagggaagctgtcagaaaacaagaagagacaaaggggtcctaaaatgctaaaggacgtactaaagtggaaagttaaagaatactgagtctccctacactgtcctttgagttacagagtccttctagcctgaaaagtacatgtggaaccaatgaccagtagttatctcacaaatttcttttagacttatttactgatttagtgtgtgtgtgtgtgtgtgtgtgtgtgtgtgtgtgtgtgtgtgtgtgtgtgtgagttttgtctgcatgtatgtaaggtactgtgtacacgccatggtcccacaaaggccagaagggacatcagatgccctggaatgggagtcattgagagttatgagccaccatgtaggtgctaaggaccaaacccaggtcctctgtaggaggagtaagtgtgcatgagtacgagtgaacacacacacacaatggcccatgcagcagacacctctgcattccctaaggccaaaacctgactgacaagacagagcatgtgaccagggcagctacttggctggtgccagctatgagggacaaagagttgcccaccaaggtggggtgggggtggtatataggcacccctcattatttcattaaatgagtctgcttctgcttcttatctggctctcaggatctgtgttgttgattcccctaccttcttacccacaaggatcatctggggtgggtagactgagagggctagcgcaacactctacaagaccaccaagggcttcctatccacaggggtggataggtagacactacccccatggttatctaactccagtgcctccttgatcatcagagcatcagagggccccacagagcctgttgggcccagctgtatcagcagatgaagtaggcttattcttccattacatattcacagggacacttttaacaaaaggaaataccaaacccgaaacaccctgcaaaattaccagggacaactcaaggaaatcctcagaggtatgccttcttgctttccctcttcattcatacaagaggacaacagagaattagaaagcacaggcattgataattctgcagtcactactatttcagcctgaacaataagcatatcccaggatgctctgggtgaaaccacaaggtaagcaaagtcggcctgtagccattgcaactaacttcagcacccatatctcagacaccacgtgcacttaatctctctcaatctgctcccaaatcctccagtaaacataagcttattcccagacatgctattagactcgtgtctgatcaaaagtacaattgagtcttagccttagcatgaatgcttcaccatcccctggcagatcttccacaaatacagcctgaggtggtaatgaaagaagcagaggtttggggccagggaggcatggttttccaccccagatccaccactcactattttgtggctgcgggcaagttacttaacttcatttaagtctcaatgttcttggcctaaaaatgtggaaaatttatgcctgcccaattatatctggagaaaggctaactacaaacaaactcttcatttctcgccctatctttcctcatcttgtaagaggaacctagaaaactcaggaaaaataaaacaaaacaactactgtcagaaatcacaccaggaaaagaaaggaagctcctggtttgctgttgttgactaccttggctggcaggtgagagatggcctctgtccaacgtggagaaacccaagcgaataactgaataggaccctgggcaacattcatggcagaggccatcgttatgcttattgcccccaaatagtgacttctgtcattgcttatgaccacacacatgacaaacaaaaatcaacctgtagaaagaagcatttcttttggctcacagtctggcagggtagagtccatcaaggcagagaaatcaagacagaaaggtgaagaggtgactggtcatttgactctgcattaaggatgcagggagatgaaagttgacattataactctttttattcagtctgggtcccccaacccttgggaaagtgctacccacattgagacagaggcttcccacttcagttaaacctaacacaccagaggttggtctcctacattattctaaatcccatcaagttcaaaagcaatattcaacatcacagcccctgagaaagagtattaaaagcaatgtatagccttagttacttaaaaaataatctgccctgaagataataaagagaatacagaactaggatttatttgccaatggtgatattatgagcaatacctaagggctagcctctaccaccatgtcacctatgaagtaaaggcttcattcccacatccaacctggactcccactaccctctcaactgcccacactagactcttaattcaccatgtcttccctgaacagcaatccagactgtgtcctgcttctgtccctgcatcttgctctcaactctgtccaaagtcctcctttcatggctgcccctgagccttcccagatatccgagctctagtttaaatggattctctgttagcattggaagttaataaagccaaaagacaggatcaatgtcaatgaaaccagggcactgggtcctgtactgtgatcagccagtatgggataaactggccagagacctgggattctccccttgggatgcgctgctgtgtgatactatttctggggaggcataatcaaacatcttttcaaaccagatagggaaccaagtacatactgaaggaatggtcttgccaaagttcaacttggtaagccagagtttattgtgctacttacaggagcatgcacaactcaaagcagcagcattagttggacaccgaccccaggatgagtgactgctcataaaatctagaaccctgaatctctctgcataacctgcaggcagcttgacaagttgagaagtcttacctcctgagcagcccttactgcttatatatccttgaagaggcgcggaacttgtgagtcttgttagtttcagaacctttctgagacctctgagttgtttacttcctaagttttaaggatctcccccccccgccccccatgatgaaatgttttaactgggaggggttactatacagtagtgtccttagacttcccagaagttttacaaagatacagagcccaaacccagacttctctaatctagaataacctgcagtggggaggataggtatgtgggcatctacatttttttaaaaactccacactgaattttaacatctagttggagctaaaaaaacaaaacaaaacaaaaaacaacaacaacaacaacaacaacaacaacaaaaccaaacaaatctaccagcctccagtaagaactggatgctatggcattacttcaaaactccagtatacaacagcaacaacaacaaaagagcagtgagtgagcatgccgaacatttccagctccaaggggctgaaacataagtagttgaaagtattcaaagatccaagaaaacagtaaagtgtgttggcaaacaaggcacagaggggagtggatattgaaaatgtccagctatatgtcctaaacctaagtagagcctctgtgtctgtaatgaacaaaacaaggagaaaacgtgcattacacggatgctgagactgtggaggctgcagaacagtaaacatgagaaccgtcatcaaggaaaggatgcagaacaatggcatgtgttgtttcagaaagggtgattgcaggagaagagaacagaaacacaacagatgttttactttctggactaggtgcagagctctgtgcagcagcttataaaattttaattgccgatatggctcacaattggcaggagagcaagtcacatgggtgcagctcaaaggactatgaggaagagatgaggctctgtgaccaggccccacctcaggaggtgcttggcagtttgtcctgggagtgggggtttgcttgctctagatttaattgtatattataattaaaaaaagacccgtgggagctgaggagaggggaggaactctgaaggcaacagtgagatgaatgaaccataagatttaacctctaggcaaaaacagaaaggggaacttattgatgaaatgcaaaggacctcattggaagaaagctcaagagagctgattatagctgaactacacacagaggtaaaactgggcaccacctgggggggcggagtatcaggttcatgggccttctcagtggtcccccagcctctagatcagtgtcagtcagagcagaggcaacgctcctactagtgtgtgggttaacagctgccagagataatttccttccagaaaaagaaaggctgtaagaaacgtgccttatccaaataagccaactaaatatctttatcccagctcctgccatactttgttcaacgtgtgccaacaaacagagtaagtcagtaaagtgcccagacggtctccacagcccgaccaggaaagcaaaaggaagttgggttggtggatgtttattttattttattttactatattaactttattttctggagaatgagtttcatgtgacccagactgcctttgtgctccattgtagctgaggctagccttgaactcctgctgcctttatcccccaagtgctggaactccaggtctgcaccaccatgctcagcttagaaactagaacattgacccatcaaacccttctgaaatttgtgcagaatattttaattttaaatatagtctccttaaataagctgtaacatgatcttttataataatttgctgttgtaaagcaggccaactgctgccatatttgtgagacaagctatgcctacttgtaagagtccatcacagtcagctcataggccaccaaccttcccttatagaaaaagagaatattgagtgtccttgagcaaccacctgagtatctagtcactcctcctagccattgtatgcaaatgcaccctatcttacatggcttttgaatgccctggctacattatttaggctgggaaaggttaactgaagaggtcactatgtgactatggagggagccatcatccatcttgagtggagactttccagagaagctgctcctgccaggatgccctcagccacactctgtacataggtccaataaatgtattggttccctggaaataaatcctcacaaaatttatgcctgtacttctgtcccgcaatgccagatagaccatcatcatgccagttcttaccctgttacatctaaataaacagatagtttttgtaatgaatttatattcagcactacttatgccttttaatcacaaaagctattttcatgaatgcttctcggtggtcatcatttccacagccactgacaagcaggctgtatgtacaggtgatgttatcatacacattaggacaggctatagaatgttgcttttagtaaacaaccctgagacctcaaaagtttagatcaatgaaagtttatttttctttgactaaaagtttcatcatgggtcctgggaggctctgacattcttttgtctatgagtgacacctatcatttcatttccaatcacgttttactgaccaaatcgagtcacatagctatacttagctctaaaggggcttataaattctgtcctaacatctttctagaaggagaattactgtcagatagcacaagcacatcccacatcaatctaaagaatacacatccatacgtatacccataaatataagcatgtagattccttcgttgttagtggcaggttttgaatatacctcagatttctggaaggttcagaagttgacctaattgcccatgttgactatgtagagttattaaatagactcaaatcaataatgctcaccttccagaaatgtcaaagttgatttaaggattaggtttttattaattgcttcttctcttcccctaaattaaattttacaatatttgtttatgattgctttagattatatacaattcacaattgtatatagcatggctaattgtttaattataaatttaaatattttttaagaagttcgagcaaatcttacacatttcagaacgtttggataatctatactttaagagacatctcacctatgacaccaagtaggagaaatagctaccattcaaggaatactaggcattcctgagtaattcaggaggccaatcaactccagttgtcaaggtcattattaatactttcctcatttagagttaattgcatttcccatatgttagatgtcacttagactgggttgaaggactccacagctaggaacgcattaatcctggggatgtctgggtaggtattttatttgaatcagtagccggagcaaagatcatccctcacccaagtgagcaaccattatccaagcccttgagggtctgagtaagatgaaggaacagatgaaatgcaaattcacacgctccccgacaaggctccctacccctggctcagctgagacatccatctccctctgcttccacatatcagaagtctaggctcttgggccttcagacccatggcttcaggtcagcagcccccatgttctcctacaatcagctttggactaagagctttgccaccagcaatcttgcgtcccagtccttgctcagactggattacatcatcggcttctttagttcttcaggtcgtgaaagatatatggaacttcttggtctccacaatggtatgaaaccaatttccataataaatccccacttagacgtctatatatccaattacttctgtctctctgggaaaccctaatatattatataagcaactatttacacatgaaaagaacagtcattcaatctcaccatgctgaacagatcaggccttccattccgatggcctcctgtggtcgacatgccagagagctgaaatcataaagggtgacttctagatgggagtggccttcaggagctggggcagttgtctactgtgaaatgaacaccctcagttggcccctgtctccatttcctgcctttctgcaatgagaaattcggaagttctctttagcttttggatcactcatatttcacaaaacaattctgctgacagcattagagtaatatactgcagttgtgcctcctatgacctgtgaatgaacgagcactagagggtcctggccacaggctcaggatgtgtgattttcctaaattaggttgccgtctcttctcctttactttaagaggtattgctgagtggtggtgtttggaggtgtgtttctgttttccttctagttttgtgtttgtttaaacctaaactgttcatagaaaatgcaaattgttcttggacacccctctccatacgacatgttagtgaacatgcattctccacgcagctggttttaagcttcctgtttcctgtgaaccctctctttggaaatcaaaattgttttgagatcagtcttgtttgttgggaataggttgccatagttaagaactctgaaacagaaaagaatttaatgggctccagagatagctcagaggttaggagcactgactgctctgccagaggtcctgagttcaattccctgcaaccacatggtggctcacaaccatctgtaacagaatctgatgccctcttctgatgatagcagaagatgactactacatgcttaacaggttgaagactctactaaaaaactatctaggtaagaagcatgggccatttgagaacaagatgtttacacacacacacacacacacacacacacacacacacacacacacatcatgacttaagcttttgaaatctttgactaatagaagctccagaaacacagcatctgagtgaccagcaaatctgccaacaaagaaggcacaaggcaacaacgcacagcaaatcccatcagctaagaaacctcagtccacagcccccatccaggggaaagttcattgctgccttgagttaattgcttccctggccctacagtattttaacaagaggataaagaaggacttagaaggacaatctttccaaaatgcaccttttatgcatgtgtgtgttttgtggaacgctcaaaaacacagatgttgctttctggggttctgatgaatggtcggatacactttgccaaatactaaggtggcttagaagaataaaatggtggccatgagtgtaaacacattaattggtctttcttctgtctccaaaggcccaacctttttgaatgaaatccttgaaggtggagcgtaggcatcatctgtacaataaaaaacttttctaactctctccaccctcaaccttgcacccacagccagacagtgagccctctgctctgtgttctcacacactcatgcccacccctgtgacatacacctcattatcagcatccctcacagccttggcagacacttggcacacaagaggaacttaataaatgatcccagaatagctatactgcataaaaatttcaataacacagatgtaaaagaacacaaaagaacaaatctgcacatttaaataatgaggacatatatatatgtatatatatatatgtatttgcatatatatacatatatattcaagaaaacagctagcatacagaaaaggggaactaatgatctatcccacaggttgtatgcaatcctccacatcttccaaagtgcttaaagtaattagaataaaggtaactttcaactggaactgctaaaggtccatttgctctcattggtagccaggaggaggttgacacacatcctcatgggagactgtatagccagggctccttaggtcttagactaattaccatgttagttgttggggctgagccttcatattctgtgagagtagacagaacaagtgaggttacagccaataaaacttagacaaattactttatgacattaattgacacacttaattattattctgttacatagcacttatagtaattaggtattgatggcaaacagctcatgctataattagcccaggtaaattacattttttcctcccctttatctcattttattttctaatgtatgtagaaatgtctgagtttgcagtgcttctaacaccctggtgtatttttatttttgttcttttcggttgggtctagtttgaagggattgcgctcgcttgtgtttatttttggttttttgaggcagggtctctctttgaggtctaggcttcccttccatctcaacctcccaagtcctggattacagatgtgtaccacctggtgtctgtagtggtgagttttggttacaccgcttttgctcccagcagatcacatgtaggaacctgcccagaagctatctggattctcgaatacacacacacacacacacacatgcacgcatgcacacatgccggttaattttaaaatgtcttggctacctcaaaggctgggaactcctaaaccatcccctgctaccctaggcccaatcagggaaatggccagtggccacttatccaaatttttatatgactcattggctttatctcctgcagctcctacgtccatccatatcccaccgtttcaaggcgatttctcctcccccaccccaccctgagtcctagctcaggcaactctaagggtcccaccctgtctccctttgcccaaccattggccattagcatctttattgattgatcaaaaaccaattggggacaaggacctttagcatttggacacacagattcccaattgaatcaaagcattagaactaatctccaacaggcatcatatatattcttgtacctatcatacatgcaggaaagcacaagatgggaggcttgggcattttagactgaatgtcacttggcacttctgcctttgtcatggttctaggaggcttctgaagctctctccttcttcgatctctctccttcctccttctccaaaagaggagtcaaggaagaagggtttgttttacacaagaaatatcaaatgatgaatcaagcattaagtcaaatgaatgctccttttggacagggaatgtcttaacacactcaaaacaaagcaataaacattagacttcggtgctgctagtacaaggagagttgtccagggtcctccgcactttctctcctatcccaagcccagggtaacctctgagctacagccttgtgtcctatctgaactttaactctcatgcatctagtttgcagcagcctccagtgcagctgccctatcctaaggtgttagttctagactgaagccccttatgaagtctgcaaaagtaagggacctcctttgtcgtgtgggtggttattggatctcttctctcagtactccctacagtgagtggcaagtgttattaaaagctatttctcctaaaagttcatcccagtgattctatctgtggaaccccaaaagaatctccatcatctaaaatgataaacgtcacaaaatctgggcataaacaaaatgttggtgctccacacttctgcaacacatctcctcagactggcatctttcagctgcatttcaacttggtctctcctctgtcacccacatgcaggctgacgtgacctttcatgttctgcctcaaactgtccatcttcaggttagaccttcagtgggaagcaggaatacccgcgtaagtaaaactagtctttctttcatttcacggataagtgagcacaacccacatggcgatgtctttctgctgtgtgcctttaacgaggtgcatatgtgtgcttgtcatctcagctctaacactcatatgaggaagagaatgggaagtcacttaatatagacaagcagtggactttgcagaacttcacagaggtccctctggcaccttggaaggaatctgggcattcgaggagccttgaaactcaagtctcatcagcgtgatggttaatatgcttttacacttccactcattcttcaacccaatccacaaccctcgctcttggattcagcaagccagcgccctgagcactatacctcagagaactgaacaccgtcaaaggaacctggaagcatagacttgtctatacagtctctgctttagtcttggtatgaaggtggttagaattctgagaagttgactttgggattctagcaaggcgaatccagatctctcagttctttattcttatatgttaacctcaaggaaggcaggtggatgggggactagaagggagaaaggtagaaagaaaaaggagtcgagatgttgatgaaaagaggaaacagaagatgagggagaaggagaaagaaaatgaaagggaaaaagaacatacagaggaaaggccggatcatgcagccagccagagacggccaagctcccacatcctcatcatcgtcctgggaacagccatgtttaccatcagtgccatactaaaatgaaacagggttttgttttcagaccatacactcttaaattagaaagaagagtggttcttttggctagggttctacaaaatccaatttgacatgatcccatgagaaaaagaagatgaagagaaggagagaggaggagggagagagagagctttctgaaagattgatgtccctgtgcccagcagctcggccatctggacaccatccacacatttcagcggcatgtgaggccttccccgaagcttcagttgatgccagtctccatgtcgtagtgggccttcagatacgtttatgaagtccaaacactggtcaggtccctctttatgtctgctcgtcttatttttctgacactcgtcatcttcttccaggaaaggtaacagaaaacttggacttatcacttaatctggagcacacatgtgaaaacctcaaacactttgaaaaactataatctgccagtgcctggcgtgagggagcatgtcacaccttaccttaaggaaactagattcttttagggtttaatcagcttctaaagcaatattgcatcatggcagttctgggaactgcactgtctcatggcttttcagattcatgaatttccttaccagggacctctgagggccagcctatgaatagccaagtggaaacacacctagcccaggctaactacttaatccaaactcctggaaaacactcacagcccatctcgggagctttccagtgtgaggtcttcacctcgggaagtccttcttcactgaagtcactgctgtcgtgggggtcacatgattggaatcctttcagtctcaacaagaaaaacaaggacgggtctcagacccatttttctccttagtaaaccagcttacttacacttcattttaaaatcatcattgtaaatagtcagtgcctataatgctgtgtggcacggaagaaccttttggacgacagtccatattgggcatcggttgtactctcccacgatcccctcctcccccttctctcctaggcagtttcacttcgacttccatgtcataagtacataacaggtcccataaacataaagtatgattttatagacctatataaaatctaggaactacatataaaaggaacatggcatctgtctttccaaaactgccttaatttacttgacagacttcctctggttgcatccacgtttctataagtgatgtaattttgttcttctttatgactgaaggaaatgtatattgtgatactgtatatgtgcgccccattttctatgctccttcctgtctttggggactccagtgactagtgtgacaaggactgctgctgtgtaaacatcttcgacaagtattgatttggagtcttgcaggaaaatgcttgggtgtggtatagctactcacatggtagatctacttttagtttttcaaagaaccccgctagttatttcctcagtggctggactagtttacattccaactagcagtgtataaaacatcccttcaactcggcctgagaaagtggcccattgagcaaagggcttgttgtggaaggatgagcctgaatttgcatccccgggacccatgtaatacaaaggtcagatggaatcctaacactgagaggcagagataagaagaagaaaggggattaccggctcatcaggctagctggtcagtgagccccatggttaaagaaagacattgtctcaaagactacgggaacatatttgacattatcccccaaccttgtgtgtgactcatacacaaagccaggatgttccctgggattcccaattgcagacagaatatctaacatctcactctacaaaggaactaattggtactgtgttaaataaagtcttacttcatggtgactagaaatatgagagtcccaattgcttcctgtctcatgagcctgtttgagaattaaataccacacccatctctaaggccaacagaaggagagtaaagcaacttatgtgggaaggctttttatatttaacaaaaaagtgttgtatttaacagtataggtgaagaggctatcaaaggtttaatctatgatctgcctttatttctgagccctccagaggtaaaaagagaatcttgccaagtatgagcagaagggactagaagagtgaaagtcattatgggaaatggtaccacagtcctgagcaacagaaaacaagagcaaatgagattaaacaataagcacgtgtcataaagacaccaggaggcagtctggcccttagggttggtaggtttagtagcttgaaactatcctctttaatatccaagatatagaagcaggctagaagcccaccaactgtcaaatggaaaaaggaaatgaagaaaatatacacaaaagagttttattcagccataaagaataatgaagttatgacatttgtgggaaaatggatgcaactagagatcattatgttaagtgagataagacaggcttagaaagacaaatgtcacagtttctctagtatgcacaatctatatttaaatgggagagggcacgaaagtaggatttatgacagaggaccatgaggcctaacaggaagggtggatggaagacaagtgaaaataatagacataaggtatagaagcaggaggggatccatgcttgcactcactgaggagacacacacacacaagaagggggtagcgtacacacaggcaaacatatacatgcacacatgctcatatgcacatacacacacatacacaaacacacacataaacacatacacatgcacatatacacacacacacatatgaactcacacagacagactgtattctccctactaaagatagtaactcctgctttttcccttgcttctctacaacatcccaagagtgtgctgaatttctgtcatctgctcacagcacatgatgatcgggactttgggtggtggtgattgggaatatgggtgagacctcatagctgcctaggaacctcatctcctgcaaaccaggacagctggattgtcatgctgtgtttagggaaagactctatgtttgtattcaacatctcctaggccactgccagctttcagtacaacaaagctctcccataatgccttatctgaaaggtgtggaggaggtcaaaacttgtattgtgttgttgaaaggagccaagttacaaactgtccacaccccctcagtctggacagcacatggcccaaaggggcagaccctgattgctcctgatccatcagcaaggtgtagctgggcctagggaagttggtggctttacacaaggagagaagctcttgtctgtgggccgctgacattcacctctgtggtacaaaactcatgaggaaagagggtctcaagaccagccctcccagggcagtcccaaaggttcctgcaggaagaattagtgctgagcaggatatttaaagcaatcgccttccacaaagcaaagaggacctgcggaaggaactggaagcgaagagcaagcctgcctgatgatcccgaatcttcagattcagtggctgagtcagggcctgtgacttcaagggcaggaatctaacttgactaatcaaccagtagaaacttttactgctggctctgagtatctgaagtctaataaacaaacacatcttgggaacgtacttatctacaagaggcactggctgtgtagctgtgtacccggagtaactaggaaacactctgtaagcccctccttgcgtgtacgcacacataccacgcacactcacacaccttgtcaccgaacactccctcccacacaaggaaagtgaaattgctgtgtgatgagcataaagtcctgggtgtttccaaggtttgggagtccagccaggtgtaactgataaggggagggagccccagctgtccctcagccggccccgccctgattctgccaagatccttatttggtgatgcttttacctggatccctggactcagagccaagcctgctcacgcagggccacagctggagaagcatcgccgccgctgacgtcccttcccaaagagatgaatggaattccaggcagctggagtcatcttggctccggaccgatggcattgagaccagacttcagagacaaaggatcaggcagcagtctactgatggaaaagtgtatacccacagaaatgtaaaccacacctcggttttgggagccgaaaaaatgaaaaaaaaactgtttagggagaaagatgggaaataaaataataggtagagagtaatttataactctacgggtccgttctgtaaatagtgtaagatcctggagccagatggttcagcaaattctcctatcgggagtcacgttaagaaacacgagtgggcacaaaattgtttttcaagacacaatttcaattttgccttgagggagcgggatataaattcgcttccttaaaatgccgctaaaaactctccgaaaggatcccct

SEQ ID NO: 418 - DNA, 233357 bp, Mus musculus
ccagagggctctaatgccagccagacagtatggcatcggttcttcgtgaatacagccagacagctctcactgaagattttgaacttgtcagactccataatcacacgaaccaagtacacttcttcccacgtacacgtttggtttctttggagattccgaaggccttcttactaaagcctagaatcatagaacttaccaaaacaaaagagcatcaatgaactgcctttaaattttcaaaatctctgaaaccccagtctccaaattcctttacagtcaggatggctcaggaacatccttccaagcatcagggcctgctcccacatcttcttagttaccttttcatcagtgtgacagagtcccaggaaaacaagatggaggaatttctttgggctcacagcttcagacagttctgtctatggctggtgggccctgttgctttgggcctgaagctagacagaaacaaagaagcatagtgtaggagcttgtggtagagaaggctgctcatgccatggtggccaagaagcagaaaaagaaacaggaaggggccagcaagcaggtccgtttttccaaggcacactcccctatgatctacttcagcattccatcacgtccgcaaacagcgctgccattgggagacgaatacatgatcttgtgagaagattttatatgcagagtataatgcccacccaaagctagaatggcttcactgctgtacccatgtggctccccaagagctgttgacctttgagcttttatttatctatttcgccttgaaagctgtgattactttttaaattttttatttgttttaagaatttcatttatgaataggctatatttgcataaggtatatcctgggagtgattggaagatgattttacagacacatacataagtgaaaactcgtgttatccattatacatgtgagtgtaggggcagatggtgattcggaaactgcctgctgattttccacctttgttccgtcagtcatgggtttggttcattctagaagagactttttagaggcacaagatgatttgactggaaatggactgctatttctcatgactgtgtgcaggtgaagtcaccttagtggagccaccaagaatatctgttttagggtcccttctcagtagcggaggtgtctattctcagaggcagaagggggaaggtgttaatgacatcatagtctttcaatgtcagcaaaatctcaagttggttaaaaaaaaaaaaaaggatagaccagttggaaatgcacaaaaaacagggcctagtgatgtgggtctgttgtctgagcccttgggaagtgaggtcgggagagcaggaagtctaggtcagcctgggctacatgagaacctacaaagagagagagagagagagagagagagacagagacagagacagagacagagacagagagagacagagagagaattttaaggtgttaaatgtttgccacaggatttgtttttcttaacagcccaggagttggtgtggtgcctcaggggccgtagtttgggtcagcacagggtactttccctgtatgtgaaccaccacaaacacttcacttaacccaggcagagtcagctcctccaaaccaaagagaaaagccccagcttgggttaactggcagctgaaggcgacagacagcccagattgggggagggtggggtggaaatgaacctcataggtggtttctacctaactattccagaccctcccacactggggtttgcataaagttgcagaggtggccagctcccactaagtatccggttgtatgcacttgttcaaaggccagtgtgtggacttatgggtaagaaagtcttaggacccccactaccttacttgtattttgttatttcaacaacttcaacccagtgtcctggacatgaaaagaggccatgagaaaatgagaggacatgaaggttggaggaggacatgttgggggcagtgggagcagagagctctgggaggaacaagataccctgcgtatatgtgagaaattgtcaaagaaaaaacacttccgaatcactcccagagcattcctcatggcatgtctgccccccagtccgtttacacctattttatatctctgcagactcccggccctgcttgctcctggccctcactccctctagcccataggttttgtttgtttgtttgtttctcattacagatgattgtgagccaccttgtggttactgggatttgaactcatgacctccagaagagcagtcagtgctcttaaccgctgagccatctcaccagcccagatttaactttatataatgcaaatatataacagcagtcttttccctggcttctttcactcaccagaattcctttgatgattcatccaaattttatttataagccacttatctttccttccgtttctctgatctgtgttggggatgtaccacgtcagtgtcacatgctgaatgttcaggtgggtttcattttggggctatgacaaaccaagctcctgagatttgagtccaagatgttttgtgaacatttagttccttttcccttggaattgaaagtctggggcatgtgatgtagtcagggcatgtttaactttttaagtactttgagctgtttttttgaaatgtttgtagaagtttacagtcccagcagcagggtgtgagaattctagtgtctttccgtctcctgcacttggtagtgtccatctttctcatggaagccactcagaagtgtgtgtggtggtgttacacagtgactgcagtctgcatttccctagtgacgagtgatactgctgcttgcacagctgcagagatagctctccagatggccaccatcttctcagttatgctattttcttctcattgagcttttacgatttttaaaatttttcaggatataagtctattgtaagatatatgtgcattagggatggagaggtcagaagttaagagtgctcttccagaagacctgggtttgattcccagcacctacatggcagctcacaactgtaactctagttccagaggacctaatactctactctggcctacacacacacacacacacacacacacacacacacacacacacacacgaacttggtagtgtctatctttctcatggaaaccattcaaaagtatgtgtgatggcttagcttttattcatatggcaaaacacccatatgaataaaataaaagttaaataatttaaagatgtaaaaatatttgggtgacattttttttcctcccagtatatatagcttgtcttttcttgccattcaaatcttttcaaagaacagaagttttaaatgtgaaaaggtctaattatatcagtgtatttcaagattgtgtatttggggggtcatgtcttaaaactcttcacctaatgcaaagtcaaaatgtgtgtgtgtgtgtgtgtgtgtgtgtgtgaacatttcctgagtttgagcttgtgggcatgtgtgcccaggcacacacatgtgaaagtcagaggaagacattgggtgtctttctccattactttctgccttcttgctttgggacagagtctgtcactgaatgggaggctcgctgtttcaaccaggctgttcaggcaatgagcctctatgatctactggtcgctgccctcctccctgccctccactgctggggcttcaggcacacatacagccatgcctggctttagggatttaaagtcagcaaactcttaccactgagctgtctcctcaggccttcccacagttttctctctcttatctttaaagatttatgctttcagacttaacactgaagaagtgaacgatgcacattcttagcaatttcttgtgagttttgaaagcctcctctcccccatccaggagggaatacttcagtgtggaggaaacagctactcgacacacatttgccatacttattcataagtactgcatatgttgctgccactatgaataagtcagatttcaatatctgatattatttagaaatagtgttttgggggcattgctaaattcacttctgaggtctggtattttactttcacattcctaagtattttatagagaaggactgtccacagtacaaaacttctatttcttttttgtgacttatgctggctaggattctcagcaccaggctaattagaggtggttcccctggtttctgcctcaacatgagaaaagtatgtcttttatcatgaagcatacaaactgtgggtactttcacagttgctcttaaacaggacaagcacatggtcttctagacctggttctccaatcattttaaccaagaagagtgattaggttttgtcaaatgtctgtttcctgcatctgttaagatggccatgtagttcttaattttgcgatttatatcatgacttacattgaatgggttttgaagactgaactcaacggggtagaaggagataattgactcttgagagttgtcctctgacctccacacacgtcatgggatgggcccacatgtatgtttctatgtgtattggagtgtcacacacacacacacacacacactaaagataaacacattataaatggacctgtttgtgtgtagttcatagtgcacacagagctgcagatcagaaagactgaatcataaatagcaggcccacacacatctcccaccatagcactaaagcctgaaacctctttatttcagatatcatgttcttatcgagaagaagttacaaggcacactaaaggaaaaaacagaggcagaatccaactgagagagcaagaacagtcacatcaggcatggagctggaaaggaaatcttgtgttctgtctgtctgtcctcggggaaggctgtccacctcctcctgacttcacctgtctgcgatatgtattgtttaactctacctactttccagggtttgtatttcaattttcagaaatgtgactgtggatctgtctcagtgtgggttactctaggcttctctttctctctctctttctgggggatttgttaccatttctgtttagaaaccgcagctttatgcctgttgccaaaagtttgcaacgatcatatgttttctgctgctcctctctgtctctgtctctgtctctgtctctgctctctgcggggactcagatcttacgaacacaggtcttttattgcccatagttctctcagacaggtcatttcctagtctccagagttcctaattatctaaccttgcctctgatttatttatttttgcctgcaaacttagcccatctattgacttttcattttagttgttatattttttaattttctaatttttacttcatgttcttattcctttacttagattctcatgatttttgtcttaatattttgtttcaagagtaaattcaagggcctgggaagtggctctgttgggtgaaggtgcttactatgagtctgcatcactagtgtgccagactcgtgggatgccaaaatgccattcagatatgaaatgcagtctaaggttggggtcttagcccgtgtttcttcggatgagaactagcggggtctgggacaggctatggttctcaaactcctgtgcacccagagacctctggggaactgtgaagaatgggggctcccatcctcctgtgtatccagacgctactggggacctcgagaagttggaatgggccatgggcctgtgatgagcccaggttggaggaatccagcatagctcagagggagtgccaggagtgcagaggggctgaaagatggccttctacaggagacttaggcactgctctgtctggtgaagggacgaaggcttctcactccatcccccacctcctggtggtccttgatgaaggaggcagtccttgtttgtccaaactgctttgctcatggcagatgatgaggtatatgactgactcagggtgaaccagagactaaataccttttgcagaaaaggatgcctaggaagggatctcattggctaagcactcagggtccctagatacatcattagcaaggagaactctaggctgtgtactactgacgggctgttgtcatggtcctcttagtggggtgtcatggtcacttgctccaggacaggaatctggtcaggagctagttcgttcaaacacctgctgttctcactcatgagttttatccaggttctgaaccttgctaccaccttagcagttcttctgtctggtggcacagtctactgctccacagcctacagccaagctgatgacctgagtttgatctcatgccccatagagtagaaggaaagaaccaactccgacatgttgtgcggtgatctctacatgtgcagagtggcacttgtgtgcccacacacattcatacatgtatgcagaactaagaaatgtaagaaaaaaatattttaaaagggtacatccgattttacaatggttttcagcatacctcacactaatgacatcccattgttaccatctgttgcttttctcgttcacttttgtccagtttcctcatacgacaagtgctttttgcatcggtaactttttagtgtgtattagttaaatacaacaatggatttcattatgagaattcagacatgtatataatgttttgatcatatccaccttattgctctcgtacccccaactccactgaagccctcttcccaaacaactttttccttctacttccatggcctccttctcctcctcttcctcttcatcctttcctcctccttcagctccttctcctcttcctatttctctttctccccctcttctacctccattcaccttctcaccttctgtgtcccaatgagtttaattagggttgcttacaaaagcatgggtaaaaagttatttataggcgtaaaaccgtggtagttgttcagtccacaaggctggatgcttcagaaggttcctggagagctgctgctttctagttgaaagcttggttctattgtaggcaaaggaatgaccaggggcagcggcacaggagcaaatgagtgcagaggcaaggcgggggggggggggggggggggggggggggaggccgggggcgggggaggtcgagacaggagaaggcagacagtcttccctccattttttatctggactgctccctgaaaaaacggccacccacagtgcgtgggggggggggaggagtaggtctcacatcaatcaaggcaagtgctccatctaggctgtagctaccaagcaggggcaagaatgtgggggctttgggcagaaagtggacagttatgggtgctcatgctaagaatgccatgctttcttgctgggtttttatatttggacattttcacagtgacaggtgaaatcgtacacacagtcccctcctcagttcagagcagacgctcaacacttccctcatctacagagtgagcccaagccaaggaggaagtgagaataaattgcaatgaatgagagaataacttagttagggagatggtttatcactggaaaaaaaatcccccagtcttaccctgccctggtgtctcttcacctgtaaaatttgacattttgattgcaaaagtaatataaacagacaataaaatgatcgctcaatagagaaaagaaaaaaaattaaataaatattgtattcctctgggagagatggctgagcggctaagagcatttgctgctcttccagatgagctgagttcttgacacacgtcaggtacccgacaacacctgtaactccagctcccggagtctgacccttctcctggcctcccaggcacctgtactaacatgcccatacccacatgcagacacgtaagtaaacatgaagataaatcttcaaaaaaaaaaaaaagattccttgtatgagtagctgagtagcctcatgaagacagtgcttgatggtttgttagttactcatagaggggtagggaagagagagagagagagagagagagagagagagagagagagagagagagagagagagagaatgctacctattattttgcaacttccctttttttcttgaacattcttcaaaggaacactctacagagtagagtaaatagttgcttaaaagaaggtgtggttaaaccagacagtttatgatcatgctaattttaattttgacatgaagctaattgtgaacgtttacctggtacataattttgtatacatattatgcttttaacctaagaacaaaacaaatacagcagcaggaacaacccaagtagtgagagctgaagttgtggttgggatcaggtggcctttggcgcctctggggacaggtggcagctgggccacgtgaggggaactatttagcagagtgactcagcagagccaggctgaccaagatcataatctgtcaggaagatgattgttcttagtcatccaatttctcttctacgatgtcgaaaacgctcacttgtcaggtcctctctgctttgccagttggagcttggattttcattttttcccaggactaagcaattctgtttggagctaacttttgggggcatcaacggtgtttgactcaagtttgaacccaagatctcctcagacatccttcaaacaagtatcctccgatgattcagaaaccccacaaacagaaatgttagcaaaagacctaggaaagctgaccttcaaccatagtgctatgaagctttcttctccttgaccagaaaaggacatcatcatcaccaccaccaccatcatcatcatctccaccgctggagggagaatgggtggagaacagatgtggagaaccatggggaaggttcaaagtgcctttcccaggagaagggtccagacattactgttggtacagaatgactctgtagcaaagagaaacagattataaggattggatagagctattggtctttgtggaaatcagtttgaagaagatagtggaccattcagatacatctgctctttctgcctggatcatagatggatccttctgagaatgctgccctggggagaaagtaggacagtcaatttaggctgaaattgtacattgccctttactgctgataatactgatgtaaaagctttttttttttttttgagatgaaactgtacagagatcattttgaataatctatgcatgtattttgtgatttatttcagttctttggcaatcattttgactagtctatgtacaagttctgtgatatatttcgactcatttgctgcaatcatttgaccaatctctgcgtgagatctgtaatgcatttccgttcttctatttgtctgatgctgcgatatgtcttccaaacttgtccccattgatctatatgggatgtgtaaagtctgaatgcaagtgaatgatttcattatatctttatgttccaatttgacccaaagaagagtgagtgaattcaaatactctatgagcttcagaagcctagcgtctgagatgaaatacaaggatgtgaaaatataagtagaatttaggggtaatctggttagaaggtaaataattagatagtcgattttcccagtttgtaggtatttatcttaatttccagtaatagatatacggaactgattaaaatgggtgtgtgtgatcaaagtggtttaggttcctctttgctcgtttacaaataaaccctgtgcatgctcatccacctcagtgcaaatgtgagcagggcccagccatcggggagggcctactggcttccccagccatcggggagggcctactggcttccccagccatcggggagggcctactggcttccccacagtttcttttctgtacttaaccttacatgatatttcctgccacctggtttgcatccagaactgtttctcacatagtatattgactttactcccttggccccatgaagcaccattgtgctcaacacaaacccgttgtccctgattttatattgttggccctaacagattattaaaaccccaaggaggaggacatttgtgtgcaagaggtgatgggctgcctactgtaaaacagaactctggcttaggcctctttgtacacacagggctcctctctgacagtacagccatcaatttcatcaatagtaaatgtatccatcatcaatagtaaatgtatccaaagccgtgattatgaatgtttctaggttagttgggtgctgactggataataccagatccaacaggaatcctatcgctgccctaaatgcttggtaggaggcctcgacttcatccatccacccaaatgttcagttcttactatacagaactaaacactgatttttctagatgctttacataccctaaatacctgccccagtgagtttttcaactctagcctgtgctctgaggacaggctaggacaaagctgtgtcctaacctcccacctagtggagaaccacaagcccttcttcaacatcaacgtcctcagagttatgccctcctggagtcttttctttcaagggtcttggtgcctctttagacgtgatgtcatgaccatcttggtggcaggcagctgcagggggggtgagtgggtagagatggtcttgtggtcccctgacaaattcattcagacattgctcattttggagccagagccttcccagggaggcctcggtaagggtctcaatggtttcccaatgtagaatagctgttctttccatgatccttctgtgtgagaaaatactgagcagccagggcctcttgctctgtgcccagctccaccctggctctgtccaaaccaaagatgggaccaaagtcccatctccctctagttttgtagaggtgtattatcacccatccttttcatctttacctagaaccactcaaatttcaagaactattttattgtaatatcagattgtgctacatttaaaaaacaaacaaacaaacaaacaacacccaaaggcaatcatcatctgcttggatgggaagaaaaattccccttcttatatctaggactctgggcaggatttagctgcaccccatttacacggtctcccttttctatgaaagctgcttcactcacggggccatcagtatacatggacaatattgtgcacttttggtacagatcactaaatgaacaataatcataatgtttataatgaaccatgcctgaacactatatcagccaatcaaaaggacactgagcactccaatgagcccttcctctacattctggattcgtttccttgtacagagggtcattagcccttctgcagttcctgacatatcataataaactgtcctccatggaagagtatacaagtatattatcaggagcaacgaacaatgatggcacttttaccatttccataggctctgtttgtaattagcatgcaaacactcggtacaaggcccaaacatgactaacatcttcagcctccacacacaaacacatatttttttcttttttctaaagatttatttatttattatatgtaagtacaccataactgtcttcacacacaccagaagagggcatcagatctcattatggatgattgtaagctaccatgtggttgctgggatttgaactcaggaccttcagaagagcagtcagtgctcttaaccactgagccatctctccagcccacttttttttttcttgagatagagtctccttatgtaagtttggctaacctagaactcactctgtagatcaggctgaccttgaactcataagaatctgcctgcctctgcctccctagtgctggtactaaaggtgtgtggcaccatgctaagctgattgataatttaattaggtgactaaggtgcacatgaacaatttcccacagaccagttatgtcaccatggtgctatgccagctaagcattctggcatctttcccttgatttctgtacatgtatgtgagaacatgtgtgagtatgtgtgtgcacgcatgcactgctcacatgtttctgtgtttacctaagtgtgtgtaggtgcagaggccagtggttacctccactgttgctcttcagacactgttcactttcttcttcagacattagcctgaaattctccaatgaggccagactgactggccagtgagccctagggagctgcctgcctctgcctccctagcactgggcacataacggtacctttggcttttttaaaagtgtgtgtgtatgtgtgtgtgtgtatgtaatagacagagagacagagagagacagagagacagagagacagagagacagagagacagagagagacagagagagacagagagaaagatccatgtttgcatgtgtgtgcacacgtatctgtgtgcatgggaaaacccagagttgacaccagatttctccctagattgttctccatcttatttattgaatcagcatctgcacctggagctcacagttccagctagggtagctagcagtgcctcctgagttctgggattagaggtggcttttgcaagaggtctgggcactgacgctcctgtcttcgcgcttctgtggtaagcactttatctacagcctacctctccaagcctatgcctgcccctctcatgaatcctgtgcatcactcaggtccttgtgctttacaggcaagttctttatggactgagccctctccctggcccaaaagttatcgttcgtagacggttgccagttcatcctcactaagcatttatgctgggcatgctgggctttacagaagctgcttaattttattttcaaatagttttctcctttctcagagagaacttggcaagggcttggtcctgttatggtcaattagccatgtatctctcttgccaacaagagttggcctgttgggctggacttgggcaccagatgccacctcctgcttggctgccctcttggtgacatcacctatacctggagtacccagtagacaatgggctggaaaggagtctgaccagccaggaccatgtcattggacacagatcactgctgttgaaggagtggctcagcattgaggctcctcacagcctgcaggcttgacccaagaaggctcttaaccatgtgacctttctaactaccaccgagtcacatgcctggcttctcagtgctgcaaaggttagctaagccagggctagcgtttctatgatttaagtgtgatgaggcaggaggagagaacccagcacccagaatgagcctccagcctgaggcagagcagaactcaatttgtacacacaatctgcccatatgtgtgtcaccttcattctgttcaaacacagcaggctagggaggttgcactctagaatatagtcatgaggaggcaaaggaatgggagtgaatctagctaagtggagctgctgtatggttttccttagccttccaaagtggtctggtcacattgcatctcccctgggtgttttcccatggggctttgtagatccacttcccactgtcaagatcaaccctaggatgccatgagctcagggtctcctgacaaataaatgctcacggtgtactagacttggggccaatggagccaggttagatttggcctgtcttccaggagctctcagataaccagtctgtggccatagtaccatgaggatcctgctagctgagcacaaaactcctggggaagaaagcacagaacttcctgcctagaagctgtgtttcgaatagcttaaaaacaggtaggccgagggtggtggtcttacccaaaagaagcaccaaatctgaaaagctgtggaccacatggctacatggtagcaggagctaccaggtaggaggatggagcagcttgtggcagcagagaggagctgctccttagcttgcatttggtgatcgtggggaaaagaggatttaaaatggttctgtggctttgacagtgggtacacgtttagggcacaaaagagagttcagtaatgaacatgctgaactctggacatctaggagacatcatagcatagttgagaggtccagagtccaggacaaggcatctttaattaaggacgagagtctgggtccaatagccacagagttacaataggaaagagagcaggtaagcagggggagactgagtctccatttccacttgaatgtgatgagggccagcccatctgactataggaggaaggtgtggacttagcaaccctagtacctgttgctccatagggaaagacccaggaaacaaggaaaagttaaagaaatgggtgagtctgccaactaatgaatcatcattcattcccctgaagccactcagcttgaaaagaatttactggaaaccaacttgttgaaggatcagtttccctggtgaggactccctggaatttacccaaaagttgtttgggttaattactttaacaatgatcatcatgtttgcccgctggttcccacaagccttcagattccccctgcgtggttttctaccttacaatcagtttcatttcactgtcttaggcatattctcactagtcacccagctattgatctttcagcccatgtcaatcttttgagtgtttctttatttagagagtgatggacttcctgagctcatgaaattatgtgtgtgtgtgtgtgcccatgtgcgtgcgcttgcacgtgtgcactagtggctgggttttcctcaactgcattttctgtcaattgtaatttgaaagacagggctctaaattggacaactgctcccactttgggatttttgtcattggggaaattgtcataaatatgtgaaaattaacactgcaggaaaaaaaaaacgttgagttggctgcctgccaaacctctcagggaaacacagagcggatacagacgggtgttagatggccctcgctggacaaagctatcttttctgcaaagcagaggttaaagttggaaaagcctcgtgaattgtcagaacctttatatatgacaatggaagagaagtccgctctagaaatgggaaccacatgccaaataactgattttttaaaaaagttacagggtagagaatccccaaatgaaatatttctactagataaatactaaggcctcgtcagagaaaagaaagactcctgaacagaaatttgctaggatcgtgttattgtgcatcttgaaaacaggcagggcagagaagttgggatttgctagcctgcaggatttggcttcagaaaagtaatttttagtgtcccgggttgcttttgtttttaaaacacagtcacttccaaacatggctttaggaaacttttctgagaatcacaccttttctgagagggactgactgcacactggggaggcttaggaaacagaagtgacctagaatctagattttgcaggaaatcagaggaggccagttatgcagattatgtggaggcctgtacagcgctggaggctgcagagagcacctttcgctgggaagggtgaggtcatctgaggacagaggaaaaacgaagaggaagtgccctctggagctgggaaggtgctggggctaaggaggagtgcactggggagggtgggggcgggggcttggaaagggattctctccagcgccatttctatagcctgagctgcactagcgtaaacaggggccgtgggcatacggcggtaagactgggattccacggccaggaagcaagcactaaccacgggaagtgttgggaggcagaatgtctagaagcaggcgaaggagggagagtgcccttggcaacggggagataatgagcgctcctcacagtccaggaactggtctgcttagagataagcaaggaggccaggaagagaatcccaagggccccaaggcatgtgaggtagcacaatgctgggtttcaggtgtggctttggggtttgaacagggagaaaagcctgctcggcaccattctgtccctgaggccataactgtcccatcacattcttctcacaaaggaaggtgaggctcgaaaccactctccatcacctagtatccccatcccttgtcctgtccctcctcatccctgcctggctggcaattaacacagtacaccccaggaacctactccgtttctgggcagatatggttattcatccaggaaggagaacgaattaacctgtttccgtttccccagcgcccgtctatctccctcccattcctaggaggccgccctcctccttcccacacccgcttctacccagaggcagcaggaagcctctctgcagggatactagctggggatctcccggctggaagcacctgctttgctgcagcctggggcactgtgacccctggggatgcagctcagaaagcccctattaaaatgctaatgcagcacctggaagggtgaagcctcaaggcagcctcctatctcggtgcctgagcttcctcctgtatgactagccggggatagaacaccctgtgggtatggcggatgtcttgacatcaggtaccaacccagcattctgctaaactctatgtttgagttccatagcagtcaggcttaagcttgggcgcctctcaggacagcaggtcttaaagagtctggcgtctccctatcccaggccctccctaaacacagtattattcggggcccagtgtctcacttttctcaagacacctcagcacccccacagctgtccatgtaagatgtggtcaccttcagtctgtcacttcagagaagtggggatctccatgttaggcttcaaacccaggacccctaacgctagccctgttaatatacaggcaattccacttggcctactctcggagacctagcaactgcttatgtcagcacctgaccctgctgcagatataataaggttcctccagccaccacatctctctctccccctaccccacccggaaagagggttggagagatagctcagcggttaggagcacatactacttctcaagtgctcacatcacacagctgccaactgactgtaactccagctttaagggatccaaaacctctggctcctgtgggtacctggattcctgtgtgcatacacacacatacacacacacacacacacacacacatacacacacatacacacacacatacacacacacaccctgtatatacataattaaatgaaataaatgctttttaaaagagaaatatatgtatgtttgattaaacttacagtgaatatcagacttaatggtaaaaagcttaatctcttcctcctatgatcacaaacaaggcaaggtcattcaaaaccagtgaggccactcctgcctgtgacccaagcagtatggagggctgagaaaggaagaggaatgctggggcttgctggccatcagcctagcccaaacacagcgaaggaccctgtctcaggcaataaaacagggatggggaggaggcgttttgacatcctccgttggcctctgtatgcaccggcacagatgtgaacacacatgtcacacacacgcatatacatacacacacacacacacacagaaagagagaatagatgtatcaaaaagattcatcataacaatctctaatttacaaagtcagacagattgaaatagatataacaacttctaaattacacacatacacacattctttttgaagaactcaaaatggatcgcagattgatgtaagactataaaagtattattttagaaataacaagaaaatatccagggcttgggactaggctaaacttgagaccaaatacatgctccataaaacatataaaaaaatattgataaacaggagtttacaaaattagaaacatttaccttttgactttaagaagatgagaaagcatagattaagatgaatgtctttctaagatctaatatatctcactagcgaagaatcaatggagaactaaacaacccaattaaaaattgtgcaaaagacgcaaagacatttcatcaaagagaatgtatgtatggcaaaaatgtaaagagaggaaatgagctgtctctctgcaccacctctcaaggagatggaaatttaaggacttgctgagctagaagctaaggaactatacggatactgccagcaggaacgtagacctcacagcactccacagcacagctgggtggcttcttaaaaacgtagtgtctgatctgggtagggtacaccgttgatcctagcactcgggaggcagagacaggtggatatctagtttgagaccagcctagtctacaaagtgagttccaggtcagccttagtcttagtctttccaggatgttgtgaccaaatagtccaagaaggatggattaaacaaatgacattcatttccatagttctgagagccagaactaattgctagaattttggggatctggttctcagatttgaggatttcatggcttgcacatagtatcttcccaccatgtcctcctgtggtacacgaggccaggcaacttcggagccttttatataagactgttgtcattctgcctcctgaccttcactctccaagacctcatcttctgatgtcatcatacaaaagattaggtttcaacataggaatttgagggcaggagacatgaacattcagattgtcacactaaaaatatacctttcacatggcctagcaattttatccttgggcatttactccagaaaaatggaaacgtaagcacacaaaaacttacgtaggatagacattttatatgtaataactgaaatctagaagtacccacagtgttctaccacagtgagatgattagacaactgtggtatagccacaccatggaatattgctctgcctttatttttctggtgtgacaaagaatcctgacaaaagacaatgtacaggtaaaaaggggttctttcagcttacaactgcagatcccagcccatcagtaaaagaaggcaaggcaggagcttgaagataagccttcttgttcttccacacagaaataccttcagccaagcttatgtcacagctgaagaaatgtagtaggaattgtgaagatgctgcttgttggctagcaacaggtttactctctgttagttttcctatgtagctcaggaccatttgcctagggattggcatcaattagcagtcccaagtatctcccacataccacagtccaatctgatctaggcaatttcttaatggtgagtctctcttgttttaagatttatttatttattttatatatacgagtacactgtagctgtcttcagacataacagaaaaaggtatcagatgtcattatgaatggttgtgagccaccatgtggttgttaggatttgaactcaggacctttcggagagatgtcagtgctcttaattgctgacaggccattctaggttgtgtcaagttgacagtcacagctaaccagaaaaaaataccattcagtaatgaaagggaaccatgttctaacaggtacaaaaagtgtgtctacagggcattctagtaagcaaagagagtcagtttcaaagggtcacatatcataccattccatttccaaaaaattttaacattacatatagatataggagcacaatgatttgcaagggctagagactagaggagaagtgggtatgactataaaggggtaacatgagtgaccccacggccaccaacacatgcgtaaatgcatctgagagcactcacattcacacacatgcatgcttacacatggacctatcaatactccataccagtcacacacatgcatgcacacacacagactatcaatactccatactctggtttaggtgtatctgataggcaactgggggagggaacttgaggtgttatctttacaagttatatctgtctcaaactataattgatattcttatttacttatgatatgtgtatgagtgttttatcttcatgtgtgcatcatgtgtgtaccaggtgcccaaggaggctagaggaagccatcaagatctccaagagttggagctacagatgtttataagcaccatgtagggtggtggaactgagcctgggtcctgttcaggggcagcaagtgcttctaactgcaaaatcatctctctagttccatcaaaaacttatatatatataaataaaacagtttcattgttcccagatagcctagttccctatgagaacatgactggtctttacatggtgattctataagtctcaagttctcgcccattgttgtttctaaggcaaagcctttgccttacagttttgaaagttgggtatatgtaaatataggtaaaggcaattctgagctgacttcttgtgggtttttccgggtgtctttcaccacgtttacaacatttaaagccactgattattgcacatattcctgccacctactttttatactctttttccaggactgtgattctagaaacacattttctaccactgggctcactctttcttcgagaaacctgtgttttcccacaattcccagcctggaccaactcccgttccctccctttctctaaattatctcttgggttcccaaacacaactggcaaatgaccaaactgggatttcccaggtagctgattcttgctctagagctatctcactttcaatattgatctcttactgaaaacatattgacatctccagaaacaaccaatctaggcagctctccggggtctcaaatcttcccacaggaatgacactcccaccctgtgctgctgccccttgggactcagcctcttgaggaggactctttccagtctccaaaccatgttcctttccctgccagaccctgccgtatttaccctaagagcttgaggttctctcacagatctccctgccccaaataatcttcccatggaatcttcgaggtcctatagccccacagctgaaatgctctcctggcttcctttgatcacacctcttcttctctctgaacctcagttctcctccattgactcttcctgacctttgtgcagtttctaagtctttatcaagctgtagcgctcacacagtgtactgcaggactttcaagagctgggtgtatttttcacatgcacacctatgcctgcatgttaccccattgggcacaggagcttcagaacacttctgtgctgaccctaccaccctcctgggttctatgctcatcactgctctgactcctatcagtacaggttattcttaccggttcttgaagtttgcacagatgatcattatggtgtgaacacaaactgtctcccatggtgtggaacacctgtccccagctagtggtgctattttggggggtgctggaactttcaagaagtgggaactaactggctgggggcaggttttttgaagcttatgtcccaggccttgtgctgtagttagggttttattgctgtgagggacaccatgaccatggcaagtcttacaaaggaaaacgtttcattggggctgagtatagttcagaggttcagtccgttatccttatgtcaagaagtatggtgatatggaggcaggcatgatgtaggagtagatgagagttctacatctgggtcagcaggcaacaggaactgactgagacagacttcctccaacaaagccacacctcctaataatgccactccttatgagccagtgagggccattttcttgcaaaatgccacactctggtttcttcattctcttcctccctcctccagctctttctctcatcttcctcctgccctctccactcctgtcctatgcccttcctccctccctcctcctctctcttgacccactgcactatgaacaccttctttgccaattgttctcaccatgcctcacttatcgtgttgtactgagaccctctgaaactgtgaaccaaaataaatctttcctcatagacattgtctcaggtatttgggtaccagtaagtaactaatacaatgctcactgtctcttagattgatcttacccttgtgtgtactcctggtggctcagtagaatcccactgataggcacagtggagtgttatctactccagtcctgatcgattttgaggtttttctcctcccttgaggccagagcaagatctataagttctctggtgtcagagggtcaagtcaagctgtgtatcaaaaacaaatgaggagaagtggacatcaatatgagatcaagcaatttcaggcttgtgggccatggggggagagcctcaaccaatctcagggtgagattgtgtggactcactggcttttgtgtgaaaggaacaggccacaccagacagcccaggctagaactccctggagagctggagtctctgggcttgggtttgggttccctggcctcctgcccagtgtcgtgaggcaacccaaatgagagcccaagagagccaagagccacagggctgtttttctaagatttaaaagggattatgtcatccacccagcccttgtttgcccaagggaagaacctcaagtctcctccctcaggaccctctgagagatctttctataggtgctgtggcagaaagaaagaggacagagccacaggcagtgggaagagctgggaatggcctctggcagaggcctgaggctaaactgactgcacctgatgagcaacagagattgcagcctgtgggccaccacgctgactgtttacatatgcataatcagagggaaggggggaagacttgggagcgaaacaccagagaaaaacccaagaagccacaagacccagacgagaatcagcgatctggtaatgacggggttgccgtgaggctggtgtttattccagacagagctagtgcttccctgagatctggtgacaatttggggcacatatatttagggggaagggcaagtcctgagaattggttttgagtcaggagacctggggttgaaactcagccatgtggtccacagcttttcagatttggggcaactagctacctaccccctcagcctgcagagtccctgcctggagtaagaagcaggtaaagtcctggtgcacaggcctgcctgggcatctggttttggaggcccaggctcactaagtctctgactggatgtcactgtaagcatatcagtacattatctgctccccccccacacacacactgtaagcatatcagtacattatctgctctccccacacacacactgtaagcatatcagtacattatctgcaccccccacatactgtaagcatatcagtacattatctgccccccacacatactgtaagcatatcagtacattatctgcccccctaacacacactgtaagcatatcagtacattatctgttccccccccaacacacactgtaagcatatcagtacattatctgccccccccacactgtaagcatatcagtacattatctgttcccccccaacacacactgtaagcatatcagtacattatctgccccccccactgtaagcatatcagtacattatctgctcccccccagcctaaggcaaggtttgtttttgctttaagttcctgctgccaaagcgaaggcaggcctgttaagagtcaaatcctcacccagcgtctcatgttacaaggcactattagctcaaggtgtctgaacaacttattttgaaccacaaagttctatcttgggaagaaccactggcttcagtatcctaaaccagcgcgctttgattttgatttttttaaagatgctgaaagggtcacccataggagacaaagaaacaggaccacataggcgatttcaaggttggtcatgatcatctggcttcttgaagatacagtgagggtaacaaattcacaccatagagacccatgcaggatgtgtttaatcaagtgcttcgccagtagctatgtgtggcctgcctttcctgggctacatcccccaggcagggtccctgcatctgaaattattcatccagagccaccatgaggtatttgtgaataaactataacaaatatccagaggaacatcatggtgacaaagacactgagctttcaaagaacgcgagtgacaagattcatggtttagacactcttgttttattttattgtgtgtctgtgtgtgcgttcaggtacacatttgtgtatgagcgtgcatggcacatgaacacctgtacctataaagtaagagaaagacttttggtgtgtctctactcagtactatccaccgtgtgggtgatggttttgttttgtcgtttactttcatatatgtgttctgtatttgtatcattccgtccttctcctcccttcaagccctcctgtagttctctccactccctcacgaattcccagcttccttttccttataattataacacatgcacacagacacacacacagatacatacacacatacatacactcatacacatacacacacacacacaaatgaaacctactgaatctatttcgtgttacttgtgtgtatgtttttagggctgaccattggacaacctaccaggaggcagagtgtcttcccctttctgcagttattagttgcttgtacctcttcatcgaggggtaacataggatcttatactggcctggagcttgcccagtgggagaggctgtgggctagccaacaaatcctaggaatcctccagtctccacttccccagcgctgagatagcaggtatgtgccaccacgtatagtttatctgggtttggggattgaactggctcgccaaggcttcccaggaagcacttcactaacagagccattgccttagcgctccaaacctgcacagcatttaaaatctgtttgtaaatctctagtatgagctaaataaatatctaatttttctctatatattcctaatacttggccaaacttctacttacatattttctcatgaagaaagtcatgtatacaattatcttaaaatcagtacatatgacgtacctctaatctacaaatgcaaagctcccaagatgtctcattagacccatcccatgctctctggaacctgcagaaagctgttgccaccctgtacgaagaccattagatacaaggtgagctgagccaactgttggcagagtcttcgatgtaccaggcttcaatatgagcacttcccttgtcatcagctgccctgaagtggctctgtaatcacatcctgtggctctggggtgggtattgggcagattgtgggataaaatgtaaaggtgacttgctgacagggttgtgactacctggctttgagatgggatgtgagataggtaccagaaaaaaactgtgaaaccagcatgcagaggaagaggagagggtaggatgtccgagtggctatgcccccagtacctagcagcacatattggcaaacctatatttctttcccttctctctctgcttgctccccatgagttcaaagacttgtggctggtgaaattccccctgaaaagtggctttctcttctctcttagttctggagttcccactggaaggggaaacaggactctggatgagagaaatgcactgctttcttattttcaaaataaagcaattcagccaacctggcttccccaaagaagccatcactattggcacatctggtcagggaagtaagagtcacctcaaatcacatctcatagttcccccagatccagcttccctcggatgtgggcaagtctgtgtgcccaggagcccaagggagaagaagcaacatcttactgaacacatttcaggcattatttctggttccttcttttgaggttagctcccacctgaagttactggaaataggctggctatgagcctcagacacagtcaggcatgcagtgaatagtgtcagtgttgtggggaagagtactgacatgatatagtgttgacccaagaaggcgacagggatggacctggtaacatctgaacatttctcctctggttgatcccgcagtctagagctcactgcaatagtcccaacacctatgtcttctgtattgagcatcgagctggggctcagtgaccatcctaagccttgagttcttggtgcatagctctttgaagtacagaaagaatagcttcataagttttctggaagccttaatgagtgacacttccctcctgtagcagggctcctgtgagggaattccagactggttaaggtaggtcctatctttctatccatgccggggactagagtcggtgctaaccgtgaggttgcagccctgctggagcagagaatccttctgaggctaaaactgaaagaacagcagagacagtgtgaaagccccttgttgaaccacagccctggcctggtgtcatttttgagaatacacttctctattctgcgaatggtttactgttttctttatggtccagctatttgtgtgccctgagaaatcactagcaactgctttaccaagaaatgagctagctctttggggactgtgtttattgtggtcttcttatctgaagggaactagactttgaagcttccaggaaaaaaaaaacaaaaaaaacaaaacaaaacaaaacagcattcctgatgggctttgcgaaccaatgtgtcttttgatgacaagtggctgaacactccaagcaaacatactaactgttaaaaccttactcttggagcacagctcaaaccctattcttagcttctcatttctccccttggaccacagctgggctctgaggatggagaccccatcctgcatctaagatctagacagtagggggcagagaagtagagaaatctctccctggaaggcttttagctaatatacttatctttcaggtctgccattggagctggaacatgggacctcaagtatagaacattctcttctccacttctgatgtttaaaagacttcaaagaggtccacatccatacagcatagcatagcatagcatagcatagcatagcatagcatagcatagcatgtatgatgtgacatcatcagcccatccacgtattctttccaggtctatttgatgaaagggcttccatgtaattgaggatcagtgttttagaatggtggaacaaagaaagaacactctcagatagaaccctggctccattagctgtgaaaggtccctacctacttaccgcctatgtttcttcatctgttaaataggttgttaagaacacaggtgacatgaaggcatgcatgctatgcatcaatgatggtgccctggtgatggccctactgtcatgaccactgtcatccccagtaaatattaaagatctttcaaaaataacccctgggctagaaatcaatttccagcaatcctttcaagcccaaagtaataccatatctaaatttctctgattctaagtttgttatctagagaattatgtggtacacattgtcagcaaacactgcaaatgattccttgtgtgtgaatgcactcgagcatatgccccaggcctcctgcagaaaatgaaaccaagtgtttcctgcatccctagagattaaagaaggcagaatagaagttctggtctcttttaaggctccatcatcagagtagacacgtggtgactcccaagacatttcagagtttggaaaaacaggctgaggggctgaagagatggctcagtggttaagcacgctgctcctgcagagggcctgggtttggttctcagaagtgttactgccaactggaagaacaattggtggagagaaatcccaaatagatgacacaaactttgataacaacaaccttcagaaacaccagagtccagacacaatgaagaatgcacacatgtgggcaaaactctcttacacaaaaaaataatttttaaaaaaattaaggacttcaagttgaaagggagtggtgccatcaagagcagtgatgttctagacaaacaaagactttctaaatttaaatatatgttattaaagaagaagaatattatggggtatatgtgtagtgcatatgaaaattttaacataaaattattggagtaaatggatctatggatcctgaggttttttgtaatttgcataaaacaacacaattataacttagtgaagtgtaagacatacatcgtagtctctatgtaatcaataaccagctcaaaaaagttggctaaaaggctaacacataaattaagaagtgattttaaaatatgctaaaataattttcaaagcaggtagaaaagaaggaccagaggaacaaacactagaggctaagaactcaggtgaatagtgaaccagctacctcagtagagcaagctacttactaggcaagggaagggaaaacaagacagcaaaacttcagtccaaaaggagattgtacaggtggagaaagaagagtctctgtaagatgtgtgacagaaatgttaaaaaggaagagagcgagagcgagagagcgagagagcgagagagagagagagagagagagagagagagagagaattaggaaaacaggaagaaggttgctggtggggctgtggagctctcagatggagatgagttccagatggagtaggggcagacatgtcataagcatcagctcatccaggagaagtgacaatcactggtttgtaggtactgagaaactatcttcaacatacacaaagcaaaaaacaacacaactcaaaaatcaggaaatggcacaatcctgttttaagatgttcacactgttattgatagaagggctaggtctcaaatcagtggtggcatctgcatttgcataaactcgccaatgtcttggccctgttggcatttagagagcatcttgctctgtggagctcttgtcaagagggtactgtgttacgtgaaataggtgagaaggacaaatgcaggggcctatgagctggctcgggaagcaggggtgcttgccgccaagtctgacaacctgagttagatctctggaatccacatggtagaagaaaacaactaactcttgacagctgacttctgacttccacatgcacactgtgacacacacgtgtgcacaaatacaattaggtaaatgtaaaatgaagaaaaaccattagtacatgttctcacttatataatatctgaaattgttgatctcacaaaagcagaagacagactagagaagactttggggaagggtgatggttaaggggcacagttgctcatgagtgataactccttgtgttctacagcgtagtaggctacacttggctgtatgttgcaaaagggctcctagagagggttctgaatggtcataacaaagaaaaagacggaatgttagagaaaataaatatgccaaatatcctcatgtgagcattaaacatttatatgaattgaaatattactctgcaccccaaaatacgagcaattactatgtatgaattaaaaacaaaaccatatgtttccagttaaaagataaattacacgtgagtccataaaataagtcccaataagttgaagaggtagtactggtgtattgaatttttgttgggtacagggcattaaaccagaagtcactgatggtgaggtttagaggcagacaggacttctaagtaatcctgagctaaagcagaagcagcaaggaaaacggacttttgatcagaatgatcgtgggaataaaacatcaagatgttgagctgtggtaaaaacagtgttaggaaggagattcataatttcatataccaaagaaggtaggtttcaaggcagtgcttcaatggccctctctaagactcggaacaaaaagaaggaagggagggagggaaggcgagaggaagtaaggaggaaggaaacactgagtagaagaaaaagaaataataagagtggaaccaaataacataaaaacagagaatacagaaaattaacaaacaaaagtgattacgtgagaagatggagtagccagattaacgtgcaaacaggtgtgtgatgttggctggccaaggactgacagataaccaacagaaaagagccaagagccagggacgacttcacacttacagggacatctgcgtttgtccaagaagtcaaaacgatttatggggaaggaaaagtcttctaaaaaaaaaaaatggcgctgccttcattgggtgtttatttgaagacaaacaagacacttatctttctctctctctctctctctcttcctcatttgcaaaaattaacttgaaatgaaccacagacccagggacaaaagccataacatatttagagaaaagcgtaagagaacattttcgtagtttggggtataagcaaatgttgggggagtcacaggaagagctaatcaccaaggatggccgagacatctgtctccaacaaagccgaaagcttctgctggtaagggatctcagcaagagagctggagagacgacgttcagcccttttaacagcactggctgcttcccacagaacccaggtttggttcccagagcccacatggcagcttacaacaatctgtcactccatttctagggcacccagtgccctcacctggctacctcaggttctaggcacaaacatgatatatgaacatacatacaggccaatactcacacactttaaaaataaataactacatcttaaaaagacatcagtaagcaaacaaacaagcaagccaccgattgggagaaaatattcacaaatctaaaaatgaacagatatgctgggtataccaagaactctttcaactcactaatgaaagataatcaattcaactaaaaatgggtgaaagaacctgatagggtagtgcacaattataaaccaagagagaagtgagttcaaggttggcttaagacatgtgagattatataaggaaaggacccagagagctgtggatacaattcagtggtaatagcacctgcccagactgtgcaaagccaagggttcaacttcagcctcatgcgaatatgtgagcaattaaataaataggtaaatagctggatgagagaatttgtataccacacacacacacacacacacacacacacacacacaaaaacaacaacaaaaagacatgcaaatgaccaccagggactgcaaagacactcaccagtactcaccaggaaataaaaattaaaaccacaaatgagataccacaatactcctaccaaaaattaacatcaccagcatgactaaatattagtaaggatgtggcaactgctaagacaatccataaaccctgccctgtgacccagagtggccctcctagggattttcccacatgaaatgaaaacatatgttcaccaaaagcctcacccacccgccacgccagctcaacaacaggacgggtcggagtattctttgacgcagcaataggaatgagttccctagcattccgctactgtaaccggtgccttagatgatcaacttataaagagagaaggatggttttgactcatggtttagtggttacagtcaggagtcaggcagattcattgcctttaggtctctggtgggaggggcagacgcagtgatgggcagcaggtggcacaaccaagtggccagaaaggaaaagatagaaagaggggtggactgaggtcacacttcgtccttcaagagcacaccttctgtgacactgagactaacaggaagcaaaactttgcccctggaagttgctaccatctcccaacagtaccacagtaggactcaacccctcatccccgaccgtagtgccccacccctgaccctcatcccttgaccctacacccccaccctctcacccctacacccctgcctaacctttgtggggatgcgattaagactgaaggatacaaggatgactgctcaatgggtttgggtcatcgttatgaacatgctaggagatttcagaagccagtgcccatgtacaagggttcaagtttcagcatagctttttcctgaccctgtcagtagctactgtggaagaatgactctgtcagggatggcagtcttttccattggtgtgtctttctctagctacttgaggccatgctcaaaggcttgtatcctctgctctctctctgagctatgtcaaactcaagacgcttttcacgatgttcttccaactccttgtgggaggaaacaaaccttcccagaaggcctgaaggggctcaggaaccccagggaagactccttccaaggtcctgtggttggcacacaggaagaggtttcatgaggggccatgcgggatcagcacaggcaggatgaggaatcccagtaggtgttctccacaaaacatcatctgctcatcccttgccttctttcatgacatcatctggaccagcttggatgaagcagcagagaagaggtggggtatgacaggctgagagtaggtttcctagtaacaccatgctctgttatataccaatatgacagaggcatacacactaaaatgtatagcagaacaggaccaacaaaggcacaagataacaaacaagctgaagaagcaagaggacttttgttcagatacttagcatacatgtaaaaaactaaggttgtttccaggcagactcgagaacctcacaggctccatcttgtctctgacctctaagccctgtcatatgctctgttcaagataaccaaaaaagagtctatttctccaaaacttttaggggaagcaaaagactttacagacggcatatggacaccaagggtaatgccacatgctccaaaggggtgggggagggacctctcactgaatatttttctccttttcaaatgtatttctcctctgagatcctttccacctttcctccggagtctccattcccattaagttctggctttctgttctgtgttctacagaacccttctctgtctacacacagcctgggtgtctagccctagcttctacttgaactgaagtatgtcactggaaacattggacctgtgaagcagggttggtggtcctacaagagtctcataaagtcctcactgaaacttcacctccatcatcttcactaccatcttcatcatcatcacagcggaatgccaccattacccgacctctcccattagcatcatcctcatcactgccaccagcaccgtaatcatcatcaccgccatcaacatccttaccaattccaccaccagcactatccatgttttggggggagggtgggtgggtggctcatcatatataagaaaaagtactcagaacttattattgcagtctcttgggagacagaagtagacctacttgcatttcatggaggaggacattagatatctgagaaatgctcctcctttggaggagttcagtacactgggattctctggcctcagccaggcccttgctacagctgccaggctgtcggtttctttccttggtgatggttgtcccagatcctcatcagactctaatccaaggccagatggcctttgtactttctaccaaacagtccatgggcctctgttgcaagcactcatcctgcttcaccctctcactatacagccaacctttcttgagcagcagctgttccaaggatgcttttgtacacaaccgtatcacttcactcaggccattcatcttactggtgaagtctgtccctgtggccttaaaaaccccataactctgattctgttcctttccacaactcctacccaggctgtgagatgtgcttgggtgtttccttgtgggaagagcaggctgcctgctaggcccatataatactggcaactcatagcgtctaggtttagagggactgtcactggaaatggctggagacgccactgagaaccgttcagagtgtacatcctgctaacttcataattaaaggacaagacatctgggaacccttcatgtggtgtaccaacatcaagaaaagcatcaagagtttgtagaagagaggcggactcactaaggctaccttgtcagggtttttgtaatgtggctttcctagcagacaaagcaaaggctgagactgttatgtgaggttttgggatgagcaagacggcaggcttactctaaagtgtgcaccaggcaaccgtagtacttggacttgactaactccgatgagctgtgctatccctgtgctagactagcatcacacattccaggctccacaaagcccacagagagtgttgctgaacagtgtcatcaggtgtgtgttctgcctccaaagcagaccagtagatctctttatctgattaattaaataatgatgctgtacacatctgtgcacacatttctgtgtggacgtgttttgaattctcttcggtatcccaacaggaagggaatactgggtgccatggcatggtgactcaaatgtgtaacacacagacacaatgtctaatgattttccaaagtaaactaatttgacattcctcctagcagtgtgctaagagatattatttctatacgtcttcaccgacacttgctattattgtctgtctttttattttaatcatccttgtgggcgtgaggcagcatttcgcttgtggttttgatgagcatttatctgatgagtaagaatgtggtattggctatttgaatatctgctgtagaggaacttctatctgggtgtctcattcatttttgaagtttcagagttattaagttgtaatactttttaaaaatattctagatagctggtctgtgagtatttttctatgtacagattacacagaattggtgcataattctttttattcctggattccacgattcctgcacctcccctttctcccctcccccaggataatacttgcctcctagaatgactaagaaagtgttcccacgtaagctacattttgaaagagtgtcttaagggtttgtgttaattattcttttaaaacctttgtataatttgccactgaaatcatctagtttggggtttttcctgtggtaatttttttttagggggaaaagaagggttaaggctgggtcttgtataacccaggctcacctcaagttcaccaggctgtggctgaccttgaactcctgatcctcctgcctcagccttcacattgctcagacctcaggtatagaattctgtgccctgcttggaattgttggttgataaaagttctaatttaatctcttcactttttgttgcacacccgtattttccggagttagttttgttagtctaagtctttctcgaaacaattccacttcctccatgctaccggcatgttagcggagacgaggttatagtatttcttcatggttatttctttttgaaagcctgagattgttcttgcttccatcgtttcagtaaagagattgctctttttctccctagttagtgcagccaagtaagctacattttgaaagctttgtgttcttgtctggctttcaggtttttttttcctatcctcttttattcgtttctactctgatctttatcatttttttcttctgcttgctttagttagatttttttctctttttcttttccagttccttaggatggaagatgaattattgatttttaagctccttttgttgttgttgttgttttaatgtccatgttcatgaacattgatatgcaagcaatgcttttgctatgtcttgtagttccgtcttgtggtcctttcatttatcataaaccatgctcaaactttcctgcatgatctctcagagtgcttttacatttcagttctgggaaagtctctgtttactttctatgtgatttcttcactcacaccactgtggctgatgacatcagtcctttcgatctctggggaccattttcatggcctcacatatgcctatcctggagcctcttgtgcaaagatgactttggtgtgcagtggaactttcttatgggtgtccgctaggtcatttggttgagagtgttgtctacacgttgtctaagtattccatttcaccaatgttctgcatgcaatctgttctgttgtcaaacattgggatgttacagggtccagttattgcttttggatgatgatttctgtttctggtgactttcaccttagtgttttggggctctgtgtgaggtgtacagtttcacagctggtttggcttcttcatggactgacccacggtgattctcgttctgaattgttctcttttttgtctctgataacacttttgtctaacagtagtgtagccaccttcctctttttgtttttgttttcatggtagacctgaaattttctactttactttcaacctaattgcaccctttgtggctgctatcatagttttcgtacattctttctttttaactcttttcattgaaaatttaagacatttaagtttactgtaactattcacagggtagaatttacatctgctattttgacatttctttttatacatcttaagctttttgtccttctattcccccttgttgcatgttttgtattaaatagtcatttttaatattccattttgaatgcttagcatatattgtgctaattttcaaattattatcttagcagtttccttgaagaatttcaattaatatctgtggcagttagtattagatgtcaactggccaaattaaaggatatctgcatatccggccaggcactattctgaatgtgtgtgagactgtccacagagaagactggcattgcatcagtgaactgtgtcaaagtcaccttcagttcgtgggaatgtacactatccaacactatccaactagcagaggaaccatatggaactgaaggtatctctctttctctgtcctctggaactcaggcctttggacgctgggacttgtactaggtgcctctcccacttcctggcacttagccttgggtgagtggtgtgccctcagcttccacatttctgaagccttcagatttggagttgtgcgttgccccaccacttctccaaacaagctgactgagagacttctcagcctctccaacctctcagcccagctcttctgataaagcccccactgaattcctacttgagtcaatttagaggccatctaataattagatggaggttttcttaaggttctagaacaaatgaactgctgagttgcttctgagatctggggcatgtgaggagctctggggtcttttttgagcatgcacactgctctgttgatacccagggcttttcttccttgtgctcacagatttctatattccccagacgatacatgccggagttctcagggcttcgtggcctttagatcctgcctgctagcctttagattaagcatatgcttagtttattattgctccaactgtcatcctctgcctccaccatctatgacgtccaacaattcccactgagtgtttttaacaaatgccctacaggaaacagcttttagccccgaggaaattttgttagattaaataaagacaggcttgcaagtggtgctttcggagagccgtcaggcctagtttctcctagggacttttgactttgcaaggctcagacagaaccagagagagagagagagagagagagagagagagagagagagagagagagagagagagagagagagagagagcaacaaagcaagttgtgtgctagaaagctcactacttttagtgaaatcctgtcattctatctaaattgttgctggctggctggaagcctttggccaatctctggagttctcgaaaggttgaaactagttgtcttagttatctttctcatcattttgtagaaaaaaggtttttcatgatctctaccacaccatttttgcaaatgccgctgagtttcctcctcttttccaacatgccatatataaaactaaaaggacaccaggaaggaacacatcaaaaccctctcaacaagatggtccctgcaaacaggtaggtttaactagccagtcaaatgccaccaccaccctgccccgccccgccttccttggccacttccaccatgcatttgctgtaacctcctacattcatgaccgctcaccaaaccctgcaagttgttagttatcaaatctaaacaagttgtaaattgctctaaggatctaatatgggggaattcagcagacactcaaaaagcttatgaatgggcgctctttagagggactggctcctggccctgagaagtcgtggaattttccgctgtagtgttgctgcctcaggagtggggatgggatacagcgggggcactgtgtgctgaggaggacttcgggttcacctttaactccctgctcacatgtcacaattactctgtttctttgatgcacacatgctttgccgatctacaaagcacggctccagggcagcctcagggctcatctcccactctcctcctgaaggtctccttcccgcccctgccatcggtcccttctttgagaaaaatctagcctgccagaagacttgcattgataaattattaactgattccgctgcacatcaactttaaccgattcatgtggtctctaactcctggaagtatttttatagaactaaatcaaagcttcgaaagtgaccaaggtgaccaggcctcttatcttatctccaaaggaagaaacatagcagttgtgtgccagatacttagagttaaagacacattttctgctggtgttgccttttgttttctgttttgtttgaggcatgtgtgtgcatgtgtctgtgtgtgctcctgtttgtgtgtgcatgtacatgtgtgtgtgtggtgcatttactttgttttatttttgagcctgtgtagctcagatgaccttaaacgtgctgcaaagcacaaattggccaaacactggccaacttcctgtcttagcctcccaagtgctaggctatcaggtgtgcattgcctatgcctagtcatactgacatttcaaatatagcattccaagcacatgtcggcttccgcataacacatctctctatctgtatcacaactgcatttatcctgcactgcattatcttgaaacaaatttcagtttttggatagttaaaataaaggactgtttcctaataactcagttaatgaataattggaacatcagaagttgtgcagaacagaagtctatatttgagaaacttgacctatttatacatctcgaaatattgtcacaattaaaaaaataaacaccaaaaaataaataaataaacaccaggctagatgtgaactctgggctggatgtgatggtgtgtgcttttaatctcagccttggctggtggatctctatgaattcaaggccagcctgggctacatagtaagttccaagatagccaaagctacatggtgagaccttgccacaaaaatcaagtaaaataaagtaaacgtaccaatcaccccaagttcccttgtgcctggttaccacagcctgttctctggctgtaagctaactatgcttttctgtaactaaagacagaacttgcatactccactttaactcatcgtaattatctctgaggtttagtcacgccaccctgctttccataatggcttctgtgtgaccaagtggcaatttgctaatccatccattggctgggttgcgttcgggtggttttgagctcttgatagtacaacctaagcaattgtgggcacttgagtacaattccgtgtaagatgtgatttcatttcattgacgggatggaaatagctaagcttagaagacaaaggcacttgctagatatcttttaagctcttaaaattcactctcatttatttagtgtgtgtacagggtgccacacatgcctttggaagggagggaataacttctcaggttgattctgtccttctactgtgtggggcctggagacagatctcaggttgacaggcctggtagcaggcacctccagctacggagccatctagctggctttaattttttaaaggtgacaaaatgctctttaaagtgatcacaccaatttccattcccagcagctgggaatgggaatccccgcagctaacagatttttgcagatctcctcattctcgtgcagtggagctgtgtcgtgattgttacagcagttgcctagtgactaacaacggtaggtcttcttccatatgctttttcgccggctcaagacactcttcagggagatgtctattctgtttgttttctttccattagttctgggtaccagcccttggttgtagacgatgctttgtaaatattttctctcatctctgaggctttcttttccattctcctaggcatcttttgttgtaatgaagcccaccagtccggggttatttccagcatggatgtgcatttttatatgtgtgcaggttcatgtgtgggtaggtgcatgtgtttgtgcagatgcatgtacatgtgcgtggtcatgcatgtagagggcagaggtcaaccgtgagtggtattcctcggtcatggtttaccttgatttttgggagagagtaggtcttattgggacctgggcttactgacggggagggtggccagccatcgagagccagggatccacctgtgccaggcttctgagtcgtgggattatcagcacatgcctccattcacagatttctttttttaaaacccaagtgcagggattgaactcatgttctcaggcttgcacagcaaacaggttaccaactgaaccatctccccacaccaagaggttttctttaaccatttaagtgttagctattaaaaaaaattaacaatgcagtgccaaactcaaggtcactaaaattttcttttatattttctctaggagtcttagattttggctcttttcatttatacccacgatctgttttgcattcatttttctcccatggtataaagtaaggactgagggcttgccagtttgttaactgaagctgtccagcttcctccagcatcagctgttgaagactattttctacaccagattttcttgaaaactttgtcaaaaagaaattgactgggggctagagagatggatcagtggttaagagcactaaatgcttttccagaggccctgagttcaattcccagaaaccacatggtggctcacaacaatctgtaatgggacccaatgccctcttctggtgtgtctgaggagagcaacagtttactcatataaataaaataaataaatacttgagagaaagaaagaaagaaagaaagaaagaaagaaagaaagaaagaaagaaagaaagaaagaaagaaagaaagaaagaaagtgaccatgaaaatgtagggctgtcaattttcagcctttcatttacacacacacacacacacacacacacacacacacacacacacacaattaaaggaaacaatagagctttttaattagctttagataagcaatgcaggccttaagaagttcccagccttcctccaaatctctctcccccatcctggggaccttgcccacttaggcagtgggaggattgagaccttcttcaccttgacaacaatgagaagccatcctgtgaatctggcttaaggaatgagtcagaaagggtggcttgagtcacctagcaggcccagttatgctaattccttggagagacctagagatattaaaaagggcactgagatgcatggagaagtttgaatctttgattccacacagagactataagagtggagtgggcagtgatttatgtgaaccaagtcacaattcaaacctgaaagatcccctttcatgcccatctctccattgaaaacataaccctgtatcatggcgggatggaggaggaggggatgtattcgatttgtgctgaggacaaattttgaaaggcttcttacagagtacaactgggaggccatgactgccttgtggggctggtaaccagtgggataaagggggtgctaaatccaaagagtcagcttcaggaagaccattggggaccattagcatgctgcagggtgaggaaagacacccaagaggtcagagaatggtccagtctgcaagggcttgggtcagggaggtcgtggtaagctcaatggaagccagcctcaatgtccagttggaaaatgtccacagagggaggatgctccaaagaagtcactagagcaatgattgaggttacagatgtctatgtttagctgacacttgggagactctggtatgtactctggtatttggcttatatactaatcaaggtctctagagaaacagaaccagtagaacacacgcacccgggggagggatctatcaatttatcagattggctcacacaattctgtgtgggtagtccaacaatggccaactgcgtgctagaatcccataacctcactgttcatgaagctgggtgccttaacagtcccaacatggcgctgaaggcttagaggattcctggagagctgtgggttttcagtccaaagaacctggactccggtgttccaatgtcagggatgggtggagcagaggggatgcatttgccagcagtgagataaggtaggcaggcagaagctttgagttcagacctctgggctgctgctggaaggaaggggctgtccagtgtgtatgtgtgtgtgtgtgttgaggagaagggaggtttttctccttctgttaatccttccaggaaatattcctgcaaacccacccataggcatgtctcttagttgatcccagatccaatcaagttgacaagcgaggccaacttacaaagcctaggtctctacagccctcattcatacatggggtggaaaaatgctggactggagtattcctcagccccactcttaccatcatgtagtcacttctgtgatcccagagtactcagtcaaactgagagaactgagtgtagccaagagtcctggtgccacatctcagctgtgactcaatcagatcagaagcagaaggcagtagtgtaaccctctaacacttggccatcatgcccagcttccttgtgtcttcccctgaaacaacagaattttcataatttaaggaggttaatttttctctcattttctattttacctcagatcactcaggatcaaattccatgggaagcagtagagactgaggtttccttatttacagcaaaaataattccctgaaaatgttcaccaaactcactttgcatggcagagcaggctttggccagcacttcttggctttaagggaccttcctgcacttcatgaactgccctctgcacgggtaattccagggattctgtttacagcctatgactctgtctccttgggaagatccacaaagtaacaagcttttgaaaggctccaaagctcaggagaagatactcaacatgacttgccattagggagaggcgagtaaggaacacagtgaggtccactgcacatacatacgactacgacagaaaagatgtacgataataataagagttgaaataaatgtagaggaattgttatctttgtccattattggaatgcaacaaagttcagttgccttgcttagaaatctaatggtctaagatcatagaaatcaaagattggaactgtagcattattacatgaccctgccattctccttctaggtatcagttgatccaaggccactgaaaatatacacgctactggaacttgtttatacttactgatgacaacattcttcacaaagctaccatgtggaagcaaccaaatgtcccttaaatatgcctgcaacagcacggatagacctcaaagacaccaggtgaaagcaatcagagcaaatggcctcatggacacgattgcccccacagctgggcacactcctttgcacatcatttgagaatggcttcacttttccatggattgtcctgttggtggatttatagacatgttggagaaggaaaatgattttgtttcactgaaaccccactcctcaccgtccaccaggccataatgacagcatacatattagatggcccataagacagcactcatattagatagcccataaacatccagttgaggttttatatctcaaatgagctaaaccattcagaaatgtaaaataataatgacagcccaccaaaaaaactgtcagtccaacccttgctagcttcatggtggctaggaaacaaagagagagacagtgaaggatcaggggcaagggttatctttccagaccacgcctactctgacatacttcctgagccccaccccagaccatttgcaccacctccaaataacaatatcttggagttatggatccgtcagtgggttacgtcatggattatatcaggagtttgtgatccagtgactttcaatgatagactccaccagcaggagaccatcccctcaacaggagcttctagctgtctacaccatgttcaagccataattcttctggtccaacttctgatcccagaccaagtgttggcatcaggacattccaaacctatgaggcaacagcacgacctgtgacctacagaccggttgccaagacaatgaccaccatattcccagcattcacttggctcacctcccacccttacttgtgttacatcattttccatataaataaggagaatgccccttcctcactctctctcttttttctcctttctcccccttttctctctttgcctcttctttgtctctcccttccaatacaacctcttccacctggaactgctttggtgctgttgtggcaccaccggccattctaacacatcaccaagtcctgcacattggaggcctctttcctaatagctaagtgctgaagtcacacccaagtttgttttgtttttgttgttgttgtggttgtttggttggttttgttttgttttgttggaattttgtttttgtttttttgtcatccaaacttttgaatatcctaaaggagggagatattgactttgagtgccactccctgcctacaatttctactcaggtatttgaaaaggtgaagacttccactcagatgagctctcctagtgcaaaacaacttccactgtggtaaatgccagcactttatcagcgctttatcatttgttctctccacctgacctccacttctcaaggcaaatcagactggtgcacagtacacgtgggacagcctcaatacatttttctttatttaaaaaaagaaaaacaaagttggttgaatttgcccaagcgggtggtatggcttccaggtataagtctctttctctgaagtaataaattgagcctgaagacacgaagaaggacaactggctcttggcaagacagcctgaagtacacgctgagcacagcccaactaggtggatgctgcgactggaccaccgacaacagaagctgctctccctggatagcacacaaacagggagaaaggtacctgaagggagggcgggtgctgagcatgggggtctcagagaggccagagggtagtatgcagcaggaagttcccaggaggaaaagcagcctcagggtaaagttaccagcctccgctgcaccctggaaaccggtctttctggcttttctagggtcagagggcaagcttcccagcaggctgtagactttctaggcttggctcctttccccctccttccccagggaagggcagggcaggaagtttgagatgactgagttcctgggtcacccagagaatcccctgaaatgaatcagatgagaggaaatggaaaccactgtatggtgctcacattctttcaggactgaaagtgctcgtatctcatacttgtatctaccgaatttacatgaaattaaaggccctggtgcagacgaagttcccaaaccttggaattgtctaattagacacaggaagcctccccacaagatggtatgagcaggaagaacttgctcagggcaaagccttctgtgcagccaatagggtggacatggaagtcccagggcagaggaagctgttattgcgaaaagacaggttatagagaagaaattacataaaaaacccagcggatcactgacaatggacactgagccagccacaggatgctaacagggattgttaacatttaatttttatttcttgttcacactgctatccaactgtttcttcttaggacagaacgtcttccttgagagtgaattttggtgcagataaagcagaaaggaagagttgggagggaagaacagagggggaggggaggacagaggggagggggtgtttcttctcaggctttaaacgctgttgttgcctgcaaagggtttgtcctaaatgacatcatccgagtgcctgctgtgtacctctgggacaaacagactagacaaaggaacctggtgagactggaatctctgggcctccagcaggctgacaaagagcaaagctgctgtcctcatggggtctagctgctctgcgacctggagtgctgggtgctccctacaagaaccagtggtgctggctggactttagggagatgtagggaggctaaaagggagccccaggttccctgatgtgagggtggggcaacaaatgaaggaactaggagactgcttaggaagcccggccaagaggtccagacagccctggctggtcatcacaaatagggtcccggatagacagagtcttctctgtggtcttcctggtctatgtaactgctgccacagaccagggtggaggccactttgtccaactccctgtattgtggaggtcccttcaagagtcacagccagcagtgaaatatccttggagaggcaagaatgaaactctcttcagcacagcttccttagccaggctggttcaaacttcccgagtctgaccctgcgctgttttgttttgtttttttttgttttttacagatttaaacacagtaaaactttggaagaaagtttcctcctgacaattatcacaataaagcttaaggcatggctacactgaaaactctgtcacctatgaactcttcctcaagagtgggctctgttgactgtgaaacaatgctcggataaggcctaggcaggaagggtttgcaataagtctaaggatgggctctgctgacagagaagcaacacttgcattaaagccttggaataagcataacttcttctgcacagtacatggggcctctttcatggggatggcttctatcgaccgagaaacaacagtcaggagtctaggggattcaggtgaggctccccagagcagaaaagatcatcaggttattaaataacatccactcgagccttccggtgaacaggtgtcaatttctttcactgaagacaatttggtttctctagtgttatttgtaagacttggacccgtgtccttctgcactgtgttccatttcacagagaccttgaagccacccataagaatgctcactgcaggggctgcgagacagttgagtggatcacgtgtttgctgttggaggcatgaggtccggggttgggattcccagaacccacacaaatgtcatggtgacctgtaactaactcctgcattcagaaggcaaagacagggatccctggagtaagccagctagctagacaaacctctatctgggagctctgggctcacatgaaagacccctccttaatgaataaggtggggaatgaggaagacccctgatgtcaacctcgatcttccaatgcacccatgcacacacatatactcaagtgccttagtcagggtttcattgatgtgaagacatcctgaccttggcaactcttataggggacagcatttaattgaggctggcttacaggttctgagtttcagtccattattatcaaggcaggaggatggcagtatctaggcagtcatggaactggaagagctgagagttctacatcttgttccaaaggcaaacaagaagaagactgactcctcaggcagctaggaggaaggtctcaaagcctactaccatggtgatacacttcatccaacaaggccatacctcctaatagtaccactccctgggccaaacatccatcacatcaaacatttatagcacatacacatgtacacacacaggtacacacaaacacacttctcatttttcatctcaagacccctagtgaggttccaagggcaggagagaaggcctctagctgtctctggaggagaaatctgtagactgcgtggtctggaggcccattgcatatcctcccctggcttgtgctgggtcctggaatcccaccaggaacagagtctagcccctgtgggcatccaggagagtgacagttagaaccagcaccgtggagtaagcacaaggctggaggaagctatggatcatggcagccttaacgtgacgtcggcatgctagtgtttccaagttgactcggtgaaggccatttctttacaaatccctcctattttgccggttgaaccttgaacctgccctttttagcattaattgtcaagttgacatagcagcctgagatcatcttggaggaaagcctccactgaggaactggccgaatcacatgggtctgtgggtgtaagtatgggagctcgttttcactgtgaggtgatggaggaggggccagctcacagtgagtggtattcatggtgactgaggacaatataagaaggctacctaaagaggagctcctgacaacaagtggcattcctccatggtttttgcttcaagttcctgtcctgacttccctcatggatgacccagaagtagttctatccttccttaagcttctctgtcagagcactgtaacagagctgaaactgggacagaccccatgatgttcacatttttgaggaagaaacttctgttaaccctcagggtgtgtctctggcacctaacagaacaaatgccaacccagttttcactctgtctgtctacataggttcaaacacagtacagcttcactaaaactcacactgcagtgcaaatcctctgtttgtagtcttgggggacaagtgtttgtgggcggcaccttctgaaagcagtgcggattctctcatgggagtgaacgcttgtcatcacaggactggggtagttagtgcaggagggggctgtcattagatgaggttgcccctttgtgtcctcttgtgcctgtgcctgcttacccttctgagtcctcccatgagttgaaactgcacaaaaaccacaagggaagtcagacagattctggtgtcatgcatctggacttcccagacttcagaacagtgagtccaaataacaatgcatttctttacaaatcacccactctcgggtggtcggttctaggcacagaatgcagacttatgcatctgacatttattccgtgaggagttcagattgcgcactcccttctctttcctcagacacaataaggaaaacacgagaaaatgcagtctgtcgtgtagaccagtcttttcttgctcccacccatcacccctcctctgaacaggtaaaggcacttctgtgattccggaggtatagagggactttgaagtcaggtagccgctgtccaacagcagcaccacgggaaaggcttctgaccccttgaagcctcagttcctttgtgtataaaactgaacctagaagttacttacatagggcagcactgggctaagactaccactcaaaatacagattctgtagtatgaaaattattatgtacacttacatgagaactgttttgtttctcatcttaaatccatacaacttattattattattattattggtttgtattattgcttttccatttttattgttattttattgtacttagttttattttaatttgtgctatgcctggacatctacctgaaatttaagtgacccatgaatgtcaaggtttgacatagactagtgaatagaatgggctcagtcaatggcagtcatgatagtttctagaaattcctcaagaaattatccagaagacttcagggagagttggggacattcacactctagttgaaagcacttttctgggcatacgacacggataagacaggcaagacgtaaataggaccagtttttgtattctcaaaagaaaatgagtaaccattaatcctaagtctatgggtcctatgcacaagggacattcaggatgacgtagagaacatgaagaggcctctgtaaaagaacgctaaaggctgagtgaccaatgaggagccaggagtaccaagcagatatttcaaacatcaggctaagagagaatatatgtgagagcactttgtaactcttctgacctggcgacagatgggaatggctacttctatatcctggctaccacagtaacagaagagactatgtattgtagtcctgaggcagtgacccccagtgaaacgtatttttaaaaaaaaaatacatagtgggggtctcttgttacattcttccaccccgactataaaactgtaagatataatgagaatattctcccctctggatactctggctccaggccggactcttctccgatctgtgttctcttggtggccctggtggagggatgaggaatctgcccttccaagcctggctcagcaggctggatcttgggtgaggactgaacagccaggccagacagcaggccgcctagctgccccgactctctgctggcagacctggccttggcctgctgtctgctttccagctctgattcttctgctcgctggccactggccacagtgttgctctgcactccgttatctggaactgtcagatcctttggctcagcctgtgccatcccatggggctgtgtttgcaggctcggcccctcatggctcgggaagcgcgccagagcagaagggttcaatacccacaatactctttgtgtggggcatgaggggccattggaggctctgttggcactgacaaatagtactcactctgtgggaagccttgagtactcagaatccattagtaagcagaaaattgagcttacaagccagtgtgccaataacttcataatatatagactcattattcatatgtatattatctgtatacagccagcccccagtaaccaaggatcctacaaccccagactaaacgaatcacgaacaaaaaatatttgttgtaactgcatttgtatttaacaacgacagatatttttcctaaatgatacaactactaacacaacatctaagttaactgaggactgtttaaattttataggatggtatatgcaggtccattgcaaatactgaatcagtttatatgaggggcttgagcacttataagatttgggcatctgagaggttagacgctccaggaagcagtcccctatagatgccaagggcaacctcacaaacacatatgcacatatatgatactatgtataactgcatatacatatgcatgatcttcttcatggatgcgtatacatgtataaatggatggatgactgaaatatacacaactcaggcataagcaatggtgtagatatagacacactggagagttactgggcagcacaccactatgagttgcaatagttagattttagctggatttaattttctccttttattttgctctagtttttaattttctggaaataatacacatgatgcaatcataataaaggaagtggggctgaggctatggcttcattagtcgtgtttctgctcagcatgcacagagcctatgctttgctccctagcacggcataaactgggctttgctatgtatgtctgtcatccccacccttgggaggtgcgaataggaggggcccaccatgaaaagagcaggcagagcctgacgtctgcttttgtagatatttttttctgcttgtatttatttgtatatgtgcacatatatacaaatgcacgtggaagacagtccagcctcgggagttacatctcaagaaccaagcctctgggtttgcttgtttgtttgtttttttaaaaatcttgagagagatcatttagttggcatgggccttgctgattctgatagacagactggccagcaagtgaagttccaggaattctcctgtctccaccttcttggtgctgggattatgagcgaagaaaggcagcacactgggatttccttacatgggacctggggcctgagccttttactaattgagcttgtctctggctcccttcaccatgtatttaactcatgttttatctacacactagaaccctgggaggctcctctgacctgagaatctgcaaaatatgggagacatccatcctcctgccccactcgggtctgcacaactcctctacagtgacctctgcctgttcagatggagaaggagcctttctttctgctcctttccccttcctccatctcccatctccttttcctctctgtccctcccgtcttcctttctttctgtcagtctctgatattcagggccttcctgggcagtgctagtctataccaaatactgtactcccaagaggtaagcaggcaagaacctgccacactactgggtatatgaatgtcctgagcctagctgtgtccaccagtccatcccagtctggctctgcagtagctcagtatgcaggcctgggttgctcctagagtgctgtcttctctgcctggaatggcagaagagccggtctccatcttctgctgagtccgaggcaccagctaggagtcccatctgtgggtcccttcactgggaccctcagccaggacacagtgactaggctgtgctcttgtcccataggaaacacaggaggcactgaagggtaagcaacagtccattcctctagtcctggctcgtcctacctagaccctagcagagcagggtgtagaacaggtctgtcttgctgaaatgacacagaatcctctgcttggagccacactggtaggtacggaggctttggagtttcccaatgaggcaccctgcatatctcagctcaggtaccaggaggcaaagctgtcagcacatgagaacagaggacagtagaatcccacatctgtgctctctctgaacctcccgttagggcgggaaagagtggcagcaactgtctcaagggatgagattaatgaacaaatgtgtgaagtgctccgagtagacaaggacaacagctgttaattggagtagcgctaactgcagtggcctggggccaatcccttcacctctggaagcctctatttcctcatctgcaagagaagaaaataaaaataggctctctacaggattaagtgggtggagaggaaaatccttgtattctgtaagcaattgtatctagagttgtaaccaatggaatttcctgtctaaagtagctccagttaggtagttactatctttcaaagctgaatacattagccatcagcatccatccacttaaatgcacacatgcacacatacacatgcacacaatacaaatgcacacacacacgtacacacatacacacacatgcacgcacacacatacatacacacacatgcacacacatgtacacacacatgcacacacacatgcacacacatacacatgcacacatacacacacacatacatacacacacacatgcacagacatatgcacacacacacccctgtaaatggaaacatctgaaccatcatgtttcagcatccacttttcctcagctctcctggattggtcttcatgagctaggaagtccattgtggccagtagagaatatagagtaaggcatttgggaccagactgtgggcacagcctgcaaggtgcttttgtgtgaatagagaagagaaccctttccctgtgtcacaccttggaaaatgggattgcgttaatgttgattgtcaacttgacaagatttacaatcactgagaagacacacctctgtgtctgagaatcacctaggagacacacctctggatgtgccagagagtagaacccgtgatcagagaagtttaactggggaagaagaccactttcaaagtggacagctctcttccatgaactggggtcctagagtgaacaaaaagtagtaagagaagaaaccaaaaccagcagagccctagcatccactcttcccagttcccactgcagatacaatgtgtccagtgtcttcacactcctgtcaccatgcattccttaccatgacggactgtaccccccagaccataagctaaaataaactcttcccactgtaaatcgctttttgccatagcaactagaaaagtaatcaatactggtagaaactagatctcaactcttgcttaccctttcctgcacaacacgaccctgttcataaggcctgaatataggctgcgatcttgcatgccttctgggcagcctgaggtatcagtggggtgagccaagttgctcaagtgtgaggcagaaggaagggtggggactacagttgatggtgcaacagccaggcttggagtctgaggagaagctgtgaccagcttggaagcaataccagatgctggtgactttatagtcaactggagaaatctacagagctgacttacgtgggtctctcaggtctctgaccatgggttcacctctcatgactattcccaacctcaaccagctagccccttcccggcccctttactgtgcctcctgcttcttccagatgctaccaacttcatccaacagctaacccttcagaactttgcatgaagagttgaggactaactcagatgatagagcttgcctaatatgtgtgaggccttagatcccacccccagccctgcaaaaacaattaaaaaaaaaaaaggaaacaaacttggagtatcacttcctcttttgaattcccacaaatatcccggctgctgtttcccagaatccctgctatcatgaggaagagttaaccccaggaatttctggcacggggtggttgttaccacctcaggcacacttccttttccatctggttagtttaattgtcatttgacacaatctagaatcacctgagaagagagcctcagtggggtattacccacatcaggttggtcttttggacatatctgaggaggattgtcttgagttaattgatattggaagaactaacccactgtgggcagcaccattccttaggcatggggtcctaaactgtatgagtggagaaactgacctaagcttggccatcgtacatactgtatgctcttggctatggaagtactatgactagccattggaggttcctgcctttgacatccccacaatggtggacctaacctggagttgtgaatttagacgagcccctttctcctctaagttgcttttgtcagggtattttagcacagcagcagaaatggtgtcaccaacaaattcacaccttcctagtcctttgtggcattgtttagcctgtacatctccagtggccaccataattttaattatcagtttgtggcttcccagtgtttttcttcctttctatctttgaagtactcagactcagagagagagagagagagagagagagagagagagagagagagagagagagaagccttgtcagtttctgtcacttttgggcacagaagtccccatttcaagaaaaggttttaccaaaagcaacttggctcttgtccaagacaacaccctacaagacttaacaccagtcctcagcactgaaaccgaggagggcggacaaagccagtctcgtagaggtgcctggctgagtgctcccactgggaggatttccacgcatgctctgacacctgtctttccgggttttgcccctcacttcttcactcttgttttctttgtcccatggtcagctggagatctatgactttgtcactcagttcctgatgggtctgtacagggcaggactgttatagctattctgtagacacttcacattctggcatgttaaagggtgttactaaattatatacttaaaaaaaaaagttctttgatgtgataagtttcaaatgcattaaaccaaagttctccggggttctctgctacaggacttcttagagccttgactgtgctgtggctttctaagaaaggggcgggccacacacacttgtcagctcctggcagatgtggtatgctgcatcagcctttaggtgctgaggggtgcaccctgggagatgcaccaacggatgctgcacagtgtgctattgccccttggtgctgggcctttcccactctcccctccagcctggttgccttccctggaattgtgttcccatcttggcttgcttgatacaactcgggtcactgacttccagagtattctaagaggctcaggagagggttgtgtcctgagatcatttctgttgctggcagctgttcagatggagaagtaggaagactgttggtgaggctggtgtggctgaccacacgtgtgctcttttgtttgctgtgttctggcatggtcaggggacctagggaacctaagaatctgtttgctccgggtttacgccaaaggacttttagagcaaagcaagatacaactccacagtggctcctagaagtctacatgggtggatgttaggatgccagcccgtgatgttaactgctgatttctttggttctgagatgtcatcaattgtaagacacaccgttgttctagcagcaatttgtcggagaacaacaaaaaagaaagacagaaagagaaagaaagaaactaggcagagtataggacacatcctgattttagaataattcaaatgtgaacaattgtgtgccccggtctcagaaatagactgtttctacaggttggggctggcttcttctacattactataaaggaagctgagaaacagactctgggcaagaaggtggaagactggggtgctgggaaggtgtttgctctcaaaaattagttattggcctatcacatagtcaaggcttatgtagttagcagggactgtggtagatattccatgcctcctccctctttatagaaggaatgtctgaatatatgtggcaaatagttctttcccattggtccaaagcttcagtctcactctacccgctgaaagtcaccgataattcataaaaatgaaatcagaaacttagtatgagtattttaaaataatgaatggggatgtcccttctatggctccacatcataagtggtctcatccaaggaatcctgactcttgtaccatgcccggaattctgtcacactcaaagatagtgggcaggcccttgatgttggatggcagggtttttctagattagagccttccatctcagagagaagcttgttaagatacagaaagttaggaggaaggtgagacaacaggatttgtgggggtgtcaaaggacctctccacaggttgcctaagtccaccagaaaacagatatttacataatgattcataacagtagcaaaattacagttatgaagtagcaacaaaaccaattttatggttggaggtcaccacaacctgaggaattgtattaaagggtcacagcattaggaaggttgagaaccacagttctaaggagaagagaagcttttcatcctgcagggaagctcctggagctcaaaaaggaaacaactcaaagccttcaggaacttcctgaaactaacttaaatatactaggctcgttctgtcccaaacttacattgttggcatttcatctaggctccacagttacctgataacagccaggtgtgcctgactcacttgaaaaggggttccttgcccccttctcactctcttgtactcatctcctcttgctcttgccccttaccctcttctctctctttccccattcccctctctctccacgtgctcatggccagcttctttctctctttctttctttctttctctctctctctctctttctttctttcttccttccttcctttctttctttctttctttctttctttctttctttctttctttctttctcttccttccttccttccttccttccttccttcctttctttctttctttctttctttctttctttctttcttcttcttcttcttcttcttcttcttcttcttcttcttcttcttcttcttcttcttcttcttcttctccttcttcttcttcttctcctcctcctcctcctcctcctcctcctcctcctcctcttcttcctcctcctcctccttctctctctctctcgctctctctccccccactctctttgcctttctctgtctccactccctcaacttccctccctatgccctcaataaactctattctatactatattcatgtggctggtacctcagagcgaagggatggctcagcatgggcctgcacccccttcccctacaccatattgtgtctccactgaacatatccctggctcttttcttatctttatataaaacacaacatatataatctgaaagagagtgaatcctcaacaagacaagatgctgaatgaggctaagagtgagcaagtggcctggaaaggacactccaacttattgagctgctacaggctctgtggtgtgctccaggtccccaactttggtgcactgtcattcattctcaggtgagcttgggtgatgcagctatctctgggtgattattgctctgtcatcagttccctatcgggcatgagtggacatttgttcacacctctccaggaatagtttcatacaacagttgaattggtatcccaatcctgaaaaaaacaaacaaaaaaaaaaaaaacaaaactgcaatggagaaatgtcaaaggttacaaaaaggcctgggtagcctcagtgaattctgggaggtgggtgtatttccatctctatgctgtgtgagcttgatcagagaaaacggatgcagtggagactttaggacagaaccagagctggagacaactaaggaccaatgagtagaagcctgctcctgactgtatgggtgaagaatgggatgctgagaagtgaggaggaagtggaaaatccaagctctcctgttagtctgtgttgtctttttgctgtgagatttttggaccttattttcagcaaattgaccaaagactcttgagtagtgccatgagctgtctacaagagttcaggttgtaacacaaatactcatgggtgtgccatggagcacactctcaaaggaccgagcttccctggggcttggaaagagatgctcgtccattcagtcttcaggtgagactgtccaatttggcgtgtttattggccccatcctcattcagctcacatctgggcagtggtattggtgagactttataggcgcaggttctgctattactagtagtaacaatctcccagcaaactccctgatcctctgcttcttccaatctttctaatccctctttcacaatgttccccgagccttgggtgttgggagtgttttgtagatgaattcattcggactaggctacacaagtctgcattttgattggttgtggttttctgtagtgattgcctgatgtacagggaggttttcttgatgaggggtgaggactacatttctaactacttagtactagtgaagttgttggaggaggatctacaactctataatctccaacaatttgtaaacatctgtcctgatgcccacagagaagcaaggtcattatgttttatcacagcaataggaaaaagaactagtgggatcacagagatgtacttccatgacttgtacaacctctctttcccttcctctctccctcccttcttccctccctcctttccttcttttttcatccccctccccccattattcctttctatttcagtgtgtcctctagggaggccatcagagaagaaggggtgagcgggttgtgataggagtgaggcagaactagccaggaaccagcaaggcctctgtggacagcaccaggtcatggcacctgctggtgcagactgtagatgaaaaccctctacgaggatgtgtaaaggacgggggggggggtgtgtgccccatttctctggccaaaaacaacttgagagaggaaagggcttattctgcttacacttctaggacatagtctatcactgacagaagtcggggtggaacgcaaaggcaggaatctaaagcaaaaaccatggtagaacactcaaaggctcatgcttcgctaagctttcatatgctacctatggtacggtttcacccatagtgggctgtgtccttctatgccaattggtaatcaagataacctccaaactggatacacgcctttaatcccagcactcgggaggcagaggcaggcgaatttctgagtttgaggctagcctggtctacagacttgagttccaggacagccagggctacacagagaaaccctgtcttgaaaaaaaaagccccaaaaaaccccaaaacaaacaaataaacaaaaagataatccccaaagggtgtgcccaaaggccaatcaattacccaggggcgatttctcagtggaagtttttctttcaggtaaccctggacttcaataagtgacaattcaggctaattaggggagggagtcatgaaaattttaggtacagtaaaaggtttctgaatgcagaaagagaaaattgagccgaaataaattatgtgatgcgtttgaagtgattctgaccctgcttgcctggcttgtaaaatccctgctgcagcctgttctgacgacagattcagtcagtttgctctgcacttgccatcccaccacaggacaacagcaaagatgtctaaacacccacggctcctcaaatgtgagggtatcggacggttcggacttcagtgcttttaactgtgtgtacagagctttttgatttcgtaggaacagagtactgtaatggaggaaaataaaaacatttgatatttttccactgtccactccccagaatgtgtcaattagcaaagctgatttattcttttagaacattggatttaaaaaacttgtcatttgagttgctgacttgaatttagcaaagaattactagattgactttgtcttgcgattagcacagaatcttcaataattctgaggtgaaactagatgtcctctgtcatctcattttatacatttgtgtaaagccctgttctctgcactgacagtcacaaagtcatgctacaggtgctccacacccattcaggcaagattccgttctttatgcaaagctaacaggcacatccgtctcattaatatgcaaagttgctttgatctttagtaaatggtaatttactaaattaccaataattacatgcatattatatgttttagaataaggggttttgtaatttgttgacagcaaatgtttgatttgtgccccccccccccctttttttttaaatgtgtagcccaggctgaccttgagtttgcgatcctcctgcctctgcctcttcagggtatctacttgtgtcactatcacaactggtttatgtacccattttatagagagatcccagatcattaactaactaactaactaactaactaaataaataaataaatagaaatttcccaggcaggaaggagtccttttgggtgatctctggagctctcacagaggctgggagatgcgaatgctctgagccttgctgtgaggattgctgtttgggaactaaaagcaaaggaaaaacagcttttcagtatagattcaaaggtgtttgtttgtttattttttgttttttgttttgttttgtttttgagacagaattttgcactgtagctcaagctgaaatttacaaatagaagggctaaccgtctgacaggcaacggcctacgtagcagacaagaccagagagggcagttttgtgagtctctggatgttacaatgcaatatagagaacatattacaagcaacacaaacaccagtgtggtcaggttttgtgcaaacacagaggtcttggaggtgttataaacgaatggatgaatgaaggtttaaatagtcacataaaggtgtgcccgtgtgtacatatgtagaaagggaaagagctggggggaggggcagaaaacagagcgagtgtcctggaataccgagaaaactgcaaacaagttctcagagcaaaaagcaaattgtggattctctgaccacagttgaataagacttggctcagctatgaaaatgatggccagataaaaccaaaatgtgatatatggtgtccctggctaaatataagggttttgtttgtttgtttttgtttttgtttttggcaaccaaagactgaattcagtgacatcagcgaaagagaagagccacctccttagagtctgtccttaaaaaacttatcagggctagagagatgacttgattggtaaagtacttaccacaaagcatgagcagctgagtgtggattcagagaatccgtgtcaaagctgagcgtgacatcacacacctgtcagcccagggccggggaggggaggtagacacaggaggatccttggggcttatccgccaaccagtcagactggcaagtgagctctaggttccgtgaggggtttatctgtcagaacctcatggacagttagttggcttccatcatgtggggagcagaccaagcctttaggcaacaacaataccattgcttcagcctttgtcattcctgggatctttgttcggttacacccggattcatggcgattaagaaatttctcagaattgacgcagatagaagtgagagtaaggtgcaggctctgggtccaaacacctgctgggctgttctcttcatcttcatctgacgcccacattttaatggcaatgactggactgtcacagagatcaggaaggggttgcctgtcatgctgtccttccttgcatccttctctgggtgcggctgtatacctgctttatgtggacttaaaatttacaacccagacagagccttgttctgtgtactccctcaatataataaagcaaaaacaaacaaacacacacagcactcactagctttgggggagtgtctgcttcctcagcagagggtaggtcccctaagggaccaatgggcatgtcgctaggagaggaaacacaactggatgtgtctgtttacacaaccaacaaacacagctaacagaatttaaggctttgtctgagtactttaaaactttcccattgaaagaatgaagacaaggacagaaaccaacacccctgaccccctgtgatgcttagagacacttgcggtgggactgatggattcctacagtcccaagcgttaccccagggacttagagccaatgtggacttttcagtccatttcctcctccaacctctgtcctttgctcacttcctcatcccgactgggatgcccatgggtacttcgtgccgtcaaaccctttcacagaagcagagcacagctaaagctgtgcgggtgacagcaggagatggcaaatcattcattagcttgaggatactggtctcctccacctttggcttcctacctctcagccctgtgagcagcaccatgtctttggggacagtcacatggtaccagatgaggttaaagacaaggtttctgagtaatgcaaaggctgacagagtcttggcagaaggctctacaatacccctccgtgttttcaggattgggtcatgagggttgactgccatgtgatactcaatcttttcctctagatatgtctttttggagggttccatggtttcatttgtgtgtgtgagtaaggagcaagctcatacataagtatgtggtacctgcagaagtcagatgatgctattagaaaccatagtgctggagttacaggcaactgtgtgcttccttaccgttgtgagatgctgctgggaactctcctctgcaagaacagcaagtgctcttaacctccagcattagttcaactcttctttagagaaaacacagtcaaaagttgtctaaacacagattctgagaaatgtgtcaccaaatgtttacaactttgtctgcattgcacaaacatcctagagtgcacttatccactaacacggccaagaagtcacaaaggggtataagcttatgggacaaccttcatacgcacaatcccacattctgctgtaatgtccttatgccatgtatgactaccctgccaccttatgcggtaatcccatgccccacccccaccccaaatcttgtgtggcacttccacactgaccatggtgcgctgtacatagcacaaagatctttgccctttttctcaacaagggaccatcatctctggctgtccacagcgcttggtacccaatctccaccacccgatatattacacagggctaatttctttagtcacactatgtagtatgcaaatgtgtacccaatcctccctctgcctcatggccctgccacttgtgatccttacactcccacaggaccatactctcatcatccgcacacatcttcacaaggacagctcatttgaggctccatctcacattaacatgtgtttggaaagatgtggacaggaaaaaagggcatggggaatacagagtatctcacccctacggttttgtattgatcacagttctccagaatttatggaatgaatgaatatctctccctctccccctccctctcctcctctccctctctgtctctctctcctcccccctcctctctctcatatggcagaaccatgaaggagtaggttccaatgccagcaaaggaatagatctgctagcaaagtgagggcaagcaggcagagaacaaaagtttccttctatgtccttacacaggcttccagcagaaggtgtgtcccagattagaggtgtgtcttcctgcctcaaaggtccagactggaagtggattcacccacttcaaaccaagtagaaaatctttcataggtgtgcccacacgccctctgtttctggattgtagttcattccagatatagtcaagttgacggctatacgaccaccacaagtctcgtcagatcttaatatttacccatacttgatccaggacttacaagagtaataaccactatataaaacattatagacatagctcaaggctttcctgaacccaattctcatcttcatttctcaagaaaggcatgagcttgaatttagtgtgtgtgaatatcaaacatgtttttgacagttgtcctaaggtgcatacccatgagtgaaacataagattgctttgtgatttgaagttttagggaagtctgttctgctatacaggtccttctaaaatttgttgctcatggttgtgtttatatttacccatatggatacatgttgctctagcacttatattttaccaactatatactattctgtcaccaaaagtttcaggattaagttagccatttcatgttagtttcttttattatttttgtttttcaagacaagttttttttctgtgtagccttgactgtcctggaacttgctctggcctcgaactcacaagagatctgactgtctctgtctcctgagtgctggaactcaaggtatgtgccacccccatctggctcatgctggtttctttaagcctgctttcttccttcactttttgctactttagacaatgatgccttaaatatttgtgtatatgtgtgtcaatttctcaagtctgaagctctgttctcccaagggaaggctgacttctcataccccagcagtgtttgccatttgtagcaactcctgatattagtagaccgatacttcaaccaatctgatgtagaaattttgtggggttaatgttacagatcatctctgagctatttctatgggggtgcatctaggtgttagtgaaggctctgacagaatgagaggctaggttcctcaggcaagctgctttggggactttatctacagcactagattttcagcttttccttgggtctccattctgctgttctttcaacttggactccagtagtttccatactggcacgaacaagttccttaaagtacatctctatacaggtatatatcctattaccctagtttccctggaggacctcaactaatacagatgttatcttactctgttttttgttgctataacaaagtactagagactgaataatttatgaaggtgagacgtctattcagattgagattctagaggctgggaagcatggtgctggcacctagtgaggaccttgtactgcatcctaacgtgatggaagatactgtacagcaagatgaagaaaaccaggctcctcctcctccctgcctcctcctctttctcttcttctaaaccccctgtcatcatgagctcctgcccccatgacgttgtctaaccccattgcttctgaaagacttcctctccactgctgcccacatacaacatgggacattctctttctgagcgctgggcagggttcctctgctgcttctcctcgatttgtggctctcaggtgccacttgcttctttatttttcttcaccaagccatttattgttccctcactgattgacagatggtcttctattctggatcctgacctcctgtccatctctgattgcattgtaattatccttttatggcttgatgtttgatatgttcataaataagtcttttaaaatgttttctgccagtggtgctggtggcacatgccttgaatcccagtatacccaggaggcagaggcaggtggatctctgtgagttcaaggccagtctggtctacagagtgagttccaggacagtcaaggctacacagagaaaccctgtcttgaaaaacaaaacaaacaaaagtttcctatagatttaattattattctaagtgatctattaattttttgcatctagtttaggaaaaatagtttcttactctaagttcagaaagataccttctgaattcgatcctgtgttatttagatttgttgctttttatgcttacatattccttcaccttctgtgttcttgcttgtctaaaggtatagagatctaaccattcttatgcatatgatctgttgtcacatgactggacagtgaattatctagaataacccccattaatcctgggcggagctacttggttttccactggcctggcttcctgctcctatcacgttggattccctgtgtgcagggtgtgtgtgtgtgtgtgtgtgtgtgtgtgtggccatttctgagtttctttgatggctttgacatgtctggcatttcggtatcaatgccctgttctctttaatcaagttttataattagtgttgatgattttcctcttattaagttttacacacatacaaaaaaacaccccttaagttgtgggtgtgtataaattgaattcagggtctctttagatggcaagtgatgtctttatccagttgaatccagtttccagtgacaaccaggatcaagctgccctagtcactcactgctccccacccctccccgccttttagagctttctcaaaaagaaaatgaaattaacagtgaaaacccaaacaacctgcatatgtttgctaagtagaagcagaaatgttttacagctggtatagatgagatttttattactaataaaaatttgaactgctacatgacaatttttaagtaatataggtctctctctatctctctcatctgcagccttctttctattggatgtattttgccgactttgtttgtttttgaacagtttttgtggagtagcattagcacattccctgccaagaaggccaactctgcttctttgtgagtttcttctccatgtcttttgtctccttgttctgggtatggcttcctggaaactgaggaataaaaatattggcaatggcctccttgcctcctgctggtgttgatcggtgtgattccggaacttcaccaccaattatagtgctgacattttttgataagtatcttttatcacactaaagacatttcctataattcctactttgaacactcagctcgcttactttcagcctttcataatcttatgatacaatcctcactggccacatggctgagtctggagactcatctgcctcagacccccagttccagtacatttcagctttaattccctgttcagcttctgagtaattatgaagtgaccatgaggttgtcaaacatgtgaatttgggatgcttttccagttgatgatggttcctttaataggcttagattaactgcatcgccatgtgatattggtgatgtataaatgtttgtaaagtccctggtcacctatggtttggttaagtttttatttgtttgtttttgtttttttgtttttcgagacagggtttctctgtgtagccctggctgccctggaactcactctgtagctcaggctggcctcgaaatcagaaatcctcctgcctctgcctcccgagtgctgggattaaaggcatgcaccaccatgcccagctgatttgcttaagttttaagttctctgtgcctcttcaaagaaaacaaggactatctttagttgctaagcttttcacacgtacatatacacatataatatttaatatatacatacaaccacatatgcacaaacatgcacacacatgcatatagacatgaaaatatacactcaaagcacatacaggtataagtatatatgcaaacatacatatatatgcacacaaatgcacatatacaagcacatatataaatgtatgcttatatatacacaaacatgcatacacacaaacatgcatacacaaatagtgcaatacatatacatatttacatgagtacacacagataatatacatatacatacttacccacatactcatgtagatacatgcacatacattaagtaatatttgctgattttgtttcccaaatctttcatgtaccaatagtgcttttcatgtcttaaagatgatttctttttttaaagatttatttatttattatatgtaagtacactgtagctgtcttcagacacagcagaagagggcgtcagatctcattacagatggttgtgagccaccatgtggttgctgggacctgaactcaggacctctggagaagcaatcagtgctcttaaactcttagccatctctcccgctctaatgatgatttcttaacttttggtaaagttagaggagacaagattcatacctgtgatttcgtgcattggttttctgtacatttgttagccagctttggaaccctaaggacttggtcactacttttggcatctgccatgtacaactcccagactttctgtggtcatttgttataagtgttatcgtcaccttcaattgtcattcattctgtcttacagtagctgagtcatggccatctacacctgctgcagctgatgacagatttcagagcataattagtttgtgagtatgtgtcttgtgtcttgctactaagttatttttcctgctttcccaaccctgctgcaatacccgcagtggggagaagtcacaggaagcatcatgtgccctggtctaaaatcagcagagggccatgccctgcacaccagggaggccactctctcaaggcaaccaggaccactgagaacagctacatacccttgatgaataaagatgctaactcaaggctcatgagtccatttgcccctggacattctgtgcctgtccctggagtcacatggagttgagctgaggccctggtggaagaaactcttcctgcagttgggagatcatgagtgactcaaccccagagccgcatgatatcagatgcagtcagatcacctacagaatatctgaaagcctcttgcattttggggccacgatgctcccttttaccaacaattaggtgacaccaattagtagctgtccctaggttagatctataactcattttaccacctgtcttcaccaggccagtgtaggccagacaagcccagcccaagatgcaaaatttaaaaggacacattctttttcaggtgtcagctctgccctttcagggacctgagaagagtgtcttcttaaacaaggcatcctagacaccaggttgtctttttccacagtcctggctctgatcaccaccattcctcatcagagaagtcatgcaccaaggggcacctcttgtcttctctgttgctatactgttatcaaagtaacctccctggtttgtttatgtccatcaaaagggactaaatacaatatagattggggtgttggggtgaggtattgggtttcatcggcctaatttacctattttgtttttcatgggttcgagatgcagctgtttttaacacactttcagtgagtgccaagggcaaaccttctggcaggaggagctttgctctgacaaggggaactctggtctcagcagagaaggagggagggaggctgcaagattgtttctgaggtgaggccagctgagttgctcatagggttggatggggctagactcaaacattacaagagggttctaacaagacttcctggtgtgtggtggagcctttaacaaggtgaagaagccataggaagttggccatttgctttgtgttaagggaccttgaagcagggacatctgggcacagtgcagttacaggggtcagggttgggagtgcaagcccgcctccccaggggcttccaattcccctccacactcacccccagccctcctccttgttatcagtctgagggacgctgttgtttcagggaagagataatagttaatcacagattggaactgcacggaaaataagaaaatatcgatgacttcattcacctgagtacccgcctggggggaagtgttcagcctttgcagtggtcagaccagttcaaccagttcttgtttttaaatacaggcctggacttaaacaaaggccgagactcatgaatagggggcattcattagcagttctgagtcaccctgcagacctactgcgcaccctcatttgtctagacagagggctgcagcttttctctgtttaattcctacagctgtcttttcactggacacccccaaggccctccctctctcattacaacccttatctggtcacacatcaccctagagactcccaaacagaaagccagaccaggcgcacacaccagttgccaaacactggtgctagtgttcagggttgggcaagttctcaattctggccatctgagatgaacaccagagagctgagtccttgggttagaattctagttgagtttgagttaaaagccgaatgggtttttttttttttttatggttggtacagaagtgttaggcaaataccatgtggcacctggggacatagatggaagccatcaggcctcccaggcaaggacaccaaaacctgcccttctggaagaatctcttcacacactgcagctgtgagcttatgtgtgctgcagcaggactagatggcctggtagctaagggaaaccacctaagatattgggggttgagaaactgagctgtacacaaagactaaaggtgattaaagccaggaaatgaaagaggcacacaagacacacgaggtttgtggagtgcttgcttgcctggcattcagggagcattggattcaattgcagcacaccatcaaatgtgtggtggcacacacgtgttgttacaagactcacaagttcttggtggcagaggctacttaggaatttcaaggccaacctgggctacatggtgttccgtctcacagaaaaaaagaaacagagagactaagtgtgtcagtttacttttttaaaacagaaacaaaataaccacaaattacaaatgaaggagactcttgcttggtggcagcactggagaggtcaaagtccttgtttgtctctccatcaatcagaatgttctctttagttagttagttagttagatgccaatatgtccctgttcccgccagaaccttctatgtactttcatcttcttggaccgttcatccttggaccccatctcctaacctactccgacatcttgacattcatcctttcaaccatgcccatctggcataatggtgtaactcacgtccatggcttgcttctgaggatgccctagcagtagagatgagcctgcaagagtgggagatccagaggcttcagaggataagaagctttggtggtgggttttgatggtgtcaatattgctagcaagtggctctcaggactattagaaccagaaataagactctccaaggatacaggacagagacaagccagagaaggcaggggaagggacctcaggagagccaaggaggaagatgctctctgcaatgaagagtcaagagacagggccaagataaaaggttccaccaaaacggtgcctccttcctagtccacatcaggctgttgtatttgggagaacagatgaggaacttgcatacagacaccacacattaactggtactatggtgcccaggaggccaacagtgtccaggagaccaggggagaggtgtagccacagggggaggtggagccagggggaagtgaagccagggggtggagccaggggagatggaccctgtggggacgcagagccaggggtctttccagcctgctctcaggctaggaagtcatattagccccataggccaacaatgtccaggagaccaacttgctctagttaggaagagtgggaggaagctaatgtcttcacatttctacatcttttggacttttgaaggcttgtgctggattccgaaggtgattcttaattttgtctcttttcaaataaataatagactttactccaagtggctgttaaaagccaatgacatagtggcctcttatagaagggttctgccaactacaagtgtgatctggagtttgcttgcatgtcccacaaaccatgagaattctgggacatttcccccatgattcctatgtcttagttgaactttgtcataaaatatctccacaaacggtgcatgctctgtcctaaaacatacgcatgtttcttgggatgagtgctggggttcagcaaggtgtaacctcagaaggtgggctggagggaggtggagccaggggagaggtagggagggttaggagccacgtgggtgtggggaggtccggcaagggggctttacagcttcctctcatgctacaaagcttgttggctgctccagcaggatttaacacagcacaacagcagagatattcgcatgctctaccgattattacaaaaaataacagggcttgtcacaggtgtgggctggaggcgtgcggtcttctgagaagcagtgaatttcagagagtcctggctccatcattgactctcagctactgttcccaacccataagcattactgagctagggctaggctctgggtgtccatcatggaagtgccatagctattttgattctcagtggtgaaagagcctactcttccagaaggtgggtctagttctaatggaatcacactggaaagtgtaagttcatgggaggctacagcagacctaagtggcctgatagctaagagaagccacctaagattcctggtgcggttgcagtgcacagcaagggctcaatcagagcccccttcccagaaagccctggacatcttaaggaaccatggtggggagggatggaagtttgctttcagttggaagtgaatctggaccacggggctgtaccatatagcatctcctttccaggtacaccatggtttgccagtgtccttcctttgactgatacagcccccctccctccccagctgtactctcaggcaccttgagggtagagctagttagcctttgtcttgggaagccagcacagagcccagtgcttggaagggatgctgtgtaaaatatatgttgtgtaaaggagtaaaaagataggtgagtgaggaaagagagaaggaagggaggaagaaagtcagaagaaaggaaagaagctgccagaaaagataataaaaaatgttagtgatgctttctctgtctacaaactagagacccttatttgattctaaacccttctacatagaatttacctctaatcatttaaatgtgcagtagtgtgaggaataaaatgaccctcaccctctgagatcaagggctatgtagcccagggacagatacatcagagtccacagttctggagatgtccaagtccctccaggccctggagcccctgtatgtcacttcaactcaaatggagagtcgcttccactgctcatgtgtcatccctgtccatcccctactgagtcccacggggctaggcagggtcctgcacaactgcacagggtctgtgccacccacattctccctgccctgactcattgtcacccactgtcccctcttctgtcgatagttctgtgactacccaatttcatacaaaatggcttctttgttggagacccagtgcctggatgttggcaaatgagtgtatcattttgctcaaatttaattttaaggtaactttatttttatatagttaacccaagcagaagcattcactggaaagcactcgtagatgaagcaagagcccctcactctccatgctccttttctgtgaatcgtctggccagctacttcatccatttttctcttcaattgttactcttgaactttttttttcctcgttgattactaggtattcctgaccaagtctggataacaacctagaatttttgttttgttttgagacaagcttttgctttccagccagacttctctctaactggtgaacctcctgccttagactcccaaaggctagattacagatgtgtctaacaagaaagagtctatgcatatgtgctgatgagatggctcagtggttaagagcacttgttgctcttctagaagacccagattcaattcccagcacccacatggcagctcacatctaatttcaactccagtttcaggggatctgacacactcattcagacatacattcaggcaaaacactactgcacataaaattaaaagtaaataaagtattaaaaaaagaatctgtgcatgtatgcagatattatgcgtaaatatggctatgactctataagcatgtatatgtatgtatatgtatgtatgtatatatatatatgtatatatatatcacactgacacatatgcatatatatgcatagacaatatgttacaagtgttctctgccacctgtcttggtctcagtttgtagcgatttctggttttaaatcagaagttccacatgttgatgaaagcagacttacgactcttcccccaaccctcctctgggatttgcctctcagggtcctttttgctcccacttcaaggttgtaaacttattcttccatttacgttcagtttttattttatttatttatctatttatttatgtattaagacaacgtttcatgtagtctaagcagacttcaaacttactgtcacagtataactgagaatgagcttagactcttgatcctctatcctctgcccaagaacagggcttacaagtgtggggcatcacacccagtctacaaagtactggagagtcaacccaggactttgtacatgctagacaaggggtttaccaactgagctatgtgttagtgtcccatataccctatctaatctgttgatgatcccacctctgtcctgtgacctggttccaatgggttccttttcaggggaatttgaggtggttatttttccttttcatcaattcttgggaacgtttttatttaccaatgtctgctccctgattgcccaggtgaggtgtagagggccccaggggtcaaagagccctttgagccaagtctggcattatttcttctccgtatttgctaactagtgcacgaattctgcagagacaaacatcagaaagacccttctgaggtttgctctgctccctgcaaagccagggtcctcggtctgccctgctctcctggaacttctgagagtagctggtatcggtgtgacctttccctgaccacgctatccaaacagaagcatgcaatggaagaaaaagaaggggagggaaaactccctttctactatgcaaatatactatggaaaacaaacatgacctcacatgggttcagcaccttaaaattttttgttttattttttagttaggtatacatgcatgtgtctgtgagtatgtatcagatcacatggagctggggtttcaagagcggtgacccttctcaaatggaacccaggtcctctgtgatagcataaatactcttcacagctgaactgcctctctggcctcagagttagaagctcagagttcactcttcccttctcagctggctccctcgggtcacacagcattcacaagagtgcaatatcctaggtgtcatggacatgggacactgagatatcacagagaacacgggacctggtgtaaactccttgatgtcttcttcccgattaaaaacaaacagattaaaaacaaacaaacaaacaacccccaaaatctgtctggccacaaaaaacaaaatttcccagttgctttagaaaaacatataaaatataaaacccactcactggctctggggcgctagctctgctttaaacctacaaagcagaaatgaaaaagttccgtgtatcccaccagggatcttgtagtgttacaggaggtattggggccttgactggtataaacaagccttttctaccacgtgattttgctataacattatggtaccagaggcacaaataaacctttctttataaaatgtttgcctcgggacttttgtcatagtgatagaacgctaatagtacagtgtcttagtctatgctctgcttctataactgaattatcactgggtagggaatttatctcacctgtaaggacctgtcagtaccatcatgatagcaatcaaatgtcatcttgggtacaagaggagacatttaaaccacagcagaaagagcccatctacacccctgtgttcagaaattcagacaggctaatgaggagagctcttcagatagaaagatccagaatcattggtgtgactcctgtgtgggagcccctctcctttcaccccaccttggtgtcttatgttctctccaacacccaaggtagcctgatcctggaacctttagttgtcatagcctgtagagagttgccctgactgaagagtgtttgttgttgttttggttttggtgttttgttttgtttgtattttatttctgagagatttttgaaaataaggccaagaaaatggaaaggagaagttcctcagatctacagtgattgccaggttcctttgagggctttagtgtcaatagggcactgaggttatcaagagaagtctgccaggtcggatccatggagccaacagaaggtgagtaccgtgtggcaggaggcttctgtaaatcccactggggttggagcaccagtttcccatctcagcccccactggctgacactggattttaacatcaccttcctctgctacctcaatacagctctctgtctcatgccagggcagagactttcctaactcctccgtcccagcttggctcattccattgtccttcctgcatgtgccaccacgcacagagtctagagtaaccctgacaaggtggctgctgggcacaggcaaggtggcatagattctgggttgaaccctacctgccaggctgagcaagttaactcttcttgaagtggcttcatctgcaaactaggttaacaatggtgtctcaaaagctatgctgactgcagggagtaaaatttcttgaactaaacatattgcctagggctggagagatgactccatggctaaaaatacgcattgttcttagaagcaggggatctgggtttagttccgggcacaccacatggcaacaaccagccatctttgatccccccttctggcctccatgggcatcaggtatatacatagtacacttccactcatgtaggcaagacacctgtgcacaaaataaatacatctttaaaagatatttactacaagccttatgtgtgtggtacctgtaatcatagcactcaagaggctgagacaggaggatggtgagtttgaggtcagcctggcctacatagtgagatattatcttttaaaaatgtgggtgatggaagagccctaggaattgtaaatacggtattaaaacaactttgtcccttttgcataagttcaagtttatctagccagaaaagcaagcaaacaaggcgtttccccaaggccagcttccaggtaagcaaacatcaagggacaccttaataaatgaagctttctgtgcgagcatttcctgtgattgcattctgatattgtacacatttcctgtccttagtcggagtgctccggagcaaaggggaagtgctgcctttgggagccagagtcatttacaaggcagttaacacccttttgcctggagctcatcgttatgcaaatgagcaccacccacctggccttggaagttaaagcctgcccagcagagattctttttgtgccgattttcttggatacgctctttacttcttttttccttccttccttccttccttccttccttccttccttccttccttccttccttccttccttcttcccttcctcccttcctcccttccttccttccttccttccttccttccttccttccttccttccttccttcctccctccctccctccctccctccctctctccctcttttcctttcttccttctctcccttttccctcttttcttctccatccttcctcctttttccctctctcctatctctttgtctctgtcctctctctcttctgctgatagctctccctacctctaggtttcctaccataccttgcagctccttaatagcccttagtaggaaagagacttgagtatgcagctcagaggccacgcacaaatgaactttgtactacattactgtcactgagcagacacgctgtggctgtgtatctctacacagacccagaatggttcccacttagtggctgccacgtctatttccttagggagttgagttactggtacacccactttatcggaaggatccagtaatgaaagtgacaggtggtctttcatatgtggactgtgttacaattgtcgaagtggcagccatgctgcttgtggtacaaagcctggcctgcttggtttgaatcttggctttcttatccacagtcctgcagtttctgttctctttaaatacccgcacagaggcttctagctgaatcctgctcaggcttagctcagagcctggcaccagcgaaagggcagccagggcacaggtacctggcctgatggcatctgtctcacacaaatgcaagtgatcctcaacccactatgagatgagataaagcgattttaaggtacaaatattattagtaaacaatgccatttaatatctctaacctagggaagctcctggcgaaacaacccgacctgaatgtggtatagcttcaacggtttcccctcgctacccgtgtccactgccccgacctgcaaaagcatactatatggcacatcattaaacaaggggcaagatcaagattaaagcaaaataaaactggcaaaacaaaagccttgtccacttcactctcccagtgccgagaccccgtccacctgaacctgttcaagtctcgtgcacgccaccacagtccctgtgaaccctgagactctctcacttccattgtctatgtgaagacctgaccccttggactcagtcaccacctccagctcttagagtctcttgaccttttcttctccataaatccttgtcttgaggagagggatttgatgaagacatctgacttcgaattgagtgctccaaagtctctccctctctgcatctttcccgcttgtgggtctctttggtaattcctatgtactacagtaagaagcgtccctgctgaggctgagtgaggaccgatctatgggtatagcagtgtgtcactaggtcactaggtcactaggagtcttttttgtttttttggctttttggttttttttttttttttgttttgtttttttttttgtttttttttgagacagggtttctctgtgtagccctggctattctggaattcactctgtagaccaggctggcccagaactcagaaatcacacctgcctctgcctcccacatgctgggattaaaggcatgcgccaccactgcctggctactaggagtcattttattactatgttcttttagcagaagtaggtttggaggagttgggggagggaaacacgatcaaaacctattgtgtgggaaaaaaaattaataaaaagtgaaaatgaccacagaagggtatatgggagggtttagagggaggaaagaggagggaaaaatgatgtaattatatgataatcttaaataattaaggaaataatgaagatatgtaacaaagaaaagaaactcaagctcttcagttgaaacatcaggcattggtgacacatctgcacaggccaaaatgggtcttggaaaacattgcaggatcagagcccccttaaacttgaaaaagagtgttgctataaaactgaagtgaaaatggcttgagcatagcctcctcagcagaggttccttacagaggatgcaggggtggcagtgggtgggagggcagtggggtatctaagcactgatcatcagagaaacatgaaccatcagctgtcacttcctgggtcctcatggctatatggagacccttgggggagctgtctggaggttgttgtcagggcttacacttgaccatgttttcccatcatgctccaggagtccagacttcagtctccagagtgtgtcctgctgcagagaagatgtaaaaggaagatgtccttcctttacagggtgtaaaggaaggacgtgggttgtaactaggagtccactgtcagcaaacagtgacatgacgtaagggtgtgttgatctgtttcccagaacaacccttgtccaaaatgagatgcaacgttgtaccacaacaccatgactggggagggagctgaaccctgtgaaagaactacggggccgttaccatggctcagtcagcgaaggtgcttgctgcaaaactaacaacaacctgtgtttgatcctgggaacctacaaggtggaaggagagaaccaactcctgaaacatgtcttcactcagcccacctcaaaaaaatgttcaaaagaaaaatcagtggtgctgctgcagtttgaacgtagtgcctgttgtgtttgtcctcctagattcccctccccccagcacacacagaatctaacccccagtgtgatggagacagggccaatgggaggagaataggttttgagggctgaaccatggataagatggatgatgtcatggaggtgaccccagacagctgttatgtcccttacactttattaagaacctaaaattctaaccctgtatttatgggggctgggaggatggctgcgtgggtagagagcttgcttactttgaaagcatgaggacctgagttcaatctccagaacccacaaaggctgggcatggtagcacacgcctgccaaccctgcacagggaaaggagagagagagagagagagagagagagagagagagaggggatccccgggatgggctggccagcctgtctagactaattggtaagctccaggccaagaagagctatctcaaagaaggtggacaacattctgatgataacatctgaggttgtcctctggcctaatatacacaagcacacatgtccaaatataaccactcacgcatgcacatgcttgagcatgcacacacacctgtatgtaacaaaagacagctccgggttgagtgtggcttccctaagcttctagcctgtgatttctggaaatgtctagaataattttgctgcaaacagaatattgctgatgtcaggtgctctggcaaggctctgtgctcccataccaccctgcccagcctgtgggtggagttggctaccacaggacctagcatttcataaccacctccagctgtaagttagttagtacatcctagcaagggacttagtactcactgtgggttgtttttttttttttttcctgatgaaagctaaacaaacacagacttcctctcaacatcgcatgggttggcaagaagcggtacgaaggtgaaacactgcagaaaagcattgggtagacagtgaagacatagcttcctagggtggtgcagaggaggaaggaaggagacgatggaggtgggtgacttcatcttcaacaattcatcccaatccactctctccaatcatcttcatcatacccaacatcggtctccaacatgccagtggtcccaaattcccaacaatccccaggaaaggtggtggagcctcaaggaagtgacttcagttgagccaagggagcaattgatcaagagtcccaggaacctatctctctcaaaggcatatgcaattccctatttgttagattcttcactatggggagtacccaatataaacaattaaagggagggaaggttgattctggctcatggtttcagtccattgtcctctgctctggtgactctgggcccacagtgaggcagagtgtgacacccggaaggcatgacaggaagcaacaatgccatcctatggtgaatccacgaatgggtaagcccactgattgtaccaaatcccccaggaagctcatcagctgtcagtcaagctctgaataaagctggcaggggtggagggggagcattcctagtcaaaccataacacctcctatatctaacggttcaacccttcattcatttggtggaggttcggggagaagtcagcctctgaagccacacaggctgcagtcatgggttcaggaagcctgaaaacgctggccccaaaatgctaggacttgataaatagctaacagtgtacctagtttttatggccacttccaacttgggaacagcagaagaaatgtgccccttaccagttgcacaggatccttgcttcctgttagctggccccagctatccctgccaacagctcccagtcagggaagccctgggctgtgtgtgtttcccaccaacagctttcctgatacacgttttcctgtctctgagtcctgccaaacccaaggaacagcagccaattgcctttctgctgtagcaaacttcaagtgaatatccttcacttttcttttctttctttctttttttttttttttttgttttttgtttttggtctttgtcttttgtttactttcacagttctcatacactcacagacaaggtgactgggagccctgggcagacaacaatggccagtgtggttgattaaaagtcgcctttactccatgcatgagcgctccagaacagtattggagaagaacatgactcctaagtgatggctcagcctcactctgcctcagaagaaaggtaaaaggcccaaggcatgtctgaaatcattatgttttgacttaaaaaaaaaaaaaaacttcattagcctgggggacaatgggactattgtctggtgatagacaaaagaaagttctggaaacttggacaagaagcagctgagccacctgaatgcctgggcacagattttctacaggctgatgcccagcagaagaagagggcagagccaaaagccatcagtgggtggcagaggccagctgggcaccaagttgccaatccaccctcttgccagagagacacagacgtttgtagcaggctaggtccccaccatgggccaaatctgtgatttgcggcgataattcagattcagctctccttcgtccccgggccaaccttaaactcagctaagagatgtgctttgagtctgggacaccctcctttctactataaaatcaaagcagtgtcacacacagaagcttaaaacccattatacctatattttgcctggagacgctattagaaatcaaaggaatggaactctgatacttattaaaacgagcaattagggtagttctgaatttgttcctggctccctctcacgttagtttctgatattaaaaaaaaaaaaaaaaaaaaaaaaacttgaagggaagaattcgggtctctctccagacaggactccacaaagtcagcctcctcagagcttggcaaacacagggagaaggtgagggagacgcgcctagcgagcctccctcccaggcctggcgcacacccagggacgaggaaaagaggtgctaaattatctttgttctgctttaagaatgcctgccaattacttgaactaaggtcccgattctgctcctgttaattaggctgacatcgcagaatttactagaagaaaagcagtctggaaatcggctctcttgtcttgatggcttctgtgccggcacgtgaccagcagttaccatggtgactatcagtcgctagtggattgtccacaagttgaacttgcatctgacaagtcaaatttgtcagtttggggaaaagtggaaaaggtttaggttgttatgttatgttttgttttgttttgttttgtttctgtctcagaaccactgttccctttttagctaggcaggctttctccatgtcacggtcctaaggtgctcttatcctcttgggtggtctgtggcatttttgagaccaccgatagcctcccatcagaatttgagaataaaataatacaggctgtgattgaaccatcgacttaataatggggtgtgcaccacagacttcgcctctctgggcttttcctctaaagaagacttcatttctttctttgtcgtggactgtactcatgatcgtgggggtgtggatagtcttccaggctgcactttgtaccttagcaggtaatgatgctcatggctaggtttatcaggtttaagataaaagttttaaaaaaaaagcatttaataaagactactccgtcaagccacatgctgcaggcagctggagctgggagtccctgaaagggacaagaaggccgagcaccagccctggtgaaggccatcatcatggctatgatgacagagtggggatggaagagccagctgagccccaacacaacagctaacctcttctttggctaaggtcctaactagagtcaaggttatcagcaagtgtttcaccttagcaagatgtctttcagctgaaggaggtctgagcccccggctcggctccgtgtgcaggcaggcacagctattcttagcacagatgtcttttctcttagaaagagttactatgaatcttaagtgcccccaaaggtaggtggggtgggacccctctctcggactcaggtcagaagccttgacttgtccccaccctaatgacataagctagaactggcctgcctctctccactgaaatcaggatgtaagctctgttgaattagtagcataagaaccaggttttagactccaatttcatgtctgtctcaagaggacaactgtatgggagcaccggctgcctgctcagagcctgccattgatgcagcgtctcctgccctcccaccagccagcttagacacaatttttacaaaggtggcactgagatccaaaagcacaagacaggttcccctcacatgtgcagagtagctgaggtctgagccagccttagggcctaagaacacacatgttcgggagaggtacctggtgtccagtacaacgcctctggccatccccagacagtcaggcattctgtgatcatgtgcacatgtcaacacacagatgcacaagtatacatatagctaaaaatattttataaatgaatagatattttaaaattcattgttggttcaccttactgataaagaatctgtagctatgggaggttaattctatttatgaatacatttatataaaactgtatacacttgcatggctatataaacttacataatataaatacaatgcacacaactgaacttacaggtctaaaatgtaaatgagattttagcatgctctaaatgtaaatgagattattagtacatatatccagaatgcacacttacagctatgttggtcacacagtcaatttctcttaaaggatgctcttggtctgttcttttctcccctgccctcctctttttcctcctccccaatatacccagtatctagtctccttcttgccgtaggatgtagaatccaatagagcaagcatctgtcaagagaaaatttccagtgtattgtggggaaagggaggcacatggtccaacaagaatggtggaaatggtggacatgaatgggggggaatgttctagaaggcaacttaaaggatgcccatgcaactaggggtatgagtctcccttggcctagccttatatgaaataaagataccctgcccccagtgtctgtcatcgaggcccaccttttctcactgagtattttacaacattgacattggtgtggccttgggagattggggcagagtcatttctctcaagactcctagggaaaagatggagactcaagccccaaactgtacaaggtcatactcaccctggcaacctagaaaaggaatggtgtggagaggagggggagaaggaggtgatggggaggggaaggacaccaggacagttttaggacaggcatcctgggtggagtctccagaactccaaatcacaagacctcatagtagaacagtgacttccaggctctggggaagggggaatggattatttggataaggcaaagtgctcagaccagaggatctgacatgctcatacagacattcatgcaggttaagtaccactattcataagaataaattaatctttaagtgcactgggtcttgtgaggggctatgtagttgtggggaattgaacctgggttccctggaagagcagctagtgttcttaactgctgagctatctttccagccccgtgccagtgcatttaaaaccagagcataaaaaacactctttaggatgatcaagagtccctgacacatgggccaatgagcttcaggctgcctgtggacagtagagttctgtgacctcgtgagttcagttctctgagtgtaaggagagccagaatgaatcagatatggtgaacacatatccgaagactgctggttatcactaaggtattccctgaggtgaccatcagctggtgggagaaagatcacacttgtcctttgagagggaacagatagaggaagatcctaaggcaagatggcacttgagatgtctactgtaaaatgtgccccaccacacccatctcctcctacccaaccctggtccacgctgccatctttggtctccagaaactctggtaactcttcctggcctgacagagagccctctgcctccacttgctgcctcagttggcattcgtggcaccagaaaggaaacttagaagaaattaagcacaaataccatgggacccatgttatactgttcatctctgtgctgttgacagtggttgacgtgaaagcagcatcatcgtccacagacctgggcaagggacaatagggtgagagcatacaagagtattgcccagcaatgtaaaggaggaggattctaccacagccaacttggataggcccagaggagtcagagctgaggaaaatcagtctcaggacggataccacatggtacagcttagataaagagtatgacgtcgactcttggacagtagaaaaatggttgccagggacgctggagtggcacctagaggtgctaatgaagaggcattgtgtttccttacaagttcaaggagtggctgagctctggagatctcagcacaacactgcctacgtgggtgaggatagagcttatatttgatgctttttaccacagtggaataaaatgctttaaaagcatttagtgcaaagaaataaacttttatccagaaaagacaatagggagttggggtgaggaacctttcctctttgagacacggggaggtgaagtgggaggacggatggagtggcagctgccggcatgggtgggaaggcagccggggaacatcctgagctggtttcctggtgaggttaatgcaggcttgcttttgtgcttgtttttgtttttgtttgttttcttcacttttcttttggcttgcaggatgtaatcccatcacaaaccgaggaccgtgtgtgtgtgtgtgtgtgtgtgtgtgtgtgtgtgtgtatgtgtttgacagagagagagagagagagagagagagagagagagagagagagagagagagagagagatttagatttagagagagagataaggatttggcttctgtgacactggaggttgacagggccccaggacagagcccagagcctttggagtcccaggagagctgcagatagaagctccagggcaggccagaaggtccagagccaagcagagcctgtgctgtctcagttcgagtctgaaggcaggaaaagggcagcatcctagctagaaggtcgtttacaggaggaaccccctgtggatcctggcctgccttcttttgccaggctgtcagggtgtagcccacccatccacttggggaaggggaaatgtgctttatctagaatagtctcttcagtacagtgttctccaaatgtctaacagccagtctagttgaacgtaaaacctaaccacctcagctttatcagctgcattctgctctataggaataggtcctagaggcggagccagctgttgtctgcttgggttgggtcttcagtctctttcgcagggctctgaccatcacaagaccctccccctgttttatgctcacccttgaatcttgatctggtgcaacccttttcccttaatgagtttgggacgagttttattgtccatcccaccactgggttcccatgagtctggctgccctccctcaagccctctgtccttgcaagagtctccctggatcccttccatattttgctaggctgggtcattgctagagaacaggccttatacaatcatatctgcctggtgcttattacaataaccaatctgaaaaccggggcttaatgcacgcacgtgagtacacacatgcctatatgctcatctgtgttcagagacacctttcaatgtagtggtctatgtataagagcaaagctaggatacctctcagaccctccagggccagttgacaatacttcaacagagttaaatgtcctatgtgttacagtctgcagaaagtgccagccattgggtacatggtttcaataacaattctagtcaccaaggcctctcctctgtccactgacttgagtgcttgcagcctagctaccttctggctggggaataggccttgagccacctgtctggatgcgctttcctatctctagaatagaagggcacatatagggggaaagcaaggccaagctggtgctgccaaggaagctacagatgtgcacagtaggatggcctaacggagagggagggagggggaggggagagggagagggagagagaggggagtgggagaggatgcatttattctatttggaaggatagagccaagaagcagttcaggactatgatggccaagctcaggctttgaagtgggccatcccctgggctcctgcatctagaggattgaatggtctgtgtcaaagggcacaggtggcctcttaaagaaacccaaccccagcagcagcagctgctcagtgagaatgcctgatggagctagagtctagattctcagccaagcagccatccctgtcttcaactcaacaggtagggagggcggaggctggggaaagctgcctggtgacagtggccccaggcgataggacttgaggaatggacggaaggacaagcagtaggagtttgggcaagggctctcccagagaacaggccttatacaatcgtatctgcctggtgcttattacaataaccaatctaaaaaccggggcttaattcaggaatgtgagtccctctccctccccctccctctcccatccccctccctccctctccgttaggccattctaccgtgcacatctgtagcttccttggcagcaccagcttggccttgctttccccctttatgtgcccttctattctagagatagcaaagcatctccagacaggtggttcaaggcctagtgggaggacaaaggagagctactcacacgctcagagaacaacgtgatacggaaggctgtacaaaagatacgtaagcaggtgaataaaccacagcaggacagacccttgcatgtcctggtagctagagagatgtaacgtcttcattcatgagaatggtgccttgttcatctacaaccatactcacacgttgtcttctttcctccctccttccctcatcaccgcccttccccccctttcatgtgtctttataagtttacttcgtattcaggatttttgaacacgacaggcttgttttgagcgagcagcaaacacaagtccagctgtgagagggaagggcaatatggccccctcagccagagccccaggaaaagctacaatgacacagcccatcagaggctggccccagcctcccgctgatgacctcattactccacatctgggaatggcgccaagaggcagcccagcttgccagaacatagactcctgcagagggcttcagactctgaggccccaggggacctactaagtccagcgccctgagaagcctgccatctccatctccctcccacactggctagtcacccagcctcatctctcaagccaggaaggtagggaccagggggatccacacacagatatcccaaggcccaccaccgcagagtacagtgttgaggaccaatatgcttgagggagttggcccctctacacatgcagattctctgatgaggtatttataatagtctctccacagtgcccatgagggaagacacggtagactgggatcctcatggtggggcagaagctgagttgctctgaacagaactggaaataatgagaccaatttctcctacaaacagtcactgaaaacccacgggcaggcaccatcctccacccgtggtcccacgaagtgtgtggacacaaacgcttctgtggcatgtctcgaggtctgctgtggtccccaatggagaagaatgaatttacatccatggagctaatccaatagaggaaacaatgtggcgctaggctgtggaaggccacgtatcgcgtggcagcgtgggctaaacacttgattggcaccagggccccaccttctcccactacttggtattcatcattcatcggctcttgctgggagcctttcccgggctcctcatctccccgagggattactgtccacactggcacaggcacccagctcatgtccctctgtctttgccagcacaatctggtgcctgatacaacttcccgtcacactggatggtttagaaataactactttattcttaggattagcatgtcttctcccatttctgttgctatgactttaacggagcgttgtgtggtaattcgatacacaagtaaaacacatgaagaagatatcaggaagcttggctcctctacttcaaaaacttcttaagtttattttgattaacacgtaacatttgaacatgttatggggtagattgtggcatatcataatttttggctgccctggaacactctgtgtagaccaggctgccctggaacactctgtgtagaccaggctggcccagaactcacagagaacctgactgcttctgtcccctgaacactaggataaaggagtgtgctgccacacaagctcaactaagcgtgtcccgctttctatttcctgaggagactcagtccaaactcccatctcatttgaaacaaatctgcattgtgttaagacttggaaggctcaaacaatctttctcatgtacacatatgctcacttacacacacacacacacacacacacatactcacacacacacacatactcacacacacacaccacacatatacacatattcatacatagtcacacacacaccacacatattcacacccactcacattcaaacaccacacacacacacacacacacacacacacgtatcacacactacacatacacacatactcatacacattcacacacacacaccacaagctcactccttcttttcatgagacaatttgtactgcacataactctttaagcaggatcatgactaggtggtcccttgaccttaggtctccgggacagaagctgaaaggcgacatcgccaggagtgggcaaggggtgccgtgttccacagcccctgctgtactctaagtcaccagattcttcctgtgtggccaccaagcttgggtttgagcttatccctgagccgtcctggcaaacacagcccttcacagagaggaggcccgggccctacctaaaacctcccatcttcctctccttctccatccagtgctccattctcacacaggtcccctcccccacgcccttcactttatctttgcctccatcccccgtgaaatatcttccatattcacaagtattctcaaataaagcaacaacagcaaaaccctaagaaggctaatacccttcttatcggagaaatactcagtacagaatagaaattccctaagaaggaagaaagggaacgtttcatgagtccctactgtgtgcacagtgtctttggcctctcctggtgtgacaaagtgactctgagtgcttgcaatgtgcattacttgcgagctcaatgatgtcagttgtggctaggagaagaaggagcgcttatctctgctccactcacctttgtgtcccgaggaagcctggacctccgtgagctatgtcagcctgctgtgccaagtccctctgaggccaacagtaggtgaggagcagggtctagctgggtcttcattgccagctcagcctagagatggtgcactgtccttaccctcactgataaggctttgttgggaacgaaattaagtcacagaatgaggctgagtggaagaaagtcctttaggaaatgaaatccaccaagggaaatctaccaagtgtgctgacttgctccccacaacaccgattaaacaacctgtcatgtgaaacttgctcacctgctttatcctaaggcaggacccaaactatgataagctaagatgactaattctcacatcttcctccaaactacaggatttatgaaatgccagggacagctgacctccaggttagcagggtccaccaccaccttgtaaatacttaaggagctctgaacaagcttgtgaagttgaacctctctccttgaactggtcaggggcagccacagtgcagaaaggaagatccagaagtgtgagccttttgcagggacccagacactgcctccaggaaagctctcctctggtggccattgtggcacagaggaaatcgcaccagatggtaaatagtggcaactccaacgcttggtgaaatgatttaggtacttagcaaacaaagggagcacgccagctcctttcccggattcttcttcctggggcacagaatagaagaaaatgcagaagcaacctccaggctcagtgagagttagcatttcctagagtggaagaaaaatcagatggggaggtgggggtgggaagtagggggtggggcagggggcttgagggtgggaggacagggggcatggacagactagaaagtggaattggatttttttttccttaaaaaaaaatcgatgaagtaaccaagctattaaaatggaaaataagtctgatgtcattctgaaaaataaaagcgttgagtcacctgcggagccacttaattaggcccggaaagggacaagagagcttgagtaattttccccgccaatgtcagtatttcaaaatgagcgaggcgtcaggcctcctctcatcagtgagttacatcagtgcttttaccctggggacagcctgagacattagaagtcggtgaagaacaaaaaggaatgcattaggaacgatccccctgcactggaccagcttccacttcaggtccctgcgacacctcagaacgagggctagaggggtttctgggcatgctctggggagccagacagcagcatggcactacaacagtagtcagagtgacagccggcgaagctctatggagaccccttagggacagccttggtttgcatgactgcagtcagaggtttgggctttaacagagccacatgggcattccttcataagtgtttggattcaacacctctgctaaatgaatacctccacctctccctgtgggtcagagggtggctcttcagaatcctgccaactacccctctgtctttaccaaacagagagtcctgctatcaccagtcccttgcaagggcaaaaactcaataatctccctgctgcagaactgggctttcttggtagcactcaggaatcatggggaccgtccttgagcacttgggttctctgagttgggggtcccttcagccacactcatgacaggttcctgctcgagatccccaactagagaaatctctgactaggaaaagcaggggccgcagctgggacctagctcacaacaccatgtccaccccctcccccatcccccccagtgctgcaatcgaggttatgatgccatgatcagtcaagctcaattctgatactgtctggttgatgtttattttccttattatttagctgtagctgtagaactcccagggctttctttaattcctaaaactggccttctggctttgtaagctttgaaatggaccctgctcaggagaacaaggtgagcacacaccgatgctaacaaggctgtcagcgggatatgaagtacaaagtgaaggcctaggacacaggaaaggcgatttttactggaaatggagggggaggtgtctttggatggtaagcagtctgttctgagtttagtgaatacagcagaaatgaatcatgggctaaatccaggttttagagaacaccctaagtccccaaagaccacccaaaaatttcccccatgttagtcacagagagataagaatgaacagcagtgctcagtgtgcaatcatcgaccagatcagaaatgacacccatccctcacaaacaccttggtcctgtcagacagcactgggtttcccctttaactacctcaatattattccttctcaccttcccaaccaaaagactgctgggtagaaacacaaaacaaaacaaaaccaaaacccagagtaaataagcaactgcttactttccctgccaatctaacaattgaaacccaggtaaaccaactctaatcctctttcgaggatcaggattgccctgcctctaatctaatgccaatagctcactaggttgcagtgcagggagctttgagactaaaagaagatgactaagatgccatgaagacaaggggagggggtgctggctgaaccctaataatattgattaagaagcacttggaaagtccttctgagagagacagtgggatgggagaaggaggcatggtctctagtatatacatgagctgtggagtatggttctttcagattcatctccccaaaccctgcctttcaactgggccagccagctccccttgcggagccttggcttccttgtatgttgcaccaggatggtaagtgtttagcagggacccatgcacaggatatatcagaactcatagctgcagatccatccaccttgttggaatccagctcttttattaggtgctgagttgagaaggccagagtgcaaactggtgcaacatccatagatatcagttatgttggttggtgatctcttgtacaatgtcacccggagcagtctccacggctgcatgatttcaaataccttatctttgattttttttttttttttttttttttttttgtggtgtggggaatggaaccagaggtatcactcatgctaggcaaatcctctgacactaaactgcctctcagatgtcagggaaaaagagttatcagtgcaaaacagacaacacaggaccaggacaggctggacactatagtaagactgttttacactggctcagatgaaggcagggccaaacagagacacagtactgaaaccattgccctaaagtcttagggtcctggagagacatcaagagcactggaggcaagagagaccaaagttgtccaggcagggacatgcacctgcctacagaagcttgtgtttaggtggcaggaccatctaagagagtggttttcaatattgctaatgctgtgtgttttctaatggtcttaggtggctcctgtgaaagggtcatttgatggcccgccccccccaaagggtttgtgatcttcaggttgagaaccatggacctaggggttggggcatctccatggtgaggagaccttttccttccctctcctgattagagtctggcatgactcctctggcaaccccctctgtaccctgtctgaatgccaggtcctactggcctcccctcccccagctctgaaccaatcaaagtgtgtatatttcagagactaggaagaagctgtgctcttcattcttctggagagtcattttatgtcacagttgcatgagaaaggagataaccagagttcacagtctgcctgcccagggattccgtgggtgaatttgcttaggccagcgtgacctccatgaccatcatgcttcaacagcctcctctttagcataagtgggaagagcttaaggtcataagaatataggaatcaagccaggaggtggtggcacaagcctttaatcccagcacttgggaggcagaggcaggtggatttctgagttcgaggccagcctaatctacagagagagttccaggacagtcagagctacacagagaaaccctgtctcagaaaaacaaaaaaaccaaaccaaaccaaacaaaaataaacaaacaaaaaatataggaatcgaactgtcacatcctgtgggagacaaaaagagtccaggctacactaaactgaagaccaatcttagtagtttgaatagatatggctcccataggcccatgtgtgtcaatgcttggcccatgggaggctggctgggtacaagctgagagccctgtgtgttctgctcctagttctccagatacctcatcttgaacaccaaagcccagtcttttgtttacacagcaattcaaccatccaccccagcttttcttttgattatcccatgaatcagcattttatgacctaagtcccttgattcttagaaaagacagctagtacattttttaacacagcaactaaattcagagatctgcctgcctttgtaagcacagacagtaagctagctgggtggaatcccttcctgaaattaacattcccaccatgcctgtgcctaacttgctctgtcccaggctgaccttgaactcaggaatctgcctgcctttgtatctttctgacaagctttcattagtgcatgcctttgttcttttagatctgtgaagcccttcatacaattcatattgcatccttatatctgcttagttgagaaatttataatttttgaactcatgttttcagagttcttttccacagccttaagggctgtactgaagctcacagcatttgccatttttgctgaggaacatagacacatcttcaactcctaaactcatgttgtttctaattatcatgggacattaaccttggcagggagaacattcgttgcctgataaccttgtcggggagaacatctcccaaaggaggaacataaagtaaattatgtacattattatacaaacaagccctattcctacagcaaccgacaacactcgtgaaggcccatgtcctgctgattctgctgtatggacaggaaaccttgtcacactgtcccctgcacagccacccaggactcggcacagataaaagagaaaacatcacccatgtaatgctttgtgagctaataaattgattgctattacttattgaagagtgggtgactcaaaagcagctatgtcattggaaagtccaccccagcatgggggaaggacactcacaaaaggtatatcccgagatccctgcacaactcataggtagttccactttagagtctcccttccctaacaattattcacaatggagttgccttttccaagtttcttgggtctcctgagtcttatgagcctcctttttccctccaggagggactgttttaatttggagaaaaatactacacaacaacctggatgacctggctctgaagtacctgctctccagatacacacatgtgcccagggtagggcacctttacctaacctttatgggccttgatcatgctcagcatgaggagtctgggtgcatggatttacatgaaggttgatgttacagccatgccctgggcacaggtttgccttacactctctcctgggccttcccagaccccatttccttagaaggaatacttcttccctcctaattttgggggtgtagaataatctcaggtgcatattctctgctgtggaaggctagagaaagggaacattttctcttggctgtgggaggtatgagagtatgggtgagtaagaggtatgagacctaacccttggcttggagccctcatctgggtgtgacatcagagggccagcagatccaacagtcactctagacagaccatgagataggaatgatgcttcctgctttcctagctcactggagaagccaagtttctcctccgatacggagacctttatcaccaccttccaaagcattcactctttcatcagccctggctggagtctcctgaaaatgatggaattctcattatgatgagcccaaatacctcgtaccttcttaaagtgactcccacgatgtccccaaccgtatcctgtctgtgaccaaagactgtctttctatttaggaccttttccatttgtcccagctctctcttaatcttgtttgtgtttctgacctatataacttcttggtgtaatgagggccatatgttttctttacttacctacaggttaatgtggaagcaaatggaaggtgctgtctctcttcatttccacagcacctcctcagtttctctttatgtaaacaaaatccagggtgcacttctgatggctgacattccatgcgtgcccactccactaccagcttcccagatgaagagctttgtcatgctatgcaatgctgcgcccattgttcctccctcagacttttgaccagcaaggaaatgcactgctcagctacttagcagatgtccttgtgagagaaccacagcccctcttaagttcgacaggccctcttaaaaatcagaatattgaccacatcttcatggcaagagatgctgggaacccatgaccctgatgaaaagcaaaaggatcccaaagcaagattgaattctcatgaatggatctctgacatgtgcgaaaatgctagatttttagaagtattgagtatatgcatcttatgggggaaatctatgaatttcattagatattcaaaaaagtaggtcatgctccagaagttcctcccaaatgtggggctcatccgagggctcatcttacgttattgctggcacgttccatgagcatgtggggagtcatggtagagacaccggccagaggctgacgtagccagaggctcctgcccgagcttccagactctcctgccctaaaagtgggaatttacattttgtttctatcttcaaagtttcactaggacatgaacgatggttgcattcattatataatcagaggccatgacctcagtaactacccaaaaaggattcctgggacagtaactgcaggtagaggtggtcgggggtggggtgaggcagacaggacagggaacaaggcttagagaccaggaaagatagtggagctcctgaacagatgagatgttcagaatctgcaaaggtccctaaagattaaattccagtgaaaagcccccaagggcaaatgtgccctgacctgccgagcttggcatgggaggttcctgtcttagttactgttatcatggcaaaggcaacttatagaagaaagcttttaactgggggcttgcttactgcttcagaggacgaattgcttatcattgtggcagggagcatggcagcacacagcagatggggtgctggagaggtaactggaagctacatcctgatctgcagtctgcaggcagcaaggacggggacacacacacacacacacacacacacagagagagagagagagagagagagagagagagagagagagagaagagagaggcccatccccagtggcacaccaactgggtatcaaagattcaaatatgtgagcccacgggggggggggggctttctcactcaaaccaccacagcaacagagtctagaacagggctttggaggcagccctgactctctcccctttctttacacagagcacctcattattctcagacagtgccattctgagagcaggcaccaaaccgacagtgagttttggccaagacttccctttttgcatggttgtgagtgactggtgggggacctgggtgagtgggacagccttcagctatgacatgcagcacctgttgtagagggtcttggtgggtcagcagtggccccaggacgacacaggtgctagccaagagctcaagagccattgccatctccagacctacctcaagttatgcctcccccaagaaacaactgcttctgggttgaacaatctatttagagaggatggcaagtcacacctcaccgtgctccccaccaaatcacgaatccaccacgtcaccatgctttcctgtggacagaggagtggcaaagaagccatcctgccgagcttcctgctcaggcacaatgacatctgctgccctgctggtgacgcgcagcccaccccaggtgtgggaacgctctggcttcttgtagattgtggtttccccgttgagtcagagggattgggacagtgctttgagcagaaggacaggcgggtcacaagacatgtgtgtgtcaaagagataaattttgaatctttgacaacaggtttatttcgagtaagctgagtcactgattacatcaaagatcgtgcccagctggagacactaacagcaaaacccagacctggggcatttcatggaagttaccgtaaacagttattttgggcaaaaatagattttcatctatttgtttatttttgagacagggcttgccatgtagcccaggctggtctggaatatacaattcattatgtagcccaggttaccttcaaactcaatgtctttgtgtctcagccttacaatgtttgggttagtgttgttgacattgttgttttctacaaagctttaaaacacacacaaaaagaaatgaatttattacttatcgcaacttagcagagtagttaaatttataatctgccttaaattctatatgattgggagagggtaccaaaaagcagggaagacccttggtgagggttgggggaggggtactcagaatacccttgagatggagcgagttcatctgatgtttaatgtgcatagcaccagtgaggctctccactctatggaaagagtgaatgtctttctaaaacctccatggagtcaggccaggcatctcttcagacgtctgcttcctgagtcatctttgccttttctgtgacagactactgattccactgggaacactctagccatgtggagtccttctgagttccaggagtctatactgttggtcacagggaaagagaaggatcacgggtttgacagaggctctggggacagcaggcctggctatccagtggactccactggcagaggagggctgatattttgctctggagggaagcctgggtggaatagggtttccttcaggctgtgcagcagttcaaccaagaggcagttcagcagagcaattgagccatagacagcaagctctctccccgtgtttatctccagtttccaccttcgattcttctcaggagacccagatccctccactctccccacgctcatctaggaaattggagctacctcaaggatgccaggatcctcagagcccatttctctgagcagccaggctgttgtgtcaatagtccgagaacagaagagccatagatctcagccaggtaggagcctcgtgtagccttggggggttcaaaggcccgaccccagtatctgacccatcagctgctttgatctgctgaagtttctttcttctacttcccacagacttttatgattttattacatgtgtgtttgctctgttctgtgacaattgaggtgaatgaatcagaatcaccaattgtttttccttctagtctgcccaggtctgtcaccccatcctgctctgaccattttttttttttttttttaagatttatttatttattatatgtaagtacactgtagctgtcttcagacactccagaagagggcgtgagatctcattacggatggttgtgagccaccatgtggttgctgggatttgaactcaggaccttcggaagagcattcagtgctcttaaccgctgagccatctctccaggcccctgctctgaccatttaaaccccctcttgccctccagtgagagcacaagcaccaatcttccaggcttcacctttcatgctcccctcccccaaagcaagctcaggctctttctccaaaacaggaagttacagatagtgaagtgacatcggtccctggcctccactggtagcctcccccactctctccctcattctgagcaacgtcctctgactaactcccgaggttctccttcctctctggagcccccttgcatcagcgcagctgcctggactcctcccaatgcccaactagaatttccagaaccttccaagctaggtggcctccttctgacctatggacattcctctggggctggttctgtcacaggattttttccccctgaggatttattgccaggaaaaagaattccccaaaggaacgttgtgatttctcatgttggacaatgagagccagacactgttctttctgtcgctgggatgcttcagtgctaccctaatgtgtaggacagatggttctcaacctgtgggttgcggcccccatagaggtcaaatgacctttttatagaggtcatccctggaaaacacagacatttacgttacaactcacaacagtgatgaagtaggacatattttgtggttaagggtcaccatgtgagaaactgtattaaggcgacacagcactaggaaggttgagcagcgctgtgcttaacaccattgcatacagctgactgagaaggcggtctggtttccctagcctctgggtccacgatccagacatactgctcttttcccagtctcttggagcattgctgcctactgaggggtcccctgcacacagtggatttgtggaagcctcattccctgctccccaccttcgactgggatctcccgacaaccatcataatgtgctggcctcctgcaccttataaaatgggatctttctaaaggggaatcatctggtctaacagaacaggcccaactgattaagtttctctctcccatctccaggcagcctgacgagagaaacaagaaaaacagagttttcttttcatgggtggaagcgatgcagggagtcagaaacagtcttgttccagctctgagtaagatttcagctcagttggcagatgtgggttttccagcaagtgcccacagagtgccactttacttcctctcagaatttcctccacaaacatacctgaggtcacattctttggacgtggtacctcagccttttggaatgtctctagaggtcaaagggctccttctgccttcgagagagagagagagattgctttctgtgagctctaatagtccaacaaggcttcatgtaattataactgattacctgccgtgtgtgtgtgtgtgtgtgtgtgtgtgtgtgtgtgtgtgtgcgtgtgcgcatgcaagtgcatacttatgtatgcagatgtgcacatgcatgagtggagaggccagaggagcatgctaggtacctggctctgtcactcttcaccttattcctttgagacagggtctctctctgcacttggagctaagctggcagccattaaactatggatatcctccttcccctacctccacccccacatagcagtggggttacagtacgtgtgcagtcacgcatagcttgctatctggatgctggggatttggtcccgggtcctcatgttctaggagcaagtgctcttacccactcagccccagcctttaaagccatatcttaaataattactcagtctggacaactaaaaaaaaaaaaataataataaaatcatcctaccttttcttttttctttttctttttctttttttttttttaagatttatttatttatttaatgtaagtacactgtagctgtcttcagacactccagaagagggcatcagatctcattacagatagttgtgagccaccatgtggttgctgggatttgaactcaggaccttcggaagagcagtccgcgctcttaaccactgaaccatcttgccagcctatcttatcttttcttactcacatgtgaattccaagaaatgtatcgatgtggaggtcattttgaagagaatttaagtacagcagagacacattaacacagactaaaaggataccaaaaaaactccaaaggttctaactgtggtactaccaccttgagcaaatacaaaaagggtcacgtatagggtgtgggaggcctccaaacacctcgccttcttgttggcttgtttgggaagagtgggagttgagtgaaaaatctttctttctttccagccttgacaccaatctgctcatgggatgaaaacagccattgtcagtattctgaggctcagccgtaccactgccaactggccagctgtaggccacgtggagaaacagcatcagtttctggtcaccaaacaggccaatgtcagaaacagcttcctgagcaagcatgggcgtctgagatctctcaggccctggatgcagaaagcaagaacggacatttgtctataatcagtcttgcttgctgtgtcaagagagagctcaaagcacgggcgatgggctgaggactagctcatgatccctcctcggtttctctgttcttctagggacatttccagcccaaactaagggcagaatgtggggtgaggctccctttaccctgtctttgggagcatctctgcccttccaccactctgccctgcatcccttcattgttgggatgggagcgagtcctctcttgctccagcctttggctcatccaagacttacttatttccaggctggacgtcccatgccagcttcatgctggactgaatgagtgaatgggtgaacccggaagctgagctacctctcaaagacctgatatctccatagaaaatattaatactacttattaacctatgtttactgttactcattgagttttttgtatacttagaaagtggctgggttgttttgttttgttttaaaatattttcttaggctaaggagaaggcaactcagttggtaaagtgttggcacttttctatttctctgtcccctctgtcttctgtgtcctgtgtgcctggctactgtttaacccaagtggggccttaagaggtgaggggtccggattggatcccttttctcctcctcctcttcctccccccacctccctttccctctccccctccccttccccttccccctctctccccctcccccctccctctctggtgtgaccaattattcacctattctcaggccatcctcatgctatcagtccatgccacttaaccacagtaaacagtgtctaagcactagacactgaggataaatgtttgcacacgcaacacaagcatgcagatcttgttaaaatagagccatgggccctgctctctgactgcgtgatttggcgattctgggaaggtcccagagaaagtgtgtttcaaagaatttccccaacaagagaaaaactttgtccagtactcgaaacctggctaactactcagggctagtgaagttttggatcttggcccacaagacctcaaccctacacaaagaactacaggcaactacagaaagcaaagagcaggaagaacaacccttccccagggagaggcacaccgactggtcagccgatgccaaatggacaggtctgaaaacatacatacaagtaacattatccaggctgagcaggttgtttttgtgtgtttagaaatatgtgtatgtacgtatatatgtataacagcaatttgtggggggaaaggggctatgaatttgagagagcaaggagaggtaaatcacagggtttggagggagggagggcaatggagaaatgatataattttattacaatctcaaaacaaaacaaaaggaataacaacaatgatgatgatgatgataatgatgaagatgaagttatcaggtgatgttgtcattctgggttggggtcccatcccctgagaagcctcactagtccaggtaccagaccccaagaagtaccatcttctgagaagcaccattcaggaattgttatgatgccatgcctctgcattattctgtgctgcatgtgacaataggtgagtggctctgtccctgtgaatctggactgtgtcttcctggggtccttcaacccaacaggttgtcatcacaacaacatctggcatcgatcttcttatatttcagtccctctgagtctagaacagagttaatcacatttatttccatttggtgtgcaccaagccaactcttggccagaagagaacatccaaaattaaataaacatgactgtgtaaagagagaggaatgggcagaaaggccaagggctgaagacatcgggaatgacaaaatggagaaatgaacaagcaaaggggaaatacgggaagggaaaataagaggctcgctgtctcctcccatgcaaggtaaccccacaccttagccagcagagaagacactgaggccccaatttattcctaatggtaattcattatcttcaaccagaagacaaacaaaattagtgtcaggggaaaacactgcctggtaaggactttccctttcaaaagttttcacagtcaagatcagtttggaatcctatctacacacttgctggtccacagcccctcgaataagccctctgctccagtctggcccctgtttgccctgtccaagcccaagtggaagcataaagaacagacaactttccattttcagggctggtggctgaagcacatttgttcttgcactagttcaaaatcatcagctgacaggcagtgctggggagggaggtggtgatgacagtacagagagcattcccacctttgcagtgtcagtgttaggtagggatggaggcagtagccagccactctgagaggcccaatgctgtctgcatccttagctccatgaggtggcctggcctccaagtaagcagggtggccttaaggaaagtcaagacatcccctgaaggaagctagcaaggtactcaacagactgtccacacaagccattcgagaaccgtttactttcctgtcaatctttcttcttatctgctcagagtaaatgaatgtttgccttccgaggtttctaaacacagcataaaatactctttgtactaggcacaggaccgaaatcccagcggctggcaggaggatcacagggctaagtcctgcctgggctgtagatcgagtttaagactggcctgagtaacttgagactttctctcaacacttaaaagaataaaattttagggctggtcctgcagctcagcagttgatgcgagctgaacttgtctagcacgacaaagaccccaagatcagcctccatctccacacacacagacaaacgaaacacagacagaacacgcgcttcctgttcacagtgactgttcaaccttgcaaacctgagcgtgttctttccagtaaactctttgccgaagtcaaattgtactcagagaaaagtaagggaaggagacgcaagactcctcctcacccgaggcgacaaacctgacagagtcaagagacagggtgtcataaagcccaagagctctctgtgacctccaacaactactgtccccacttctccctgtattggagagctctctgttcttaaactttgtatgaatggggcaattcaaggcaccttcatggttgtcttgaaaatggtgttgataagaatcgtgcataagattctgtatctcgttcacttatttaatttcaatgctacgcacagctttccatccactgtcatcatattacattgttaatggaaatttgggttattcctagtctttgattaatatagctgcatgatcacattttatgtgtttgtttgagtgcctttctgttgggtatgtcccttggagtagaattctggctcatcaaatatatgcacttggtcagctgtggaagacccttgtccagaggtttcccacagtggaaacttctcccactggccagtggatgacagctgcagttaaaccatttttttccctagtgtgtgtgaggcttatttctctgtacattttgtggtgactctggggttttacagtggtgggagcaagctggaattttatgtcgcgttttgctgcccttactttggctaattgaaaatcaccctctctctctctctctctctctctctctctctctctctctctctctctgtgtgtgtgtgtgtgtgtgtgtgtgtgtgtgtgtgtgtgtgtgtgtgtacaggaatgtacatgcagatgtggagactacaggtccaccttgagtgttgtttttcatatgttgaccacctggaaacttctcgttatttcctgaactctgccatcacaagcatccatcaccatcaccttgttttttctcagaatgggtttcaggaacagagctcggatccttacacttgtgcaacacacacttcacatactgaactgtcttcctagctattgctgtgatgagctgctcatgatatggaagttttgcatacagtctgcataaaaacatttaatcagaattttaattggaaacctctctctctctccccgccccctctctgtccctctgtgtgtgtgtgtttgtgcactcacatatgtgcatattgtgtgtggtgcatgtgtgtatgtgtgtgcatgcgtgcatatggatgtatgtgtatacatgtgtttgtatgtatgtgtctggtgcatgtgtgtgtgcgtgtgcatgtgcatatgtgtgtgtgtgtggcttgccttttctctctcctagcagctatctatgacaattgacattctgtttaaatcaagtcttgaccatctccttctctttagaactttcttattacagttgagaacattattatattccaaggtcttgcaattactgtctttcacaaatgtaattattttgtctttaatattaatattaccctttagctgactatgtgttggtgtggaatagaataaagactgagtatggtactgcgtacaatccaagcactcagaaggccgaggcagatcacaagtctgaagccagagatttgtccaatcagcaccacagtgtttatgaagactatcatctatcccatcctttatgacaccttaagttttcagataaagaatccaatttattctacaaataagctaaaatctcgctgtaatatacagaccttgctctagattcgtttgaagggaattgaacatagacttgataaaaaaaaaggctaactcatgaatatttatttgactgctttaatttctctcaataataactctgtcgtctgtagctttcaattaaattaggtttatttctatgcacctttgatgctattaagaatatttgatttttaagtgttgcaatcatttgtcactcgtgaggacctgtttgtcctctccttaagctgattacccaccccccgcagagtagttaatacagcaatttgaaaatccaagtcttcccgaagagcagcagccagccttctctgctttacgcccctccgcattcagactgcattttctttcaccagtttcacagatgctcctgtcttacccagtctacttgtgagcagagtcctgtcaaggcgtttttgagccttctctggtgtctgttcactcactttgggaggctctgccgagcctgtgttctgaggtgcttttctgacggctgctgtgaagtctccttcagatgacatcgaggctagtcttcacacggtgtcagcacgtcatcacatctcatttgtttccctggttctgggctggggagatggctcagcactgtcctattctcccagagttcaattgccatcactcatgtggggctgactccgcagctgcaggggatctaccacctgtggcctcttcaggcacctgtacctacaggcacctacacccacccaagtatccacaatgtgtacataactaaaagtaaaaaataaatccttaacaagagttccctgggtcttatgcagtgtgcattggctgtattaggatgccctgcctcttatgttatgttatgtcttaattaggcttttgctctatttaggtctaacttaaaggatttctcttatgagcccagtgacattctagcttcataatttccctcaaataactgaagcttccccagatcctctctggtgctgcctggaatttgagggatctctttttagtctgtactccagaagaaaaggacatctcagacttatagagagcaagagtgtaacaaataaggctgcttattaatgtctgattcccatatgtgtctgtcagtgaagaagggggaggtgctgggcgctctgtgcagggaaggactgaatccttgttggctggctttgggaagtgccaggctaaggtcaagtcttccgtgtgggggattaagatgtatctgctccccgctctacctccagtcctacaatgatcctagctacctcgccttccttctttttaactctcagagttctcttgctgatgcctcttgcatatttttctgagtttattcttgcccttagtctttccttaggaggaaagaagacaggcctacattagcttgtctaaaacagaagccccttcacaaagtagctcttttttttttttaagatttatttatttattatatgtaagtacactgtagctgtcttcagacacaccagaagagggtgtcagatctcattacagatggttgtgagccactatgtggttgctgggatttgaactcagaacctttggaagagcagtcagtgctcttacccactgagccatctcaccagccccacaaagtagctcttaaaagacttatttttaatgatgtgtgtgtaccaggcctatgtgtatgggcatccagggaggtcagaagtgggtgtcagggacctggagttacagacagctgggagccacctgatgtggctgatgggagccaagttctagtcttccagatgggggggaatgtttgtaattgccaagtcatttctccaggcccacaaagtatttttgatttaaatttacatttattatgtcgtacttcttactaagtggaagagtgtgggtgtggggggatgggcacaccatggcctcctgtggaggtcagactcgcaggaaactgttctcaccctcctctgtgggatcaaactcaagtcagcagcctctcacagagagcactgacaccgccgagccaccttgccagcttgtcgcaaaggaatatacgaaaatgtctacctcaaatgtattgattcgaaagcttaaagaaagctgtgccgtgaacagaaataaaacttctgactgcttaggaccttacgctccctttccatggaaaattccaccccaggatagcacattctttctactatactgctctgctggtgtgttaccagtatgtcaaaaccttgtgaacctactggggagagctaaggagaaaacagagttgactgaatttctatgagtgcctaccacagctggtaaagccttgacagaagtagtaacacagtggtggcgcacgcctttaatcccagcactcctgatgaagaggaagagggatttctgacttgaggtcagcctggtctactgagtgagttccagaacagccagggctatacagagaaatcctgtcttgaaagaagaaagaaagaatgattgaaagaacgaaagaacaaaagaaagaacgaaagaaagaaagaaagaaagaaagaaaggaaggaaggaaggaaggaaggaaggaaggaaggaaggaagaaagaaaggaagaaaggagggagggaaggagggagggagggagggagggagggaaagaaaggaaggaaggaaggaagagagagagagagagagagaaagaaatatctcagatggagtggagagaaagctgggcatgcaaacattataaacacacacacacacacacacacacacacacacacacacacacacacacacaccagttcagaaaagaaggcagaaacctatatcccaaacaggaaatataggaaataccaacctagaaactaaccatgtgtcacctgcaagccccgacctattttaagtcagtgacgcaggccacactttccttttctgcacctgaaggaatgacttccatcccagctaagtccctgtcagaaatgatggggctattcttagacccagacacgtagccctttgattcattctaaccgatcgctgcttaaaggaaacagctgttcttatgaacattctaacccgggccctgcaaaagggaacctcatgtcccaggtagcttgctggtgtggaggcagtgaccaggaggccaagagtggctcttggctccctcatccaccctctacacttgcacctggtcatactagcatgtacccaccttaggacggcatgcctgtgccaagggagtcttctctcactaattctccatctctagaaggcaggagaacggactgaaaccatgggagctcttgtctggctcagtttctagcacccacatggtgtctcacaatatctgtacctctagtcccagggggtcagataccatcagtcccagaagacactatcttctgacctctacaggcacgaggtatgtctgtgatacacaggcattcctgtaggcaaaacacttataaatatatacatatgtgtatataaaataaataagtctgatttttaaaaatcattatatatatacacacacacacacatgtaactattgggatgatgcaagatatacactgtgtagtgtttaaaccaagttaaacatatttatcatctttttagatgtttgtgatacatcataaacatattcaaattcctttcttcaagattttggagatacacagcacctgtttactttttgttactttaacaaacatttgtgttaagagatttatcagaaaaaaaaattcatttctggtcctggcagtctaaatttcagcccatggtcatagtggcacagtacatcactgtggaaacaagtagaggtggcatcttttattcatgctagaaatcagacgagaagaaaaaggaggggccagcgtcccaggatccctgtaagaatctcttcactcaataactcatcttttcccccacttaaccctcttaaaattcctgctgcctcatagaagcttaggctgaggctgagtctttaacacatggacctttggaggacagccgagatccaaaccgtagcccattgcatgatagttagataccattgtgctggtcccgcttctgctcactgtattctgctcagctctttctatattctagaagcagacacttctcttgggatgcagaccctttctcttttctaaggcatctgtttagtcccacacacttccctctcggctttgccttacttagtcccacctcacaaatgttaatggttgccgtgtgtctcatttagttctgtgtacctgaaacttttcctgagactcctggacttttgttgtttagttctgaagtatgtggagatttctctcttgacatcctggtttaattctagtttgattccatattctgtacacacgcacatgtgtgtgagtgcgtgctcgtgtgtgtgtgtgcttgcatgtgtgtgagtgcgtgcgtgtgtgtgtgtgtgtgtgtgcttgtgtgtgtgtgtgtgtgtgtgtgtgtgtacacttattcatggatacccgtggaggtcagaggttgacatcaggaatgttttctgctagtcctcttctctacctactgggagagcatctcttactgaaccaaattcatcagattagccaggctagctagccagcttgccctagtctcttcctcctgtgccctggggttgcaggtgggtcaccatgtgctgggaaatccgaactctgttttatgacctaagatgctctctaccttgctgaatattgcatgggtcttttgaggctctgtattctgcggatgttagacagaatgtgctagggtaggagtagatacctgtccgtggctgatgctgggtcctatgctcttgttgactttgtctctagttccaatggatggagaccatgctctaaccatagttggcgagtgtgtgtttcttctttcactcgactttttgcttcacacctgtgaacctttggtgttttcttcacaagacagttatcacttcttgatggattagttctgcattgtttaaaacatccctctttgcccacagtaactttcctgtaggatgcttttatttaatgcagcccgccattcttttgctgtgagttacttacatctgtgaatttgacatgagtctcttggaagtagcatataggtgggtcatctttttaaaaccactctaccaatctctgcattttaaataggtatgtttaaactgtttgccttcatgataattattgacctgggctaagtctgacatttccttatggatttgttctttctgtgtctagtgttctgttttctctggcctttctgtatgtttcttgatgtttctcaaaagttctgtttgatttcattatacttttcttagaatatatttattacttccttagtgatgttgctgctgttggaaaatatggagtgggaagtgtggaaaatggctgtgaggcctagctttataatgccagaatgcagtcaggaagattcaggacttcactgttccttgctgtgggtgacagatcacctgctgatgtcccagctgtaaccagatgtggtggtggcattgctgctgctgctgctgctgctggcagatcagactagagggaccttggattctaagaaagggacagaagcctatatgactgggtctttatttgggctctccttgcatggactttagccagagagaaaaggatgtctctgagggtgctcttatctgagtcttttagtgattcccactgcagacctctcttgagccaggccaggttgaatgggaaagaagaaggaatgccagagaacacatccaccatagcgctgtttctcaactcctgatgtttcttgccagcacatcctcttttcctctcggctttcaagctcttatcgctgtctgttgaccgacttccagaacagttctttgtagtttataagggaaggagaaagcatctgcattgctttggtccagatccggaagtcagcacagcttgttcttaaggcttggacatgttttgctccctgagtgattttccacgcagaaaaaatttgttcaccggggcctcctgtgatcccacccccaccttctgctttctcagaagggaccggtcggcctcctgcacttgtgtgcacctgccctgcactgagtccgcaggatgctgagttccctttgaagagctaagcagcttgccactcctcccctggacaccaagttgattgttagcattgctgctggtcagcattttctcggaggttcccttccctcaccctggttttcaataacgttttccttcttttatcaagaaggaggcaatctcagagtgactggagctttcttaattatgaatgtttagctgtgctatccagcttgtagctggatcctgcttgtttctgtcttggactcttgcctgccttgggatgggctttctgcccagtgactcacggaaagtgctatattaaaaacttggagttagtggtttaaatcaaccagcaaagacattctagaaaaacacaccctgccagctgatagagcccccatgccccgctggggtgggggtggattctgcctcttgtgcgttcccttaccacagtaatcttctcattatctttctctttggtaactagaggacagggaaaaatcagatttgttgaacattttttaacctcacagacaaagtttagaaaaggtaggctggatttaatgtgccacactgttctcttttctgtgccatgtttacttgtccctataattttaaagacttccatgaagttaatttataaagtattgatacgtatagaaaaagctgtgtgtttacctgatttaggtttatatcaatatgatgatttatatgtgataaataatataaaagtgcacacacacacacacacacacacacacacaccaattccaggccattggtcttggcaacaggcattattaaccacagagctatctccccgtccctcttaaaaaacggaatattcaaatatgaagtataagaagcatagtttaaaaaaaaatactgtttagacatgtgaaaatagcttagtcagcatcccactacacccaaggctatacctgttcaccagaactcagtcccatcatttactcaagctaaccaggcataagcctagaatcccatggctcccactggccagtatataagcagagtccaaaagcaatgctctacttcacccatctggagagaagccaccatgatcagccctgtggctggagagtcttctccgggatcctgaccgtcaaatcggagacttctgtcaaagacagaaaacgaccttctaagatatgtcaaatgggtgagtagccttagggagacaggcttaggactgtggttaggaatcagtgcatgaattttgtatgataacctcagcatagtgaaattataccaactatgcatacacacacatgcacatatacacacatgtacatacataaacaaaaacgcatacacatgcacatacatacataatacacacaatatgccttcttgcttgcaacatgtagtaagatattgtcaggtacactttatgtttctcttgtcttggaatccccttatctctgtgaatgatacattaaaattattaatttaaagacatttatacctttctggctcttcattcaaagtttattgtttgaaagcagggttacagagatgccaataaattatcatattctattttatataggggcaatttgctttaaccttatcaaagaattaaataagtcacctcagacaaccaaccagtgaaaaaaactttttcatttattttttttttacagcttaaaatctggataaataattaatttttttttttttttttttttttttggtaaaagtggaagcaatttgggtgactttaagttacagcaaattgggagactcagagtcctctaaaaccttagcaggaaaagtgattataggcgtttacatgaaactcattcactctcccaattcccagaaagacatcacatgaactaaggagatgatggcttccatcttactctgaaattactgtttgcccttctgactcccaagacagtagaagaaaaaaggaaaaaaaaaaacaaaaaaacaaaaaaacaaaaaacaaaaccaacaacaacaaaaaactacgataaaaacaggaaaaaagccattttacatttttcccttgccttaaacaagtctaatattaataataatcacacatgctgccgaagagagccgctttcctcctggtttcttttgaaatgacttcctttactttttcttttaacctacaaatggagatctggaaaggggtgggtttggtcatttcgaaactttcctccccaggcgtctcagtaaataaccccaggccatagtctgggtcttctctgttcaagtcttctgggggcggagactgaggaggccaggggcaaaggtggggctggggtgcttggcagagggagtagaggacaggaagaggaggagggagccatggggtgaactcccagcaagtgtacataatgtcacacacagagagacacacggacacacatgcacacatatcatgcacagtagattcaagctcaagaatgagagaagaggaggcggagggagggagagggagagccggagagggagagagccgcgcgcgcgagcgtttcctggtttgatgtcagctctccaacactggctccgaattagccacagtaatattgggcccctgcccactcagcaggcagacggcttatccagccagcaacaggcttttaataaaacaagatgttgtccctttactaaggccaatggactccttttctctggccccgtgaaatatccttccaccccccacccccacccccagcagcagtttcggcagccccccaccccacctcaccacaccccccacccccaccccaactggcattcccaggggctctgatctctggctctgctgtgtctccaaggttcacacccagtgtgctggctcctcctgcagcttctatttgtgttctgccttcataccctgtctgccctatccagcccacctctccccctttcctgcactccgggtagctagcaatagacacagactgggaggcaggcagtcatctgacctcctaagagaccagctttcagctttaaagacaccagtaggaaaggctggacaacctggatttcatcctcagatctgccctgctcaactgtggcttcgaacacactgctgtatgtgtggcggctaggttctcagcttggaacgtaagtagcaggttgcttatagaccagtaaaatattgagctccaaaggcactgagaatccctcattgcacactcttcttaagcacagatgtcgtagccaggtcagtcactaccaaatggtcagagatgatatgggagtgaaggcctgcagcgctggcttgtgaggcccctccaagttgggaggaatctgctctccacgcccacccttgtgtttgctacaaagtttttgagaggaaatggaccgaatgagtgctgtggacccgcttgtgccttctctcactcaagatgctccctggctttggaagagaagagaggagaaatgagcagaggaacatctgggcatgtggatggagtcagagctgggaattgtgtcttctggagcttagcccagatccaccccgagagcagcagggtcctggcaggaagcagggtgtaccagccaacatgggagaagagctgccgaattctagccagggtgaccagagagctgttcaaatggcaacctcagagcgaggaatgcagaaagcccccaataaatgcagaaaaccacaaggatagaacccagcacaaaagcatcagctaaagaatgtgagcaggaggagcagctcatagggaggatgctgggctccctggaggaaaccctggggtcaaggggaatctgtattgctagctgtagagcctgggtcagcccaggacagaatcctttaccacattgcttagctcagtagctcaggatacccggggcagggaggggactctgtagacacatttccaccttgattcaaagacagcacaccctgatctccattcttgggcccaatgggaaaagcaaatgaagaaagtatatcagagtaagggaggaaaaaaagctgtaggtttcagactgaagagtgatgccagcatggagctgtcagctatagtaagtgaccagaaaaaaatctgattcagagaaagacaagcaaacataaaattcagcccagtagggcggcagctgggcagagtggaggggtgaccccaggtcagttaccaggtgtggataacccatctggatggctgggtggtgtcaaaggttaaggtcaaggctaattaattaccaactcttagactgtgaagggggtgggagatgtcagacaagagtcaagaatgcccaggctgcagataaagggaaggcagggactgtgcaggagactcaggactcactggcacccactctcctcaggtctgtcaggggctctgtggaaagggaagagttgcctctctagtagcaacaggcgtagtggggaaggcgcctctctaagaattaagtttcctaatcaaactcagggctgaaatcaaccaaagagaaacaaaaagaactaggcaaagaatcaacaaaaccaggagttggttctttgagaaaatcaacaagataaaccattagccagactaaccagagggcacagagttcagaatccaaattaataaaatcagaaatgaaaagggagagaaaacaatgaaatatatcttaaaataactattctgtctgttgaatattaacagttgagaatattacggtcatggtctacaaacaccatggaaatagtattaataatttttctcatgcttaaaattagcattttcttaatgtttaacttcaaagtttttgctattttgaaatttttaaaatatgcttactgataaaataatttctctcctagaaacactgataatcttgcttaaataagcggattgttagaccatgtacacagatatagaatgagttttaaatactctctcactatgtcaggtggtatcatataaggacttttgaatgtatttcttaatgattcatttttaatattttatgctcttttactatgcctaattcccaagaaatattttgtatgttttgaaacaatttagtattcaacattagatacagaatcctcagttatggacagtattaaatattcattaatgatgcttttagggtatgaaaggatatgaatataaaagttgaacaaattttttatatattatttgattctcaaaatactcaatattattgatatgtttgttgtattttaataataaaaatttaaaataaaatgcaaaattaaaaaagaaagaattaagcttcctctactcggttagccatagggccagttctcaggctgaggtgccagttccctcttctggggtggctcctcatcacagctttgtcaccctgggggtggggacagcctgcactaccttctggcttccatgagaaatggagtggagtcaggcagtcaggagtcctgctgatggtaactggcagtgcgggcgggaatcccttgagaaaacatccttggagtcagagattctttttggcaggacaactatgaatcctgtatccaaaaaaaaaaaaaaagaagaagaagaagaggaaaagaaaagaaaagaaaaagcagggtggggtctggtggtagagacatgttacataggcgtgaatagctgggtttgaacccccagtatgttcaaacctgtttaatcaggtcatcatcacactgtgacctcaaagcttttcaatatcatgtacaaatgatatcaatattaattacaatggtgtggtagccgatggtcctcacaacagctcctagagggaaatcccattgtcacactcagtgtaggtcagggaactaagggcaaggtcccagtgtttcttggaccttgttttaacctggaagagaaggccgagggggttgggaggagctctggggcctgctggaaaatggtgagtttcagggtctctgtgagacctgtctcaagggaattaagtggagcttgatagaaaaggacactgaaggcccttctcctctctttgcacaggagtgcacaggcatacagatttgcatgcacaatgcacaagcacatatacacacacaccatacaccccccagcccccatacacatgagcgagaaacagtaggtgatgggagatgagcaaggtgctattcaggtcctgaatgacaataggtgatcagcccagaacatctgaacgccttcagagctgctcttagactaattagactaagtgactaattgtggggaagtccactcctggaaaaactgtcaaaattgcaaaattgagtgagttttataaaaagtgaatgcctgacaggaattcttggactattgtagacttattagccacgaggattgacaacatttcagaaagaatacaggggaccacgtgggtttgatagacacaaatgcacatcttttataacaggtctattaaacagggtgcaactgattaaactgaaatcaatttcatcaaggcagtgaacaaagtatattctcatttttgaaatggacaaatatggagcagtgtaaaaaaggattcccagtcaaacggatgcccggatagaaccctgaacactttgaagttccacaatggagactcttagatctgtgctagggaccttggtctccccaaaccaccatttgctggagtccttggagatccttagatgttaggaagtggattggctggtggtattgctagggtgtcatgagtcaggtatgtgacttcatagtggactgttgggtgtgacactagtgtccttgtcactgtcgactgctactctgctctggccatgtgccctggtttcagaagcacaggcccttatcaccactcagctcagctcccctctggagtcttgagactttggtcacgtgactccaccaccctgagcctcagttttctcactgcaaacttgatattcaaagacataaaaatgtagaaagctcagggtagtggtgcacaccttgaattctagcacttggaaggcagaggcaggtgaatctctgagttcacctggtctacagagcaggttctgggacacccagggctacacagaaaaaccctgactcagggggaaaaaatgaaagcctaggtgtcaaatgtgatggtgagcggattcagagaaggacaatcaatgaaccaccagattgtgactgacacaaactggttttaacaggattaaatgaagtccaaaccaacaccaataaacattcagttgtcacatttgttaagaaaaagtctgagaatttaagaatgcaaccaagaagaatgtactggttggggcatggctagttgggcagctacctttgtgaaaagcagtcaagtccagcaatgacattgtaaaagctaagacaccaacatgctaagggttgggggttaagggtcagggggaattttctgacacctggggatgtaaacatgattacactgaaggctgagaatccagacaccaagcacactctgcacagttgacagttataccgaagggttcgacgaagtttagtgaaactctctggccctgagaacagaaccatccaatgatttaaattgagttgatgacattcggtattggggggtaagttgtaaaagctgatgtggctttctttaagtgtcatttgtgtctctgttggtgtgatcctcagagtctctggtccagatgagacatggcactcttggcacgtgggtgatgagaaagaagtcatccaggtaacaagtgtgtcagaacagaaaggatgcaggcgtgctggtcaatgttcttctgaggagacttttgaagaaaaaaaaaacataccgataacttctagacagaacaagagactacaaacccacttcctaccttaaagataggaatgaatatttgtctttatgtgggagggatgcaaacctcttgagtataaaaataatgggaaccagctgggcagaaaggttcatgtctgcaatgtgagcacccaagagacaggcaggaggggcacttcaagattatctaaaatgtctcagaagctggaaaagaccacagtaaaggtaagaagaaaactagacagcatgtatgacagacagacagacacacatgcacagacagagacacatacacacatagagaaagatattgaaaaatgggaaaagacagcaggaaaatcaagacaaatgatttataaaatatagaaaaatattcaaacccataaacagccaaacccatgaaataaaaatagtaagacaacgtgcctccctcagagtgacttccacagtctctttctgtgttatcacagtagaatattggagatagggcactttctaaagaaaagagttttattcaggttacagttctgaccattcaaggcattggctctggcaaggacatcatgtcaaatggcacactgtgtcaaaggtggtgcatacagcaaaggactcaaagaaggcatcacggtctcatctagcaatctgtccctacaagaattgacccagtcacatcctaactgcctcctactaggctccaccccttaaaggtccctcccccttagcgcctctccactcaactagcacatgaccctttaggggctaaaccacagccaagttgtagctgtgggtgagaagacagtaagtactagtgttcagggacaaggaacacagtgcagatgggcctacactgttacacacgccgggcctgaccctcatgttcctgaactagctgtggcatcaagttctgcacttggtttccttgcttattcactgaagaaaatcataattcctgctcccagggctgtcaagagggttggctgagattattttaatttagtgagatggtgtgtgtgtgtgtgtgtgtgtgtatgtatgtatgtgtgttgtgtgtttgtgtgttctgtgtgtgtgtgtttacaagcaattgatcacattacatttgtaaaatgaaatacatcttttacatttttattttattttattttatttttatttttaagacagggttttaaactgaggttggcccaaaactttctatgaagccaaaaataaactcctcctgccttcatctccccagttgcctgttgatgcccactggaagccttgagtctcccccaaggacccaagtcatgtgggcacacgaattttcttattttcttcctcgtggtcttgtcggggagaggcaggagatgtgtgtgctgtttcagaaggctgaatcaggcctccctggaacctgacacccatgcagtatgtgtggacaggtgccatagcctctgaagagccacatctggtccaggctgacgtaatcatttcctgtcactacttcaggaagcacagagcttccagcagcataagagacccactgtgactctcaggacatactctgccctgcctttgtttgatatcagttccatttcttttaaagatttattttacttctctgtgtgtctgcatgttatgtacatgtacacgcatatgaatgtgaacacccttgggcatcagatacactggagctagaagtacaaacagttgtgagccactgtgatgtgggtgctgaggatggcatgtgagccctcggcaagagcagcaagtgcttttaacagctgagccacctctccagccctagagccattttttcctgtctctgtctttgcttccctgcctcccccaaaagaagatgttcacctgtaagcccatcattatagacaactaccagaaagaaagcaatttacaactggacatttttctctttgtgtaagtgcaaggctagggccaggaaggtggccagttgatagggttcaggactaaccttcattgtgctttggattcaatcccttggactacataagccaagcgtgatggtgtaagcctgtaaccctgccagcccactaccctttctcctttccctctttgtattcagtctggaatcccggtccatcgatggtaccacctacagtcagggtgagtcttccctcttcagctaaacttctctggatacaccttcagagtcacactgaaatccactcaagctgacactgtggggcaatcatcacggtccccagggccaaaccaatcagaatcacatatgcaaatccaccttcaagttacttaaaatcagtatctcagacaactcacagaatccctagcttaaagactgtaataaatcaactgaaaaaaaattcaacaatgacaacataaaagcatccaccacacacacaggcaaagacctgagctaacgagacggggcaccttagatcatgtggccaccctggttcccgaggtgtggagactgaagtacagtatcatatgcattggaaggaatactcaacactacagaacggaaaagaaaaatgcaactgagacctaaaccaagacatcactatccaccttcaggactgccaaattttcctatgtgtcatatccaaagtgtctagacactgcatccttctgcctgcctcctgcttgtaagatgaaacaattatggtggagcatgatttgacagtatctatctaaactactgaggctaatcccctacctgagagctcagcttcggaaaaccgatggcagggtatgctcaggcaggtgtaagccttgtgtacccatcaagctctttaggcagcaccgcttgcattcactgaagactaaacacagccctgaatgtctgacattctgaaattggttaaataaacagcggcacagcacactgtccttcatgtcacaaactaaagtgtcctaccttgcgtgtgtcaaaaaaaaaaaaaaagctccatcggatcctggggaatatgatcgcagtagaagaaaaacaaatgttcaagaggcagagccagtggggtggctcactagataaaggcacttgccacaaaagcctggtgacatgagtttgagcccctggaacccacttaaaggtggaggagagaaatgacttcacaaaatcttcctttacttccacatacatgtcgtggcatccaaacaccacctcctacatcacactgacacataatgcatataaatatatttcaaaatgacagacagaggcaggagggtcccttttctgcacactggcttggatcttttctttgtacaatgtgtacaggccatctgttaaaatacatttcaaatgtaaaacataaaacccacatcttttttcttcaggggcgggcagattctataggcaaatcactgaacattcaagcatactctatccacttggacttctgacgggtcacactgctgggtgagtccgaggagtagggtcaatggagaagtcccttctctgctgtctgggagagccctcagctctgtatgagctaagtccacaacagcaatcttctagccactctgcttcctcttagtgggaagcagaggagagtatggcgttaaaactggaactagccaacatatgccagctgctggccagcctcaagctttggaggtgttaactgatggtgagtgtgttcatggcagggaccccgttcacagctcagggtctcctcatcctactgctcagtccaggttaaaaataaaaatcccaccatttgtctgtcttgccccactctaaaaacagcactcgcagaggctaggccctcgagagaggacagacctgcggtggccctgacagcttcttgtcagccattgtggctttgtgctctgttacagcatcaacacattcaactgctggcctctgaatctgcctttggcctttggtgactgctctgtgccaagacccaagcgggatggccttggcatgccctctttggttcctccagcaaactcctagaatggagatcagagccactcgggggttttatggaagggttggctgatcaagcttccagctgtcatcctgtgaaggaggtggcagtgaggctgtcaggggtctggccagctgcctgtgggtgtcaacagtgaattcccttgcccctgggctcaagctctgcctttcctggctttctagtactagctggtcacagtttgcttctcccttgtctgtcttccctctggacccttgcaggaggcaagtagtggtcagctctctaagccgagtgctgaccctgttctgcaagggcctgagaaggcagggtaccagcagaggggaaattccagagatgaacacacaaaaggctgtggggaaagacaacagcctctacagtccacctgagcttcattcagccaggacagctcattttaaaaagcatgcttccttagatgggaaacgaggccactgcattaagggcccattcaagatcagcagggacttcacctcagtccctgctttctcctgtcttggagctgggtcacaggcgagacatggcccagctccaggcctcccgtgtctgcactttaataaagtttctccatctctgtaactattagtgtgtctctgtaccattcactgtaacgagagagttccagggacatggacactccagcagttaaccctctacaccggtggttctcatcctgtgggtcatgaccctattgggggtcatatataagatatttacattacaattcacaacagtagcaagattacagttatgaagtagcaacgaaaataaatttagggttgggggggtcaccacaacatgaggaactgtattaaagagtcacagcattacgaaggtcgagaaccacggctgcagagccacaccagccagtgacagagacacacaaatgcagcatcttagttactttttctgttgctgtgacaaaacaccatgaccaaggtggcttgtagaagaaggcttttatctgggcttacagctcgagagtgctggagtctgaggtactggagcaaaggcagagcagcgacaactgagagctcacatcgtgatctgcaagcaggaggcagagagtgttctggaaatggtgaatcttttgaagccacaaagctcatttccatcaaggccacacatcttaatccttcccaaatagtttcaccaaatagggaccaagcattcaaccattaattctaaacagtcattcagactttttaaagatgaactactaaattgacattcatgctttaatctcagcattgaagaggcagattgttattagacgcgttctcacgaccggccaggaaagacgcaacaaaccagaatcttctgcggcaaagctttattgcttacatcttcaggagccagagtgcaagaagcaagagagagagaaaacgaaaccccgtcccttttttaggagagttatatttcgcctaggacgtgtcactccctgattggctgcagcccatcggccgagttgacgtcacggggaaggcagagcacatggagtggagaaccaccctcggcatatgcgcagattatttgtttaccacttagaacacagctgtcagcgccatcttgtaacggcgaatgtgggcgcggctcccaacagcagatggcagaggcagaggcagaggcagaggcagaggcagaggcagaggcagaggcagaggcagaggcagaggcagaggcagaggcagaggcagaggcagaggcagaggcagaggcaggaggcagaggcaggaggcagaggcagaggcagaggaggcagagagacagacagaaggatctctatgaatttgatcaagtagttctacaaagtgagttccagtagagccagggctacatagtgagattctgcctcagaaagaaaaaaaaaagggtggtggtagtggtgaggggctgaagagatggctcagtggttaagaacactggctgctcttccagagaacctgggtttaatttctagcattcagatggcagctggcaactgtctgtaactctagttcctggggacacaacatttagagacatacacgcaagcaaaacaccaatgtacattaaataaatattaaataaataaataagcaacacccatgtttaaggagggggtaaaagaaagaaagaaaaaaagatgagctacaaataaatgctaagtggcctcagatagttcccatgggactgtgagtatgtggtgctactggggactttgtgtgtgcctgagtgtgtatgttttcatatttacaaatgcatatataaacatgtctgagtgttaatgtgttaagagttaacatgtatgtatactcttgaaccccaagcaaatgagaacattcccatggctactcacactgctcctggtctacctagaatcctgttgtggatccagtcctccaactttaagataaagaaaagccaggagaagacagctgcctgctgtgccagaccaaacatctgggtgtacagagtggccatctgagctgctgactggagcagaggtaccatcagcggagtgtgtgctagatcccttagtggacatggagacagctttccattgttcctgggctgctgtgggcatttggtttgtactggattcctggctctctctctctctctgtgtgtgtgtgtgtgtgtgtgtgtgtgtgtgtgtgtgtgtgtgtgtgtgttagtgcagggtacaactcattggctttgactgggtagaaagcaccttccagcatttctggttaagcccagaggaggggggggggggttgttaaagggacctgggagaagccttaagaagcagagtcaaagtgtagaatactctgctcacggaactgtttctttcctggaggctaaaattcacgggcaggtagccagcagccacattaggatatgaaatgtaatctgtttataataagttttcaaactgcctctcattggtgcagagcatggagagggtaccacaacccatggtgaggtgacccttgcctgctgtccacggtgaactcacccaagctggcaagtcaccgtgaggtacagcctcccgcatgcttcctcgctcagccatctctatccctctggagcagataaacacgttaccacagacgacagctggagtggctgagcgccaaccccagctgcttctccctccgccactgctgcctgaggcagctatggaagcaaagaagcaaactgaccctgcaggttggaaggcacccctcgggtcacacagtcccactgatacaggaagttgggtcccctacaccaatattctcctgcaggtcgtgggctgagcaaggaaggagcagcctgggcggctcctggccacctccctgtgtagtcaatgcttgtcttgctttccagaacaatggtgaatgaaaacagcagccagtacctattaggcagttgccctgggcctgctagcatctaagcactttgaatgctttgtcttgggaaactcaatcaaatctccagggagatgttagtcaccgttttgtaagtgtggaaatggaggtatagaggcctccaacaatatgcccaaaccctcgcagtcagtggagcctggatttgagcccaggttttcccagttccagaatccaagcagctgccatgaccaccgccctcctcccaccctgatcccctacgccttccatggggaggtccacagcctggatccttcccagctaaacatcccagaactgacattgggctgtctaagattgattctagaactttcttcaagctctgattccccagaggacattcttcccctcacttcaaaactgaagagaacaatgaatcctaaagctggaaggaagggtaaaagctaaggggactggaacctcacgcatccaccttaccattcagggctcacctctcacccactttgagccacctgctcagcctctctggatcaccagtgcctcatctagaagcagagagcactgaacggctcaccactcccgtgacctgaagccctagcaaccacatgtgcttgtctttctaactctactgccactccttgtggggatgcccctgaagaaggggtgtggtggaaaggtggtgggggggggcagcgcaggatgtggtggcaggtttctgaaagcaggcagtgagactcaccacacagccttggttggagactccttccttaggccttgggtctgccccatggttcatgggtgatgtgtaaactacccctaagatacattgtattccaagaaatgaacacatttaaagatacaggcttacaaaaaggggggggaaagtctcctgtcttcttcaaacccagcattccctaagatgcctcctagtccttctcctaatagggttgtcttctattcagcattcccagaagcttcctctgacctctagtactgaaatgatgccatgtctccccaaaggccactggacactccctatccatccacccagttttacttaacctttgtgacaggtgttgctaactaatgtcacacgtccattccttgtttatattattctgcgtcaccacttattggctgctgcaggagaggtccccagaccccctccctactgataattatcctaaatggttcctaattcagattacaggttcactaaatagaggctggagtgcttgtttgtttgttcagatggaaggaaggaaggaaggaaggaaggaaggaaggaaggaaggaaggaaggaaggaaggaaggaaggaatatgcaagctcaatgtgtgttctagttaggtctaatttcttttcatttctctttagatttagttgttttatgtgtatgcacctgtatgtatatgcaccacatgccagcctagtgcctgcagaagtcagaagagggaatcagatctcctggatctgtaatcacagacagttgtgagcaaccatgtgggtgctgggaattgaaccctgagtattctgcaagagcaacaagtgcttttaatcactgggccaactccaacctattataaaattaatataataaaattgccaacttgacccggcctagagtcatctgagaagggagttttaattgagggcttgcctagatcagattggcctaagagcacattcgtggagattgtcttgtaattgatgtaaaagatcccagcctactgtgggcagcacaatcccctgggctcatactcctgggctgtgtaagagaactaatgaagcatgaatgagccaacaaataacattcttcagtgtttctgcttcaaattcctgtttgaattcttgccctgacttcctgtgaccattaggagggcatgaattataaaatattatcagatgctcaaacacagcacactgagagaagagtccagaagatgagtgcacagttgttacttgcattgatcacatgacattctagagcaggtaaagctaatctagaattttctttctttctttcttttcttttcttttaatttttattttaagaaaaacaagatttgccttaggaggtgaaacagagatcaagtgggaagaacttttttgacaagtactcataagaaagatgagaacttccactttcaggaagttgaaaatatccctttcccttccggctgctgagcatcactaagaagtgtgcatattattacatagggaaaatacaaaaggcgctgtaaggagccgagaagatgggctgactagcaacctgggaaccagaggaacagcacggcctatggttgtctcacatatcacaggtgtggaactgaagaaagagactgacggtctaaacctactctctctaagaacctagaaaggggtgtggcctagaaaacagtctaaggcagtagtggtctactccaggatccactacagaaaatgtaagcccaacctaaatggaggggagacgggaagggatgcatgggtgggaggcggatagacatagggcagggacatgacgcctagcttcccactgtcaccaggggacttctctgctcacccacccctcaccagattggtgttcaagaagactgagagctgagactttgcatccatgtccaaagggaaagggcttccctgatgtcagggagcctgggcttctacccccaccagcaagaaggagcctttctcttcagatgtcaatagaagctggtggagaacttggccttctacttctacctggcaatagtgagctgtacctctctatccaacctcccctgtgtgagctctgtaagaaacccagttaaaatagaagacaataattaaatacattcctccagataacaagatttcaatggaaaatactcttgctaaagtccagaaatcttttaaaccaaatgaaaaaagatcagtaaattccaatacggagatgcaatgttatctgacaaatttttttttttttttttttttttttggatgcggtttctctgcatagacctggctgtctttaaactcactctgtaaacgaggctggcctccatcttggaaatctgcctacctctgcctaccgagtgcttggattaaaggtatgcactaccactcccagcccatctgacaaacattttcattttaaggcatctatcataagaatgtttcaaagtgcagtggtggtactcttgtactcatgaaacaaaagtcaaaaataggaaggagaaaatgaaaatctaaggtctgaaagtgccataagcaaaatgaatgtgcacacatacacacacacatacataccctgaatgtgattaaaaaaaaaaattaaagagaaatacttagagcagatgtgagtgaagataaagactgactatatagtgacaatatgtagtcacagcaagatgccatagtgcacccataagactgagggggagtgaattccagcatctgacataagttccagccaggacccagaacagaggggctttttctccagacctaacaaaatcttttcaatttctcactaaggaatctgtcttaattctgcctaccatcccccactgttcctaatccccagttctctctccctggtgcctttgtgaagtcagctatctacaaccagtcgcctccagcaagagcaagctcccctctcccaggaatttagaattcatctaccagaccattaagtgctcagtgctcagtgcttggtgctccgccttccttccctttactgtgctaggacaggtaaggcaatgcctaactgaaggagagctggaaagggcaactccagagagttctcagagagccggatctctgactataggcaggggaaagggttcagtaagatcaagaaggatgctgtgttggtgagaatacaatgctagtgccagaaaccctgaggtttgtgtctttagaggcaacaaggctgtgcaaccattctccaggtgggcgggagagtctggagggcatgagaatctcaaggaagtactgtgtttctttaccatccttgttctctaaggagaccctgaacacctaggcctgcgtgagccttcctttattattacttttttaaatattatatgaccattttttgtaatattttttaattaggtattttcttcatttacatttccaatgctatcccaaaagtccctcataccctcccccccactcccctacccacccacttccactttttggccctggtgttcccctgtactgaggcatataaagtttgcaagaccaatgggcctctctttccaatgatggccgactaggctatcttctgatacatatgcagctagagacacgagctctggggagtactggttagttcatattgttgttccacctatagggttgcagacccctttagctccttgggtactttctctagctcctcagtttggggccctgtgatccatccaatagctgactgtgagcatccatttctgtgtttgctaggcctcggcatagcctcacaagagacagctatatctgggtcctttcagcaaaatcttgctagtgtatgcaatggtgtcagtgtttggaggctgattatggaatggatccccgggtatggcagtctctagatggtccatcctttcgtctcagccccaaactttgtctctgtaactccttccatgggtgttttattcccaattctaagaaggggcaaagtgtccacattttggtcttcgttcttcttgagtttcatgtgtttgcagattgtatcttgtatcttgggtattctaagtttctgggctaatatccacttatcagtgagtacatatcatgtgagttcttttgtgattgggttacctcactcaggatgatgacctcttattacttttaagcgaggtatcagttcacaaacagaggcatcaacctagaagccaggtgtaagccgggggctccattgcatccgagtattttcagccttggctggctgggattctagctaatggaccaggatacaggctgatggtgacctcagccagcacatgggtctacctgatctggttaaactccacaatgggctaaagacacctagttcagctacctagaaaaggccagtttgagagagagagagagagagagagagagagagagagagagagagagagagagagaggaaaaggactcacctggggaggagtgttactaaagattcacaaatggaacaattttctaataacaaaataaacattattaaattgtccttgcaaggtggcaaattggtgaagagatttttgttatccttttcaatgaaacttggctggggcgtgcattagattgcactccctaaagaatgtattatttgtttctgtgccctgcctccctgcctggctggctttcccttcagacctgcaggtgttagcaccctctccctggggctgggcaaaggctgccttggggttcatcctcagctctgtctcctctacttggggtccagaataagagaagcaggctctcattcccacgccccatgttgggactcatctgtactgtgggacaaaaattggtactgacttgcctgggaattcccttctgtggatcctgttcctgaaggatgagagaggtggggggtccctttctatctagcctctcactttgcttggttatgaacttaaagataatttcatgtttgtgagctgtgtttcattaagtttttagttttcaaagttggtatggggacgtaacatgtaaaagtgatcatttatttgggggatgtgggtcgaggtgtttactgaattattctgttttcttccatcgtgaacatctcctgttccaaccaaagaaaaggcccatatgaaacctggtccctccccacgaataggagtggctaccttcttgtgtctcctgcttcttctgctgtagaagtcaaccagaacttggtatgtgggtgtgggtgtcctcccctctttgtccagagcagctgctgttctctggtcctctggtttgctttggtagtcttctggataaaggcagatgagttcagaatgacgtcatttccaaggtttgactcgatccctgcccccgcaagaatcccacctgcaccaaacagaaaggaacacctgtaagaagagaggccgctcgctgctgtcatcactagaagtgaacccggtgtaacagaatccaaactatctcaggttcaacaggaacgcatcaccagagaaaacccatagtgacgttggttgccgctcttcacttaaaaacaaccaagctaaattaagtaacaataacaacaacaacaagttgtttcccacaccacttgcccagtttctacctccagtgttcagtctgaaacaatttccacgcttgagttattaacttatgaaaatcggcacaagaggtggaggcagtgcgcacagctccccggctgcgttattactcattgctatggctcagtgggttccagcacaaaggcgtgttattctgcctgcctctctctcagttttgaacaaaacgcagctcactaatgggttctgcctcatatacctttctgtaatcattatgctgccattctctgtaatttatcctgtttttcacgaagagcgtgtgtattagtcaggcgtgcacatgtcctgtaagtcccctttcatttgtggctaaaaagaaaggtcaccaagctgccaatcacttggagtaaagcacccataatgcacccattatgcactgatcccggcaatatttggaaatagtaagggatggctatgaaagactccaaaagccgagagaatggggacatcggtgtgaatggtgaaggggatctgaaaacagtcaagagaagatggaccgagggggagttttctgcccatcccagcaggatcccagtctggagatcacaataaaacacacacacacacacacacacacacacagagcaatcagcgacacctgcttacaggctgagtggtttcaagtacttcttccgaactcctttactgccagctacagcctgtattttagcaatttctaacttgtgctccgaagcgctacttcagggtgggggaaatggctcagtagataaaatccttgctactaaagcttgagaacctgagttcagatctctaatccctacacaaagagccaggtgtggcaatagaaggaatctgatgctgaattctggcccttttagatgtaagggtaagcacacacaggtatacatgtagcatgtatgtgcacatgcatgcactcacaaatattttttggaaagaaagaagagctatcctatacaaacttgagccaagtgtgttctggaactaagtggtatcatggttctggaaacttcagaattgcttgcagaaatcaagacctatcaatgttctagtggggcgggggggggggggcggggcggggggaggcaacaagagggaaggggtgggctcggacaagctaaaattgccagtgaagagaacaactaggtaaaagaacttgagacatagggaaaggtgggacacaattaagatttaaaaaaaaaaataaaaaaacaagtctgaattgctctcactggctactaagcaggtcccatggggctgaacaccttgcaaacaaggtgcccctaaaacaactaaagaggagcccaggagccaccctccatcaggtagcagaattctctaccagattctttctctgtagccactgactcttgtagatgagcaagggagcaagccagcaagtgtgtttctttcatcttgctgaaagtgctaatgaatgctttggttttgttctttcctcctcattaagacaaatgagctcccttctgcccccaggaagctgctctaaccccctaaagcagccactctccttcctgcttagcaagctcacacctctctaagggaccctgtcctgtcaggtggcctaagggcctacctcgcctggtttagactcagcctcagggcctctccatactgctcgctgctcttggagcccattgcctaccacctcgagggtccagaggcacgtttgaggttatatcaaccctggaggtcccggcagagccacaggcacattacattttcatgttactgtgtcttgaagaggctgccaggttcgacaggatttaggaagactttacccccccaccccaaaggtagttagaggctgtgcagcccagtcttggtcaccttatttttgagtcaaaatctctcactggcctggaagcctcaaggggagctacagggatcagcctgccttggtctccccagagtctagcctttctctctgtgggtgcttaggagacaaacattttatcaattgggctatcgccccaatcctttgctccccttttaacagtatgaaacgaagcagagcggtgtgtgcagacccacgctgccggggacgtgggtggaccaaggtgggaagcaggattccttcgctccgcttgcccaccgtgattggatccctaccctagacccccttccctgcttcccaaggctagcaccaagctgacaagaggacaacttgaactctgctttacccagagacaactggaggtagaaagaagggccttcctgaagctgcaagagaatgagaggcctctaggacacagctctgagtcacagtgagcagtgaggataccaccacagatggccccatatggttgcaatgtgtaggaggctgccaaactctcaggggagaagtgagaggcccacctgaggactgttcttggggagtcgaatctgagcaatcataacccgactttgctcaccccacctgagttggggccagcctgagcaacaggccacacctcactaggtgtctgcctatctctgtatccccccacatccttccctaagtgacacgatgttgatgtaatcagcctggcaggatccagagttacctaggagacaggcctctgggtaatgcctgtgagggattctgggtaatgcctgtaggttaatggaggcggggaaacttcccttaattgaaggtagcacctcgctgtgggcttaaatctaatgaaatgacaagctggcaccagcagtcatctccctctgcttcctgactgagtgtgacacgtgacctatctcttcccgccccttcagccccctcttcccacaccaacgtggatcacgagccaaaaataagcccatgttcccttaactgcttcttgtcacgtatttggccacagcaacaacaaaagtcactaatgctgttggctacattgatgagttccagtctttatctccttcaccctgttaaccattttaggaacacatctctgtagcattaactacctccccactgttgtgtaacatactctccaggccacttgcaacattgtgactctacagcccatgagcaatcgctgtccacttccctcccctcagcccctgacagcttccattcggcatctctctaaagttaactgctcttagcacttcatggaagtagaatcagacagaatgcccttccacatgtggctaattttcattaactacatctggactccaccaaaccccatgctgcctggcggtcctgggaggtgaagagctttctcaagcctcagatcagaggatttgtagttctcaaggaaaggttcccgcgtgtgcaggggagaaccggagtagctggctcactgtgtgtgcccccgaccccaacattgtccatcaaacacaccctctgtgctcacagcctcaggagccagattgctgtttggaagccattgacaaacccaagctgcccagaacccagaagtacgtgatacccacttcaacgggggttatgtattttaattctttcccccttcaaggaaggggagagaactgaagctgttgatggaaaccccacttaaatggatcagcactggggagccatgtgcacatctgttcttaacaggtctcagctgaaaatatacctagatctgtttatgtggaaccagctaaacatgataagattacaacttgcagggtaaggatggagttaggagtcagggggtggggcgggaggaaaaacccatccacactcagtctgtgtgtttgcgcctcacacttaaccacagatgtgttgactgggccggatttgctgtgaattttaaaagccaaaatggttcaagattagttacagacaaactcaagaccttcccacagcttttctgcagttcagcctctcgacttacttccccccccccccccgcccccatgagcccaggaggagactacagttgggatgtctcttgaattttgagttctggcccatgagaaagacagtatgctagctactcacacagagaggacacagaacaccttaagcaaacaactcaaaagtagcgggggtgggggaatgacggtttcctttgggtcaggttacagctcatagttgacatgttctattggttgtaagcctgtggcaagatcactgtagtgggagcaggggcttggtttccttcacttcccactaatgacatcaagttctatacccatcagaatcacactcatggattaaatcataaccctcaatcaaccaataacttctcaatgattggatctaccagctgaggcctaaaatttcaacccagaagtcttgcagagaccttttttatatccaaatcattacgaacaccaatcccccaccccacccctcacccccacccccgcctcctgctgccccaggaagggttggcatgggttgaggcatgtgtctttttgcaggctctgtgctctctcagggtcttttggctttggacctacagctacaatctgaagctacactgttaactccagcacagagctgagcaagcagtctggatggtggcttagagccctggtcctcgagcaaatggctaataatggcttcagcagactaacactgggaggaagtagaccctgtggtctacttttctgagttttgctgagatagaaatcactggatttttacatgatgactccagtattgaaggcaaatgaaaaccacagccctgctgtggctttggagcctctcgtgggtctgtaggtgtctccacaagtgggaggaagaggcctcattggctttgcctgctccaggctctgcgcagcaggattcccgtcccccagtataggaagaccccatcttaggtgaaaggtgtcacagtttagtacccttctccactttccctctgaacgccatcatactccatatcttcactccatggtttgaaacttgcactcatctggagacatccatccataatggagctctacaaattgatatcagtctataaaacgcaccacaggatacagaataatggtcacatagcctcagaaacaatcagctgaaactgacatctgaaagcacacatcctcctgcatccccccacctcggggggggggggggaggggagctgtgattggtaagggcttcattcccaatgggcctcacgctgcgagcacttacctagtttagttcatcaaaaatcacttcttttaataagcagtccacaggaaaacaattatggatggcagtttcattacacaggaagttctagaacaaagaactcatcacccacaattctgtgacctattagatgatacagaattttaattaaaaaacattaacatgttaaattgatggcaaggaaggtccttaccacttcaaggtgttagaaagaaaccaggaaggcaaaatatggctggtaggctatctgaatgaactgtgcagtgtgccttaagatttgtcatctgtggctttgtgtctgaggctttctgctatgtttgttttttaagacaagttcttactgtaaggccctgactagcctcagattgatggcaatcattctgtctttacctccagatgctgggattgcaggtacacataccgtgtgtgcacactttagttttggcagagcagaatctaagctgcgcacatccatcggagggagggtagtgagattcgggaagggagctttctttctctctgagtaactccaaagcacatcctgaaagaggacccacagttaaaatcccctcacctccccaagtggctactgccccaagtagtgcaagaaaagcccttgataggaagcttttggtttgattgtcgttttctgagcaagaaacttggtgttatttccaggcaattaacttaagaaagccttcttcattgggacagatgaatggaaacacagtcttctgaaatcactggctaaacagtctaatggcaggcaacgtggttcaagccaaactcactaagtctaagagcattggcttctgaactgatacattaatgaataggaacacccaggtgctctaagccagttcccacactagcttcaggaaagatctagagctgatgggcatcccataccctctctagacaagctcctaggtcatgctgtgtcagagcatacccaaagttctgtaaaagagtacacactttgccccaaccacagggcactgagctgtgacctctggggaagacactggcttgtgtccaagaaggaagtagctgcctgagtcttgagagtccataagaaccagttttacacctggagctgagaatatactccagggtgctcagtgaggctggcctcttgtaatgaaggacttgggtcttgggatgcagattgtcaatcccactgcatgggaaggaggcaactgcttttgtcctgagtgggctgggctggtgcaggggcagccgtagagttaaccacaggctagaggaaagcttccacttcttccaaggaagagagcagcttcagacttgcacaatgctgaggccagactgggccagtgtacggcagtgagccacaactgggatcctgggaagatcctggagtgataatccagaacatagagtgagttcaggcctcagaacacaaattataaagcagctgggtcaaatgacaattgcttataacctcagtactggggagggagagatgggtgggtcccaggggctcattggccaaccaacctagcccacttgtccaatgagagcacttggctcaaaaacaaaacagaaaacaaaaacaagccaaacaaaccacggtgagtgcctaaggacggatgccggaggctgttctctggcttccatgtacacacagacacagacacctacacatgtacagacacacacatgtgatgccttcacaatcactgctgggtcccctctgctggacagctgacgagggatgtagctggtacctttccaaaagtccaggcttgactgcatcatattctagttcatatgtatccctgattgtgcctcgaggtaccagtccggtggaccactcccttgttaccattcccatatcttcctcattgtgtcaaggtcagtggataagccatgtaggcccctggcccacaacaggtacctaggcagcataggtttgggttactctttctgggcaaacatggccaactccactgagggacagttatgcactgaacgtccaggaccttgaaaaataccatggtggttacaaaaagaaaatgacagagggccaccacagggacatccacggtagccctgaggtgaagcaggtgagccacattggaacactgacccttcttcaaccaacttgacagcaggtagcaggggccccagaaggagtcaagtgtgggtcctcatggagtgatgtttagggaagctggctcttgcctaggcgctttccccactggctggaagggcttcttgaaggagaagagatgccaaggctgggtaaaaatgaacagcaggctcatggggcagggttcactgtgccctacttggactggggcacatgactagttttctctgagccagcacattttccattctaaaaatagctcgcaatgacccaagacatcttcccctcccgatagggcccgtggttctgtggtggtgttgttattattgttttcccagaatgtttgtgatttctggaagcagtgagcattgaaaccattatgctgtcagtgcgttatctgactgtcccccagatacaacaccttgaggaccaatattcggcccttcgtggagggaagagacagccctgggaggtaaggggagccctccccttaccaaccctctttagtcagcctgtcttctccctccatcatgaaaagcagggggtgctgcttaagtagaaaggaggagcagacagcacccccatccccacctccatgttaacagcagggcacacccatgaaccccaaggctgttggcctctgccaaagcctgacctagccacagctggaggagcttttaattgaacattggatttctgtctgccctggcaaccttcccacatcgatgttgggatatttctgggacgtttaggacacaagccttttaaagaggaggtacccaacactagtcaggtgactcctaggagccgagtctttcaactgcgggtttccaagcatggggctatttttacatatctgagtgaaggcctattaattgctgcacaagcacttctagggaagttcatgtttcctggaggccaactgttaactcaagcaatgccaaggcttctcaacggggcgctgggagtgggggttgggaaactttgtggtttgctaaggagagactgaaaaaaaaaaaaaaacccactcactttccctaaagggttaatggctgcagacaagacagccatattaagttatacccggccaagggtgagcagtgggtgagcaacgcaggcaagcaaaagaaaaaaaaaatgtagaaaggggaagataggaaaaaaaaaaccgcaagcatatacaccctctcccacatctcccagcccacccccaccctccggcagaacattatatgtacaggccacagattggagtgaagttaaatttggctcacaggaatacaggaaagaaagaaaacagatcaagttacacagaatcctattcagatttgggcttgggcctcagcacacaatgcctagctaaagagaacaaggccacggtgtgttgtggaaagctccacgcccacgagctctcctttccctgtagtcatctgctggcccagccctgggctgcaggctaattccctgctctgcaggtggagacgggataaaacaaaccaaaatggtgtaatggactgcaggaaacccttctttcagaacttgatcagcctccagaaaggaaacacgcatggacttttctcccgacagcaatctgttttcttagggtgcagcgagcaagaggcctggtggccagggtaaataaaacagccagtggcaggacttttggcaggctgggttgcacaggaaatttgaaaagaccgcttcctacactctgattccaatcaaaagtgagctgtcaatcttgcaggacggaggcacttgaaaagcacaagccaggaaagagacgctgcggggtggaaacccgagtggcaggtgtgtgcctggaaccctctccggctccctcgggctgggtcacctggctcgaacccagtcccagaagccggattctccaagtcttccaactggagccaaacaggactgctggatcgaaactctaggtggattttggcttctcctttgagcagctgggcaggctaagtggcccctgcatgtaaagccagctatgagatggtcaggtatgtgttaaacaggagagattagaccctgtcccttgagcagacagagaggagagaggagagagtcccgccagtgctccccggggaaagtctcacaatgacctaagaatcaccccccccatactgctgcggagtagggtctttacaaagctatcctatcctatactatttgagtttctcctgactctaggtgggctgggcagggagaacacagacctcattgtacagtgaagaaggaagatgcctagcaaggtttctctttgcctcagagaatatggcctaccatctgaacagacatatgccaggccaggctgggtggtccaggatcctcagacctgggtgtacgtgacagtcaccagccttcatcatctggtgtcacctactctccttaagagcgttgccctaggggctagaggaaggacttagcagtcaagaacactggatgatccagaagacccaggttcaattcccagcatccacgtggctcctcatgactttgggaattccagttccagaggagccaatggcattttctggcctctgcaggcaccagagatgcatgtggtacccagacatacatgcaggcaagatatgcacacacataaaacattttaaattaaaaacccagtaaagactcctctcagctggagctcagtagtggagtgggcacctagtgtccttagttctcagtgggctctgccgtgatgggagcccagccagcctctggctcagagcgacccaaggccgagtcaaggagagaccccatgcaagtcatccctttcacctgtgggtctgtagctcctcaaacctaagtggaaagaaaaagtcactgtgggaagtgtgttccccagtattctgctttgccttccactgccctgataaaacagtttggacaggaaagagtttgtttggcttatagtttatagtccatcattaagggaagccaaggcaggaacctagagagaaaactgagaggactctgtgtgtgtgtgtgtctgtgtgtgtgtgtgtgtctgtgtgtgtgtgcaagcacactcagggaatgctacttgaatagcccaggaccactggcttagtcatcgtatcacccacaataggctgggccctctgtggcatccatgatcaatcaagaaagttctccacagacacactccacaagccaatctgttaatggaggcagtctctctattgatttcccttctttccagaaatgtctaggtttgtgtcacgttgatgaaaactaggacatctaccagacccatccattcacgtctaacctctagtatctcagaacatacctttcccaggatgaatcgggatgctatgcatataattagttgagatgaggtcactagagtgggctggaatccaaaattcagtacagttcttattcgaaggggaaatgtggacaccaaggcatatagaggggtgcatttgtataacagtgaagatacacatcgatccgatggtgctgctgtgagccaagaaagctaacagttgccagcaagcattagcagtacgagcaaattcacattcactcccacagaaggctggtccgtgccagtcttggatttcgtcctgtgagtcctggtgtgtggttctcttcatgtcaagcctctgtacatcgcatgctaagaggccaggctggaaagtgctcagcctggggtaagtgctcctccaaagccagcatccaggccctgtcaacgctctgaagagatttttctctgttgcctgaaggaggagtgagcctgtgctgctatgaagggtctctctgctccttcgggagagaaggagagaaagtgtggtctttcgcttttatgttttgtctctgtttctcaacagaattcctccgaagaggctcagaagtgagagcaacccgcacttcctctttcgggcagcgatgggctcccacgtgaattatggtggagaggaatacctttgtcctcagcgactgaagacctggcctcttgataacttcccctttatcctagtggcttttctagagaaacctgataacttcttcgcatgactacaggagaagccacagtctgcttgaaggagaagctctcctaggcaggaatgaaactacaggatgcagccataggcagactcatgggggcaggggacagagaaaaccctgacaatattcacactcataatgggagggccctcccacttggtgggaatgcctccacacgcacccacagcagcagcccgtgcagtgttgcttggacctcaactttccagggtagcgagggactccacgactgttcttcaaagccccatgacacacaccatcctcttggctctgggaaatctttacaatatgtcatctgccttagaactctgccgcatttccagatccggtgagaggagctgcacacaggaggtcctgggacttcactccgttggaccatcaatgagatggtgctcatatacctgacgtggaatgccagtctttcttcttttgctgtaccccaatctgcctcttgttctgtagcctcctcctaaacaccttctcttttttccttatcttcacccctaagtctttattatttacacactccagagttatttttcctcactaagcattacttaatatatcaatttaggaaatatttttttcttccaaggaaacacttgcccatccttgtttattgctgctatattcacagcagcaaggggatggacccagcctagatatccatcagtgggtgaatggaccctttaaatgtggcacttattatacacagtaggatactttcagcagtgaagaaaaaattaaatctacaggaaaatggatggatcttaaaagtataacaccaagtaaggtgacctaaagtcagaaagacaaaaaccacatgttctctcttgtatgtggatcctagtctacactgcatacttgtatgtatgtaaacaggtataaatgtgcataatgtaaaagtctaggaggccaagagagggtagtattagctgatagggaaggataggtgtcttagtcagggtttctattcctgcacaagcatcatgaccaagaagcaagttggggaggaaagggtttattcagcttacattttccacattgctgttcatcaccaaaggatgtcaggactggaactcaagcaggtcagaaatcaggaactgaagcagaagccatggagggatgttccttactggcttgcttcccctggcttgcttcccctggcttgctcagcctgctctcttatagaacccaagactaccagcccagagatggtcccacccacaaggggcctttcccccttgatcactaattgagaaaatgccttacagctggatctcatggaggcatttcctcaactgaagctccttgctctgtgataactccagctgtgtcaagttgacacaaactagccagtacaataggggatgctggatctgtctttttttttttttttaaatcaattttacacaagctaaagtgatctgagaggagaggccttatctgggaaaatgcctccatcaggtcagtgtgccagcaaacctgtggggcattttcttgatggatgatcaatgtgagagatctagcaccctgtgagtggtgccaaccctggggaggaggtcctgggttttaaaagaaaacaaactgagcaaggcagtaagcagcactcctctgtggcatctgcctcagcccctgcctccaggttcctgccttgagttcctgccctgacttccctatgaagagcctgagagctgtaaaccaaaataaaccctttcctccccaagttgtttttggttgtggtgttttattacagtaatacaaaccttcagtgagacagggagcctggggcaaaagggaacatgagacatgaaagggggaaaatatctggggaggagctgttaggggggcagggatagatgaaggatgagaaagatgatgaaaggtaaacatagaaacacagcttgtgatgatgtcataatggtatcgaacacagtcatggctaatatgtgtacatatatattatatattcagagagagaaagaaagaatataaattatgcttctggccatccttttcctctgtggtagtgactggccttctgtccctccttctcctctgtggttagtgactggcatgcaggagacacttgagaagtatttgctgaggggcaatgtcacctgaacctcttatgttcaggttctcttgtcctcttgtcatctccattttaaccacttggtcagcccatctacagatgttactatctcttaacttagtcccaatctggacacctagtctcctgtttacgagacaaagcactcacagactgtgggtgtgagtgtgtgtgtgtgtgtgtgtgtgtgtgtgagagagagagagagagagagggagagagagagagagagaagctgtaatgtgtattgtgctatatgcacatatatgtgtgattgtgcatgcactgacacacgtgggtagaggccagaggaggacatcaggggtcctgtcctattaacttgccctcttagtcccttgatacatggtctctcctgtatcatttggagctgggagattagtttttaatgtatttggtccatattttctttttcttttgttttgttttttgtttgtttggcttttttgaggcagaatttctctgtgcatttctggctgttctggaactcagagagctgcttgcctctgtctcctaaatgctgggattaaaggcggtggtcttagtcatttttcaacatttctttgataagaggccccatgactcttcaggctctcagagctggtgaagaggcagaaggaagcctagaagacagattttctggtctatcctgtagatgaatacgtcagctatacagagtgtatattccgggtacacagttgttctggaaggctccttctcttggtttctgaacatttcagtttaacatttacatgctctcaagagagtccaggcatctgccttcagcctccagagataatcctggtggtaagctgggcgttcctccccaacacaacaggtcgagtgacaggaatgcacactgcttcaggtgctgtctcacaaatccacatctcaaccagccatagtgacttccacggagagtgctatgcaaacctcagaggtagatctgtttccaacccccgaagaagcttaaagcagcgcagtcttcctggcacagacgccagcctccttgttctcaagttcaacacatgttttacatcaagaggagggctgtggtcggggtaggggagctgaagggagattcaaaggttcttcggttctcataggtctcagcctcttcaaagcttcatcccactcagcacgagggcttctgcccacactcgggtgctgtggtacatgcttggagacgcgcctgtgggccagagagcagatagcaggcatggactgcaatctccctgcaaaggttctccctgaaaaacggacatttcccttgggagtgtcctgagctccctaagctgagtggccaagaccctgactgctcacaaggccatgctgaacagtggggatggtgcaaatgagctcaagctagcctattgggcagtttctactagggatctttgcaggtgtcaaggtcgacaggtgatggggatgtctaactgtttgtgaaatggaaggcgatatattaccaggcttcagagaaatgcagaggaagacagctggaaagtgacaaggtcctgggcatttgtatgatgctctttccgaaataaaggagtagagggcgaagagaggagggaagaaagacacagaacaggagaaagatcggaggggggtacctttatttacctccttttttaaaactaaacttcttatttccaaagttttcattttccagaaaagttgacaattagtgcagggagtcttcctatacctcacactcggtcccttgactaggtctacttgtcaccgtgaatcataacgtaaaccaaccgaactctacagtttatcaaatctccacagtatttcacctgaatacttggtattgcagctacatttagttatcatatctgaccgattcctcttggccatgacaatttctcaaacttatgtttttgcagcttgtggccattttgagaactgttaggtggaatttctgttggtttgggtttgttgttgttgttattttgcttattatcacagttgagtgataaaacctcagaagagaggtgacatcttcacacacacacacacacacacacacacacgaatacctgttatcgtgacatctcgcttgaccatctgactaggatggtgtttgtggtacctctccactgtgagatgcctcccactctttggaaggaagtcatcaagcccagccacacttgaagagtggggagctgtattccacctatgagggtggactgtctgcacactatttgaaattctgttgcacttttctattttcctcaatttgttctctcagtcttgcccttacaaatccctcccctcagcccagttgagtaccaccctaccctgggacatctagtccccgcaggactaaacatctcctcttccactgaggtccaaccaggcagtccatgtaggggaagggggtccaatggcatgtgacagagtaagagacaactccaattgttagggggtccacataaagatcaagttcacatctgctacaaatggggggtgggctaggtcaagctccagcatgctctttggttggtggttcagtctttgtgagcccctatgggcccaggttgacgaggtctacatgtcaccattaattacaacataaatcaactgaactctacagtttatcaaatttccacagtatttcacctgaatacttgataccaaatctacatttagttatctcataggtcttcaagtctctgtaggtcttcttgtggtgtccttgagcccccagctccctcaattctaccccctatttgtctgtaagaccacccaaactctgcctgatgtttgcctatggatctctgcactttcccccttcacttctggctgaagcctcttgggagacagttatgctaggttcctgtctgtaattctatcagagaactcctacagctgatgagcacctttagcaaagtggctggatacaaaatcaactaaaaaaaaaatcagtagctctcctttacacacatgatatatgggctgagaaagaaattgaggaaacaacactctctacaataaccacaaataatataaaatgtcttggtgtgactctaacaaaccaagtgaaagatctatatgacaagaacttcaattttccaaagaaagaaattgaggaagatatcagaagatggaaatatctcccctgctcatggattggcaggattaacatagtaaaaatggccatcttaccaaaatcaatctacacattcaatgcaattcccatcaacattccaacaccattctttacagaccttgaaaaagcaattctcaacttcctatggaaaaacaaaaaacccaggatagctaaaaaaattcctgtacaataaaagaacttctggaggtatagccatccctgatctcaggctgtactacagagcaatagtgataaatactcagggtaatagtgtagaaatagattagttgatcaatggaatcaaattgaagacagagaaataaacccacacatctatggacacttgatatttgacacagaagccaaaacccatacaatggaaaaatgaaaacatctttaacaaatggtgctggtctaactggatgtctgcatgtagaaaacaatgcaaatagatacacatctatcaccctgcacaaaactccaatccaagtggatcaaagacctcaccataaaaccagatgcactaaatctaatagtcaagaaagtggggaaagccttggacacatgggcacaggagacaaatccaattacagaacaccagttgctcaggctctaagatcaacaattaataaatgagacctcatgaaactgaaaagccttttgcaaggctaaggacatcagcagcaggacaaaactgcagcatacagaatagaaaagatcttcaccaatgctgcatctgacagaggactaatatccaaaatatataaagaactcaagaaattagacaacaacaaaccaaataacccaatttttaaaatggggtacagagctaaacagagaattctcaacagaggaatctcgaatggtcaagaagcacttaaagaaatgttcagattcaattcctagcacccacattgcaatttatggccagctgtaactccagttcctggagatctgacgccctctcctggactctgagagcactgcatgcatgtggtgtacagaagtacatgtaggcaaattgcccctacacatacaatgaaaactaaaacaaacaaacaaaaaatctggaatagaggtgtgctttttgttgttgtgataagatttttcacccccaccttagatggcagaataggaaaatatatgtgcctacatgagttatctgaatattttgtgcgtaaccatctgtagctgtagtaagctaaagttgattccacactggtctctctaacactaagggattaccatgagaacaatcgcagtcttttccttgtctgtaattctcattctgttaaaaacctgactgtcccccccgcccccccactatccagtcacttcactgttaggaatatggaagtcatagttttagaatgcacactcttaaagaaagcaattattttcaagtgtatttaaaaatgttatgtgtgcgagggaataacacttctgaaagtcatgttgggctctgatcaccattgtgcgggctgaggaaggtggaggtgccatgtaactgccatgtttacaggcaaggcctttaggacgaggaaaggtcaccagagtaggtgtcattgaatcctggttggcttcatgacagagaccagaaaacacacccacacacacccacacacatacacacacatgtgcgcatgcgttcactccatatctcttactatgtgttcctctgcaccactttggaactctgcaaacaagaaggctataacttgtgatggccacttgacatggaaccattactagaagccataacaaatggcccatgttatgagcaactggccccagggagcatgctggcatcttgaaatcccatgcagccaggatgggtgtagaccccagacaatagtttctccgtgtaagatggctgatcttcactggaaacttggtggggtttagcattaccatagaagcaagccccttggcatgtttgttggggattttctagatcaagttagttgtgggctggagagatggctcagtggttaagagcacttttgttcttacagaggacctgggttcaattcccagcatccttctggtagcttacaatcaggggaaccaatgctctcttctgagctcagtgggcaccaagcatgcacagggtgcacagacaaacaaaatattcatacacataaaaattaaatgactctaagaacaacaagaagggatttgtcttgactgagacgagctgagaaaagtcttcctaaatgtgggtggctccaatccctgggctggagtcctggaaagactacaaaggaaaagtgagctgagccctagcaacacacaagcactctgtgcctgagtgctgaccaactgcggctagctgccctacacccctatcacggagccttccctggcaagaagtacttggagcctttcttaaattggacaccaggataaacccctcttcccttctcttccttcttctaataataatgagaaaggtaagtcacatctagtgccaggctgggcagcaggtgtccaagctgggcctgtcttccccatacatgcaaagccatgtttctagattgtgcaggactaagagccggtgatagcccagcttactctggggcaggatttctaagctcacatgcttcctgccatccttccactcctccactcttggttcccccagctgaatcctcacaccattcaccaatgtctgccactcagctgctgagtccctgccaagactgaaggggcgccacccctcaacatactgaaggggaattccaaccaacatgcatatatccacaggggttcttctgtcagggaagcccaggagagaaataactagtccattaacgatttcatttttgttggagttgatccatgtctctatattgtcatagaaatccaataggaaacttccattttaaaagatagcagatgtataattaaaaagaaataaaggcagctcagtggaggctgaactaacagactgggagacccagagtagacagagagacttgaactaccaaggagcaaacactgccacccagaaaatgtgtcccagagagatgatcctggctgccatgtgtgagaagagactcggcattcctgtctgaagataaagacagatagttggggacctatgggacacaatggagggtcttgactgtgcaaggctgcatgtgtgggtgtcagctggtaggagccccgatctggagaagaactgttgcttaaagtgttagaagctggaagtaggtccccagggtaagagagtcttggctactttgggtccctacaggtctgcagctctgggaaaaggggactctgcagtatcatcacctggagtgtagtgtgcagcaatcagaggggagagaactttcaactctttcttggagcttaggccctcagccaatcagaacgctcaaccttggggtctgggttggctttttattgggctcgttccttctgatcacaaacatgatggatgtttattgcatgaattttggaagcagagaaaagcaaatgaggaattaaaatggacccgcgtcatccttccacctaactagactcatttatcagtcagacatttttatttcccagcctttggaaaactatagactgtaaaaaaagagaaggggagaaagcatttggatattaggaatccgggcacggtgaggggcgagccaccacccacacagaccgtgagcacactgcacagacggaacgtgatcctgccaccagaatccttccacagctctgaggagaaaccgaggttggaagatggctgtggagaggtcagaaacaggggtgaggcgctcagagttttacaaccaaacagaagtgagtagcgagaagcttgagcctccagcctacaggaactgcacgcaaagctcacggatgagtgaacatttccatcctcctttccaagttcaacaccacggtgacagttcctggctctggtgggcactcttttgctgatctgaactatagcggtcacgcctgaatccacgtttctggagacagggacactaacaggcaaagtcctcgtcacagctttactggcagtgttgagagtaggcactgtggcccccagtgaccacctttctgtcattttattttctccatgtgtgtggattcatacctgtgactgtgagcacgaccatactatagtgtatctatggaggtcaggggacaacctcaggtgctggtccttgctggtcaggagacaacctcaagtgctggtccttgcagatcaggggacagcctcaggtgctggtccttataagtcaggggacagcctcaggtgctggtccttataagtcaggggacagcctcaggagctggtcttcgccttccacattgatgccttttgttactataattttgcttgattcattgcactttttttttttttttttttggttttttgagacagggtttctctgtgtagcccaggctggccttgaactcagagatccgcctgcctctgcctcccaagtgctgggatcaaaggcatgtgccaccatgcccggcgctcattgtacatttctatttccaaagaaatgcctacatccactacctctgaccaacacagccttggctagcacacaccttcacttatcttgctggggtcacacccatgaatgtctaggtgggcatgttggagcacaaatatttaccagactggtttgggtccctgcattgtctttcatttgacaaaaatgtccacgtagatattctttcattgtcagcaacaatggtttacatgttcgtggtgtcctctttgtgtcttcacatgcaggaaaaactggctaagaattttatatacaacagctaaggccctaacacttgtatttaacagatgaggaagatggatcccagagcttaagcaaggtactgcaggttacacagcttgtgtgtgtgttggagttgggactgaagcagactcagtcagtgtggaagctgaagctgtagcaattcttatggacaagggcagacctgatgatgaaatccagatgagctggcttcagagtctgcatagtttctacctctagtctactggtaaaaagcatttggatctgcaaatcactttatttgaagagctcaaatggcagagaaaatataatccacatcctcagacctgaatgaacaagtatgacgattcatttcagttgtcaactggacacattttaggcttccctgggaagagagtccttaagggattgttagatcaggttggcctgtggatgtgagtggggaattgtcttggttgtgaaatgaggtgggaagccctccctgaatgtgggcagcatgcttttacctgctgggaagaacactgggcacagcagccagcagaaaggcccaatgtgcaccttcatgtctctttgttcttcggtgagatgtgactagctgtcttgattccttccacctagaccctccatcaacaacgacatggaattacaaagccaaagaaacaccttcctcccctaaattgattttggccaggatattttatcacagaaacacaaaacaagacaaaacaaaacaaaaacatctcagccaatgaaagagcatttgaagtagactgattttttaaaaaagctctttctctccctcctccctgatccctctgtatgtgtgcatgatgagagagagagagagagagtcggaagaagccattggatcttattggaactggggttacaggtggttgtgggccagcacatgtagatgttggaaccaaacccaagtcccctggaagagcagcagtcattgctcttaactgccaagttgtctctccagccccacatcactattttctttcctccctgagacacggtgaacttcagaatcactccgtccctgacagaaggtgcagctgagtgtagaacacagactgctgtatgttttgttctctgcattcacagcacaagtgactcactgtgactctgagcagctctttcgtctcctggggcttctgacagttcaaggacagaggcaaggaagaagccttagtatctagagatttttctcatttgctgtccacagtgtccaggaccccacaaagcactcatcagagtgactgtcttgggaagacctcagtatcctaacaccaataccctcacttatcagcaagaatgaagtttgcaagtttgggttgatcaaaaatgaacttaactttcaaggagggctcctgatgaacaggagaacatcagcatcttcatgaaaaaaaaacaaaacaaacaaacaaacaaaaaaaccacaagaccaatcctaagtaatggtatccaaggcttatgctatgggaactgtattgtatatttgtacaaagtactaaaacttctgaagaccacccttccaccacaaattgcctttatacagcttttgagtgcccaggtgcctttaaacaactgggaagtggcaggcctggtagtctctgtttctggcttcctacaacattgtcctgagaaattccagctactaacagcaaaggctttaaagaaccctaggctgctattacagaggatgttattcaaaataatttttttgtggaggctgattttgaaaaaatattgttcaaaaccttacagtgggttcagaagaggtaggtagttctggtgctggtggggttggacagttgctagtgtcaaatcctctacaggaggttataaactctgaacaaaatgtgagaaaaagaaaatatatatctggaagttgggattggcttttggaaggaggaacttcattgagtaagaccaggcctatactgtcttcccagagcccctccaggctgttggcagaaaattgccatgaggtgacaggggacagaacatggacatccatggtgatcagaaatgggggcgggggcagggtgctagaagtgcttaaatgttttaaatgtgagttgatattcatctctcacccaccaattaggagacagaatttagagtttgaatcctgccaacttttccaaaagaacctttgaaatgccctgggcaagtcataaaatcctaggcatgttatactgaggaccaagagaccatgttccagggattaattttttctctcagtttaaggagaaatgttgagcaaggctacattaaagactgcaaagccagacttctacatcttcaagatgatatccacaagtaaccacccaatgatgtcaaagaaaaacaggatccagaatctctgccaccatcagcacgaggaacagcatcaagaagaaattttaaatgggtgagaaaaaggttttaaagtgatttgtatttaaggggagaacacaatgacacaaaagtcaaagtatatcctatgttgtaataactagttaagagcttttgttttcccttggtgcttaggtttaagtccagggtctggcacatgctaaactactctagcactgagctaattgctcagcaccataaaaacttaacaattgcatgtttaaaggacataagtgaaaacatagctataatgagtgatcagatggagaattggagacaacaatggatatatatgaatgtatatgtatgtagtatatatgcatatatacaatatatacattcattcatatccatttatataatatttatacacatatatactatatattttttattttaaggttatcagacaaaacaatgggtttcattgtgtcatcttcactcataacataagcattaaactctgctctcattgcccccctcccccactgtttgctccagcaccttcccacctccagctggttcctctcctttccatacacaatctcctatctgctttcttaacacatgtgttccattatcctctctacttcccattgtcttagcaatacatttttttaaagaatcaagtggaagttccagaatagcaacatcattttaaatcttcaaatgaaaattaagcaatacatctttaaaagtaaaagtcccaaattataaaatacaaatatagctggtctttgctactttgtgggttcttctttttcccaccctttatgtcaccctacccctggttttacccccccccccaaaaaaaaactagataggagagaaaaacaaggatagtggggatacaggaaataggaaaattcatgaatctaatttcttttcttttgtttcttctttgaccatggctactagacactgcaaccaatcttcctaaatgaccagcaacaactgacctcatctctcgggtcctagcatttaggtattttctgaaaggttcccagaattccaaacataccacaatcacagagactatctgcagctggcaaaaccacatctctactagagcatgaggcaaatcatagtcagctgctgcagacagtctgaaatagccccacatccctacacctgggattaaactgaaagcatatttttataatatttgtgctttttaaagaagccaagattccaaaattatcgctacacacgcagaagacttggaaaatcttggccatcttggtgtaggcagaaacttcttagaacaagaaaaacactgatgacagaatgcaactgataaattgtttatatgcagcaaaaacgaaaaaaggcatagacggtgaaaatactcagaatctgtctggtcagtaatggatttatttattttaggcatgtataaagatctcttataaattcttaacaagggcagaacaaaaaaaaaaaatccaccctgaatgtgagcagcagcatccttgcctgaagtcgtgtgggtgtggccttcttctttgtcccctctggatctgctgagatatgagcaggcagcctcgcattccacatgacacagccacagggcatctgacccaacgccaagtcctgccatgatgagtcggaccttcaaactgtgagccaagataaacccttgagctgcttcttgctggatgtctgaataacaacaacaacaacaacaacaacaacagcaataacaacaaaccaatacaaggtagaacagatactttaccaatggccaataagcctgcacaggtagacaacatgattagggaaattagagaattacttccctaattaatccccaagtaattagggaaattctaattaaaaccacaatgagatcccatttcccatgtactaaatggccgctatgctaaacaccgtgaatgaaaaatgttgacaaggtcatgaagcaactaaaactggcagactgtcagggtatccatgctttatcggcaaaacgaaatattttattattaccaactaggagatcgatatatggtacttatgactattccttaacctattcctgagtgttttatacactctgatgggccatgagaggaacaacctctcctttttcgtttcacattgttgtgaagaaaggaaagttttgtatttggctcacagttcagggtgcagagcatcctatggggaaggtagtttgtggaagagtgagaccgtggattctcctgcctcaagtcagaaaacaaagggagatgaacattgtactcagctcccatcttcttcactccaggaccatagcccatgagaggatgccacccacatttagggagacccctcctttcccattcattctgactgggattactcttacaggcacacacagaaatgcgtttccatggtggttttatatcctgtttaattaacaaggttaaccatcacaaaggagagtccagaggcttgacagagaccccaaggggtctccatccagatggtcaggattcttctacacctaggtgtgtccctagtgacgagacacgctgctgaagtcttccctgagccatcaccactcaagtaaagtctttctgtaattcacacttactcctctagctcagaggttctcaatatgagggttgtgacctctttggggtcatatatcagatatcctgcatatcagttatttacattatgattcataacagcagcagttgtgacatagcaatgcactaattttacagctggtgtcacagcacaagcaactgtattaaagggtcttagcaccaggaaggccgaggacaaaaccgctgctctagagaaagaatactttccacgctgactcagtaccagctctgagaagcaatgtgtctgcattttgtcaaatattataatttactgttaaaataaaatctgattcttctcatgaaaccctaaaggtttttaagtgctcactttccacttcccagtccaaaatcctggaaaaattctggcttctattccaagagagatgttgagagcaacccctaccccccccccccccacacacacacaagagtaaccagagtgggcatctgtccagtgatcaaggctgaagacaaaagggggttagatcctttctcagccacagagttgggggtgggggagataggatacctgctctccaggcccccccaagactgacctggctttagtgccaaaagcccttcccaggagatcctcagtcccgagcaaacccagatgattgcccacctggctgaggaccaagatctgctgactagagaccttgggtcattgtcaaacccccaactctcaagcagtctttggaggacctcggatatagtggttaataccctttctgatccagccagttctcctgggttgtgttattgttggtatgccctccccgatccctgcccagacacacacacagacatacaaaatacatatacaaacacatacagacacacacacatagagacacacaaaaatacacatacatatatacacacacagacactcatagacacacacacagagacatacacacacagacaaacacacatacatatacagacacacacatacagagacatacacagacacacatacatacatacatcatacatacaaacacacagagatacatagagatacatatacatatatacaggcacacacacatagaggaacacagaaacacatacacacaatacagacatacacacagacatacacacagagacatgcacacatacagaaacatatacagagacacagatacagacacacacatacatatacagaaacacacacacttacccagctagctgcccacaccccatatcttactagatttcaaccattctgtggaggtattactgacgaatgcttcccatagtctctggcatttgggactgtttggggaggctcatggaggctcatgggggtgtgatcttacaggggaaatatgtcatttgggtagtgggctttgagctttctgagcaatgcatcattcccagtttgctctacttcctgcttgtgggtttttttttaaagattactttattaattatatataagcacactgtagctgtctttagacacaccagaagagggcatcagatctcattacagatggttgtgagccaccatgttgttgctgggaattgaactcaggacctctggaagaacagtcagtgctcttaactgctgagccatctctccagccccctgcttgtggtttaagacactaagctgtctgagctgtcatgcctgcttgctgccgcacttcctcatcatagcagcaggggactttatccctctggacctgtgatcccaagtaaccccctccttctaataatagcccaggtcatgttgttttgtcacagcgatataaatgtaactaaaacacactctcacctgggccccacagtgctcacctgcaacctcagcacacaggtgggagcggcaggagactcactctcaaaacacctgcagcctctggtccccgagtacaactttgttatcatccagagcctcataaaacagagacataaggccagaggaggggagatgggggtgggcagaagagtcattctgtaatatagagagaggaagggtccacagacaaggagtgctaatagcctagagaaaccaaaacagagggaggcgaaagctatctgctggtaccagacccatggcaccttgactcctgctagtgagagttatttcagcctcctgaactgtaccagcaaacatcggtgctactggaagctcccaagagttgaaggcagcatgggaaagacgggtactctgcaggagaagagcaaaagctagaggaaccaagcgggttccttaagccacagggaaatcccaggaggtgtccagacttcctcctgctgggaaacagcctccaaatactggagcctgcaacccctcccgaaagtcccctgggccaggcacctcggagcccgtggctctgagagtcattcagcatctcgcttactgtgcccactctcggcctaaatcacccagctggcgggaattgattattctataaggcgaaaaggaggacccaccatgcgagctgcagtgcatgttgggaacagggccaggccaaaggtccgaataaacagggctgccaggtacccacctagagttatatcccaggaagaagtccagacaggcagcactcagagtaggaactgctaaaggctccctgaggggctttgctttgagggccataggccattaaggcatttaaatcacagtgtgtgtgtgtgtgtgtgtgtgtgtgtgtgtgtgtatgttcatgatggttaggtggaggtggcggtagaactgggccaagggtcttggttcataggtgtcccaagcaggtatgtctcaaaagatggtagctagacatgaaatacttcttgctggctcatttctttccagcctgggtgacagagtgtggtgtgggagagggggaggggaggtacatttggtcacagcccttgtttaccaaaatgtcttctcctgagcaagaaaaaagtcccagaataacgcaggggtagggttggggtagggtgtccttgacctccttcagctctcttggttacaaccgtcaaaattgtccttcaagtttagtccccaaaggcgtcagagcttgacaaagatgaatggggaacagctgtcccttggccatcagaatcgcagctctctcctccctgtgtggactatgggacatggagagtgtgttcctcagtctctgaggccagacaggccagactctggtcaccaaagtttagactcagccactattcggaaagcggtggcccaggctttccctgacacagttgagcaacttgaggccttgggaatttgggtgtgcctcatatgaggaactaagccaggctctcacttcccagtgggggctcagctctactcccagagtccctgttcccaggcccaggatacaggcaaatggagctccaaccaggagccaggagccccctttcaggaattaggggaccacttgccttcctacctgactcatccttcccacctcaagggcatggagatgatgacaaaagccatgtccatctctagtcactgttggtgacaccctcctcctctgctgtcctctgcacagtgcaatcccaggctctcattgcccacacctttgaatgtccctgggctctggaaagctaagagtccagtggagctagtgacttcactatgtcctgctcagggcagctggcgctaaaggaacaggtgtgtcccatagagagctgggccttgcctcagttgtcccagtgtggactcagagcacctccatgtccagctaaggcctagcccatgctgtgtcctagatacctgtggttaggagggacaactcaggtgctcaccacaggttctaatcccagcaccaggactttcctttgccctgggggattgtttaaattgagtgcctcagttttccccacccctacatggtgatgagtttggggtgtttttgaaagctgcatgtgagggttgaataacactggagaggcaagggccacatctggcatgaagggcaggcagggtgtgaatgaaactgagtgtggttctcagactctcaaacagagggccagattgattaccacaaagtaagtcaaggtcccttttaaatacctggccaggctcccctctgagcagcattggctctgaggcatgaacagatggcagaagcctttcctggcagctcagtgtggaggcctcttctctgggggctggccttttctaggtcctacttctcttcttccttacatctcctccgggcaaaagctaatcctgtcatccatttaccaaaggggaaactagggctcagagaggttgcaaaaattgtcttggtggtagagtgactcagggctgtactgtgaactgtcccctgtctgttatggggtctgctcactgtggtggcctttgctgcctgggccagggagaggcaggaccaggaactaaggccaggacgtaagacaccgggaccacgttctcacatcactgtgatctgtaggtagacagcacagggccccactcagatgggtactcttcccgggaccaggaccgaggaacaaggaagatagcatagcagacgtatgagcctggggttcatagtgattcgtccaaaggaccttgtgccaatatgctcaggcctcatgcatctgtccctctggggagatgtggatggtcttccctagattcaccatagttagcaacacacacacacacacacacacacacacacacacacactggcagcagtagggatgcactcagttgcctggtgtctggtttcttaagctaggccagggaacttttatgtagaatgttaattgggctctgcctggcccaggatacctggctgtgacaacaatgtccccatacttctactgcctacctgcaaggaccctgcctccacgttcacttctggtaggttggactgaccctatatctaaaacgctagcgtcctaatattacttttaatggtgtcttgagttgaaaatgatggagtctcaaactactgtccattgctccaaattcctaggctgcccagagtttttgtcttgtttgtaataacattttattagaacacaatggctctcctctgtgcatcacctctggctgttgctatgctacactggcagagaagctctaagacactgaagggcctgcacatctaagataatttccagctagccattttgaacaaaagtttgctgaaaaatcaaaactcagttggaagtttgattctgtgaaagccttaacagcgtggggaagttatattctagatctctacattttggatcaatccaggttctcttgagggaatgaatctaatgctgaagcaagtgtggacgagggtgcgtgtgtgtagacgtgtacgtgtgaggattagtagtgggcagtggatgcaattaccgaggtgagtctatggattactgagggtgaagttgaagccagagcagagctcagactcaaactggatccccggacaagtgtattagccagggctcttcaaagtagagaatatatataggatttcttagactgcttacaggatatagcccagctaatccagcaatggccttttcacactgtctcatagctcccatgtagtgtcctggaggacccctggagagacactggcttcagtctatattagaatcccaaagaagttagttctaatgttggtgatgaaatgtagcaataggatagatggtcttgccagaaggagtgaggctaagtaggcaaaacgcaaagtttccttcttccacatccttttacgtggtctgtcaccagaagtccagcactggggtaaatattcctgcctcaaaaaattgataagaaaaatcctccacaagagttgcccaaggcttgggttttagctgattctagatgcagtcaagatgacaacagagactagccacatagcacaccatgtcctcccataagcctctgctcactcacgggggaagcatggagctaatgccaccaaccacccagggctgctgttgtcagcaaatgatgtcagatatgcagaactcattatgtggagcctttccagagctccccaaaactattcacaggagcaccatgacagttcttaggagggtgtctagcacgtgttaaatactcagtcggctctcccccatgccaaaattattcaagacactcatcagtgtatttggagtacagatattttaataagacgatctccttttttttcctgggtgtaaatttggatcatcttgaggatgtgatctttggccatagcttcaactatgcagtagtccgggaagcagatggtcctgtctgtatcccacagactttcagtgactccctaggcaaggtgtacaagactcctgctggagctagcagtgagacattttagattccccagggcaaactggagaagtcctgctccctgtcagcagcgagctctggtagagacaaaggagtttatctgccacagcctatagattttattgtagcccgttgccttgtatatttgggggctggggaatggggttccttaaatggttactgagccacaggggggaaaggagggaagagggtgggcagctgctctttggccctacgatggtgaacttgcctcattaatcagacctgtgctggaatacaaggttgttcatgttcagggaattaaaagttgaagctaaaagtgtagcaggaggtaatcggagtgctggcagcctgtctcctgccgtagatttatggtgtttactcaacagtggatgggaacttttggggaaagaacacctctcctccgctcttttttcaaaacacatcatcagcccgcagtgatcaagttcccgatttccagtgtgcagagcgcgcagtgcatttgatcttccttgttccacgcccagtggaaggagggggaggcgcgcagctacaactaggagttgcctgtgagggatttccttatcggagtcagctgactctgacagcaaccctcgcttggcccaggcagttctgtaatgtgccgcctctacactgtctaaaggtgaaccaggaaccttggtcaccttgccacgccaagaggagcacagggaattcctagaaaagcccccactcctcttgttttgcttttgggtctcttgtggtgacagttgtgagcaccaattgctggtgacttcagaaaaaccagggatccccttttttttcaaggtttcccacaatagcctcacatgtctgtcagtacaggtaaatggctcccctgaaccccagagaatgaggtcctttctggaagaggctcatttaggatatttcacaaagagcttttctgctacttctcttggatgcaaagccaatgagtatgggagcccatgtacttctgcatcatcccttggtacagacatccccaaagccaggcaggagggagctctcaggttggctaccttgccctctggtttccttgggcctggggtattggcagtaatcatccatacccatccatctgtttcaaactaacttaacatttagagctgtcttgttaaacaaactcatttcctgcaagccagtgcaaaagtattttatggaccatagatttccaaatacaacgtttgcattgcctgatatcctaggtcaccatgaaaggacacaggaaggacaatgagtgaacacttatctatccactctgcaagaggagcctggttgttgcaatgtgcagaactgctttctagcaaagccagagcactccagacgttatctccaagtgaggtgcagaggaccagaggcctcacagtggctgtgttttcctgcagggcagactcttgcttgtgtgctccagggcctggaaacagggaccaggatgctaataatttacaagcagagataagatgggatttggaggaggtcaatcagataagaatgccacacacatacttagaatgcagccgaatctttccaatactgcacacgtccatcacacatacacacacccatcatatgcacacagctatgcacacatccatcacacatgcacacacctgtcactggcacacagctactgcacacaaactgtcacacagcacacagctactgcatacatccatcacacatgcacacagctaatgcacacatcctccaggcatgtacatatctactatagacaccatgtaccacagactccagacccacttagacacagtgtatagataccacacatacgaacatcacatacctatatccacattatacccgtgtcacacatgtaggcacacagtcacctatacacatgtccacccatggacccacctaccaacacaggcatgggtgtgcaaatacacccaggtacacacatgccccagacatgtaccacatacccacacatgcaccatagacatccattccacagacactcagttcacatcatcatatgcaccacatcctatgtctcatgtacacatgcacgatactcatatgatcatatctccccaccaacacacatacttaggtgtgcacactcattctcatgcctcaaagttggctttgcttctgctgaggcagccctgcaggaggcagataagctgccaggtaacccacttccttcttaaagagacaaagcggtataagggactactgtttgtaaagtaacctgtagataaaatgagaaacaaggtttgaggaaacctgtgccagcctaggtcagccttacccagaccaggacctctctgagttactgagcatgcgtgactgtgcgtgactaattaaggaatgttggtttctaattggcatgaacagggtatcttcagcaaactggggaccatggacatctagagaggtccagaagaccaaaatggcaggatagcgattggtgtggaggaatgttgcagatccacgactatttttttttttttttgacaatttgcttttctttctctttccctcctcaaacaccagcaatgactttgcatagtttaatcagcccatcctgcctctgtgttgttactgattctcaaagttttccccaccctagccaagagagaagaggcctgcctggggcacaggagtctctgtctgacagcccgctccactgctcagcctagagccctgcagaactgagctgccctttgctaactgactcagtctgacctccatgctctcaaagtcccctgggagactacggaagtggttgattctggtgccagtggtcaacactggtacctctaccaatttgactcaggcagagggctgcacaagtcgagcctaggactgcacaggtcattgacccttcagttatgcctggatgtcattgaccatgcacaggccttttggagggttggttgcatggtgacagctactgtgagcccagatactttggagtttaaaccgaggtacactatcctgttacaggaggtaaactgattcttgctaaaactcagtttccttaacctaaataaaggtaattacgcggccttcagagactctgaaatagtgctggaagccaccagaaaagaactaactggagtctccatagttgggttggttattagaaaggtgactgtttacaaatccttcgactcagacacccaaactgacacatatgcacagggcctctggcctgaaagaaaatggtctttcagccttgaactcgggctggcttttgagattctgctaagtcaagaatatatctatagagcaaaacaaaacatgcccatgattacagaagtgtgaaccccagagagtgtggtgggtagacaccaagaggtaaatcaagtctggcatttggagactatggtcttagtcactgtgagccaagagctcactttccctcaactacataaaggcaaactgacctcaaatgtcctttactctcaggaaagagatgtgtgcttctagagagttcaactagagccctttgccagaagacctcagcaaagataaccaaagagatcctgccaagtctgtgagcccttcatcactcttgacagcttcatcaaagtactcggtgtgctttacttgaaaggagccaggctggttccttctgcctttaaatgcccccctctggagcagaggagaagacattgttcccatggaggtttccactccctgggttgctctctcttcctggcatctttgtgaaagcatgggatcaaagagccatggtttggaaggagctgcccacagcccatggcaccggtgaagcctcccatctcggaagtgtgcagagtccttggcttaaccacggagtcttgctgtggttggcatatatgcagatcgagcttcacgccaacctgcaaacacttcagagatgctaatatgaaagtcaggggaaggagtccaaaggctgggaacaagcgtttcccaaagcaacccgttccgaaagcctgcagaaaaccagacactcgcccatttcaaggaaagccctggcaaggtgttaaactggaccacgagcttttgggaagaacgtggtggtctctgggaggcaacacaagttctctgagagaaagtcattccatgctaacctcatttcctgttttgacgagcttcaccagcacaggcgattaggggaatgccccagaaagtgtgtcttactttcagtaaagcatttgaaaacctctcctcctggcctatctatgtatggtcccaggtgggctcaatgacagtgagtctaggattcacaatcacccagagaagactgattcatgaccacctggtgcacctgtgacctgttgtccaggccactcaggagacctcagattctttagtgttccttccagggtcaagtgtggtctggaatgactgctcttctacccactggggggctgaatagtgagagcattagcctgaggttggaccccagaatgtccccaagagtcatgccccccctccctgagaacagtgtggctcttgcccgtgttttaacccatctatcttttttaaaaatagcttgcaaggagacacagaagtcatatttattaaacttgcaggtcacacaagaaagaaacgtccccaggttcaagggctaagggtgagaagatcaaggtgagacacgacacagtccggggaggctggttacacaacctactgcagggcttttaaaaacctctgcacatcttctctcagttatgacactgggaatataagtgtggcccaggatgtgaaagccttaaccttcaccttctaatccttaaaactcctttcagggaagtccgtttgagaagcaagcagcgttctcaattcctcccttgcgggtccaagggccccagtgtgagagcaaaataaacccaagatgatacagtgctcgaaaagggaaagctctgaaattcaaaatagtattattttctgtctaaggtgctttccctccaacttgaaaaaaagatagaaagaaagaaatctgacagtctcagtgataagaagaaaatgattcagctttgccttctgtctcctcatctcaaaccccacattggtagagctggctcagctctctccctgagtctgttgttttaaaatttaaaaaagtaaaatttctttgtataggtgtgtttggctgcatgtgtatattatgtacataaggtgagtgcagtacctacagagaccagaagggggcgtcggacccaattaacgaagatggttatgagtcaccatatgggggtctaggaatggaacctagatggtctttcaaccccacctgagcctatttcaaaagctataagtccttgtagtggcactcccatctctctcctctctattttcttaaattcttggattacaataaatacacatgtaggctcagaaggctcctctccactggccttggactttttgcaaaatattttaggttattttcaattctctagtgtagggaatgtttcctttgctgctgcccaagacctgtctcaaaatatagataggtgcttgaggcaggagggcagtcaaaatatagataggtgcttgaggcaggagggcagtcctttgcaaagttaacaggcagagagagctagctcaaacacctatgtgacagccagaatttcccttatagctaagagaactcactgctcccatgtgccagactagctcctgtacttctgatgaagctgcctgttcatggtgtgtgtgtgtatacatatatacatactttttcttctgcattgtttaatacgacagctgcagttacaggagacacttaggttaaaaaaactaaaaatcaaaaggaattaaaacctcagattctccattgcattaaacgtccagtagccagaatgtccccaagagtcatgcccctccctgagaacagtgtggcccttgcccgtgttttaacccatctatctttttaaaaatagcttgcaaggagacacaaggaaggatacggtagcagagaaggtggtcctggaccagtgctgcttagtcttggctacatgttaaaaatgtgtgtgaagggcagagagttgactcagtggctagaacacttgtttctctgccagaggacccaggttcgattcccagcacacacgtggtgagtcacaactgtgtctaactctggtcccacatcctctctgatctcattggacaccaggcacacacgtggtacacagacatacacgaagggaaaaaaaaaaacttaagcacacaaaacaataaaaaatttaaaataccagtgtttatttcacatgtttcctacttccaaattctgatgttgggtccagatgagttcctggatgttgagaattttttggttgttgttgtttttatatataatttgtgaataattgctctctctggtcagggtcaaaattttgcctcagtggcaaaaactaaaactatatagccaattctcttttacttttcaaaaattatccttatgagtgaattatctagtcaatgctgtgtgcgtacttcaggtcttcctgaagcctgagactctctttattgctgctgttaccataaacaccctacagagtagaggcgaggccatgagctgtataggctgtgttctgctatacagaacagggaaagctatctgggagagacatgcttactgctgctgatgcccagagatacctccgtgagcctctgcagggcacacgcacagacctatgtctgtcactaagctattcatcatgctctggaccatcatctctgctccctgtgtgacctctccaattgcttcctctcggtttgagcccaggcagacaggaaaaacagtcccagggtgctcttttgaggaaagctcctccaggagacactccaccgaagacttacttcaacaactcaatggtttttttgatcttctaggaatatagtcaaataaacttggacttgacaagattagcaaggagaaagttgggtctgatgagcatgtggatatgacagtgggggagggcttgtgacccacccctctggctgagcagcagactggaggatggcctagagcctcatcctcctgttccagcatctagcagaagtggaggcttatcctcaccgcgtggttacaatacagatgtgcctgttactgagaagcaaggatctgacagacctaggcagcatgtctgctgtagagtgccagattctgtagacaggcttggcgatgagacagcacgtttgcctcttaaagaggaaactgaggggcggggacagtgagacccacagacaataaataaacaacgacaacgacgacggtcacttcaaatgctggtcaatccccatgtagaaaatcagagagataactggcagggctgagggtgcctcgggacttggtgttcaggagagccttccagagtctgaacatttgggagagggctggacaatatccactggtcactcacccagagcctctgtgacgacccccatggccaattagcaaactgatgtagagacgtataaagcagtagacacggccactgagttattcttggatttctgctaagctcagaagtgaaaaccaatagactctgggaaggggactacaaatgggctctttggctacattcctaggatggtaaatttgttcagctcacagttgggggatgtgaaagaggactctgtcgaaagaatgactggccatttaaccatttcagaggatattcaagtgccagtcccaggatctcagaattgaggagtggatttgagaaatcaggacgtcggaatgaaatgcccttgatatacacttgacctccccgttcttcacttcttgagccaaacatgcccaggaggtgggtgcggaggctaccttgccaacagaacgtggtacacagtagaccccaaagaaactattatagatcaaatctacaaatcagtgatttatgtgggggtagacaggaggaaagagagaaagttggggtttccaactgaagcttaaagttgagagtgatctctaggtgagttaccagctgtgctgagaagacatgtccacacagatctcagtgttctccactgtcagcctgccaacagtgactctagagaaattatcttgaaagatcttctagaaaggtataaaacataggataaacatggttgagtgatgagattccagctccacacacttttaaagatgccctgtgtgcagttatgataatcttgacaagtgacttggagaaagttgcctgatgttcaagtttagagccctttaaatcggtgtttctggattagctaagaaacagacaattgcattttctttccttttgcttttaatgaagaaaggatcaagacatggggagggccaataaataaagtaatagattaattagttgattgattaaaagataacaaaccagctgtaagagagcatccgaaaagctctgcaggcccagcacccgtgagcactgagtagctaagagtccgttcccgggtgggaaccctggacgggcctcccagccgtgatcagcaggcagcaggtaggggtgctgctgggggcacgtcctgatttttctgtgtctgtgtcattttcgatcaactgtgtcatggggcttcctgtttcagctcccagttattctgaaacaaaaatatgcaagaaaaacataggtcactgccaaccgcactgtgacagtcactctagcacatggaaaccgagaagggagacagatcaaaaacgctactatgagcaggggatcaaatcagcaacacaactattctcatagtgatatccgaaatccaaccgtggtcatgagctgtggcaaccctttaaaagccattcaggggagagcaggaaggcaaacgttcccagaattccactgttttgtttggggtcaccctgttgtgacttccccatggggtctgatgcccagtaagctatgagattctacttctgtgttcttgatttttactagagactcccacaagacttagaagacaccccaggtgatgtcttgagctcctgcctccaaggacccaaagcaacttcaagtcaagtccactgggaactccaattcacaaggtgcagagcccctcaacacctctcctatctgagactctaaagataactgtgggcttacttgaatttgttccaagtagcctctataggagagaaggagaaaaaataataataagacaagcccctccacacacacaaccaagcagaggttgcaaggacagtatatggctgacagaagttccagaaagactgtagttctattcataactgcactgctgctcaaggcccctgtggtcagcctcccttggtgcacccctgtctgcagatcacatcctcagctctccaaaacaagtgaaaggatatttccaaaggcagagcaggtagagagaggcagatggtgccgtgccctcaaaaggtatgctgtagatccagagcctgctctgcactcaaatctgcctcacacacacacacacacacacacacacacacacacacacacacacacactggagcagttttcccatgagatggttgaagacaatgctcccatgggaacaaggttaaatctaagctggccactgtttccagctctgacgctgaacaacactgctgacagctgagaaggcagtaccactcaaaacttcctgggacatctccctgtgcccccagtgggataccagcctgagttcaccctgagctccaaaggactttgcactgtccacggccttttgttaatgacccacattttttctgcaacctcagagcggggaattgcatgatttttggaatagctccatctgtccccaagagatcccttcacaatgcataatatacaaaggatacaagaaagaggaaatatgcaaagttgctcagacgggtgtattgtgtgtttcccgacatgagtgttgttgctgcgtggagttaggaaggagggcaaattgcccagccattgagctctagctgagctgcttctaaggaccctctctgaaaaacaaagcttcctagagggtccgggctcttgacagcagcaactgtggtaatttagtgcctttgttattctttaaaaggcccctattgtcagtggcagtggggaagtttctggaagctggggaacctgtctgtgtgacacctacacagtcaggggaacagcatcccctccccaccccctacccccacccatgaatctcttgggaaaaccagcttcccgttttgtgtcctgtgagccagcattttctgaccaggctcacagtatccgccatctggcccaggatttcatctgcagcgccttcctgggtgggcaaagagaaacaggaactgggtgacgcaccagtggctgacatgggtggaaggagaaactggcttcctctagttctacccatgaagcagagatagatagccgactgccctgtcctcaccagcctgcctcttcttagtgggatgcaagagtcaaatggaatagctcaagcagttacaatatggcactcccagccaagtgggtactgaaatcgcagagaggggatagggccttatagacacagcaggctaggccatagaaggaggaagtggacaccctttccaaggtcacaccagacggggcacaagtggactaagacttgggtctttcccacctagttcccatggactagtggccaaagttagtggtaagtccagcttaccactgcagaacctgaataagctggcctgggagcttttgcatggatgaaactaattcctgtgaaccctatattggatgcctacctagctttcattggagaagcccaggctagtctatttggagactataagaagtttgttcccaattctcagcaattctcaaggacatcttccataaccaagtggacactgaaagtggtggagaccacccattcctccccagtactgggttgagcctgaagggacacctggtcacatgtagggccaagctgctctctgctttggtgagctttgctcttcttgtgggtctttaatattcactattagcaactccccatccccactacggatacacaactttattttccctaagacattatgaacaatctgggacccacgaataccatactgaagacaagtactcattagggaacagaaatgtagttcaggctagaggtgaaaggtatccatacagagaatgaggcatgagccctcaatgtccccagcttgtctctcaccaaggttcctctgtccagagctacaaccacgtatctctaagcatatttagatcctttcggggcttgggtgatgtgacttagcttctacagaatgctcctggctcagaaaatgactatgtataaagactttcaatgctctaaggcagagtctgagtctctcccagagctgttctacctcacccagctcctctcatccactactgagtacagcatcccatctgccggagtgtccagatgtgtggttttcacccaagccggcatccatcctctcagaaggatgcgtgaaggccatctcttaccaagcaggcagagccaaaagcacagggaacccaaaatccagaggtggagcttgacagtcatacccaggttcccacccagcatcctggtcatcacattctgatgccagatgctcatggaaaattcaataccagagcctcaaggatctcataaatgggctcaccttttagtagtccttgggtaccactaaggacggcctcagagtacaccaaaggtaaaaatgggcaaaggatccacaaaggtaaagatctggtctcccaggttatcttctggtctcatctgtccacatccttcccttcgacttccttctccagatttgctcattaaaatttttttcaaagaacaaaacctggacacttttacagatttatatagtctgaccggccttgtgagaggacaaagttacagacagtcccatggtcactaagaaattcaaagggtctttgaaaagcagcagtcacctccaaggttgggttggaacatgtgagaaagacctcagccttcaagacaaacaacaacaacctagagccacgatccttcaaagcaagccagtggcctctagccctggacacagttctcagtgcacccaggtctggaccagaccattctctctacagcagcatgaaatcacctgaggatgcactagatatgcaaaccctcaagcttccccctgtgtcttctgatttggaaactctaagggtaaaacctgggttgtcctcacagcacccagaaatagaaatagaaacgcaagggccaacagtggcaagtgatggcttgctccaagtgacagtcttgaacactagtgtagtctccaccgaccctactggccacacttagtcaacaattagtgtctggtttcagtaactattctcaagccacccagtggatgggcctttccagaaatctttctgagaggacagatgccaggctcgggtgaaaaatacacatggatctggacagatgggatgctgtactcagtcagtggtcaaggagagaagctgggtgtgttggagcagctctgggagggactcaggctctgccttagggggttgaaagcttccatataattcacggtgggcaggaaaagtggagaactcagaaggcttccaaggcttgaggagactgttgagagaagagcctccatcttctgcttttgatattgggtatctgcacagcacagacctgagctggaggcctctcaaatgcaggatcaaatctcaaatctcctataccaaactgttcaaccagccaagacacccatcactgcctcctctccccagtctgcatagacctactgagaatagggggccctgaagtctcttggcatttcatttcaataagaacagagtcatgccatcagctccacacacattactgtcaccctaggaaggagggtagatacaaagtcacacacctcttagtctggtcatttgaagtgtcagagcataggtaccaggcagaacaaagtactcatactgagacaggtagggagcacagaaggacaggccaaaaatgtagactgaagagaattgttgaacaacaataacaacaacccaaagcttaaccttgtacaggaagtataagaaaataaagaacgaggcaaagaagaaaaagaagggaaggaaggaagaaagaaaaagtagaaagaaagagaggaagaaagaaaaaagctaagaaattgtaggtacatgctgcaggtaagatattggtccctcagtttccatggttacctttgaagatttgggggcataggcaagagtacttggggcctggggggactcacaaagccaacaagatgactgggagtacatgaaacacaggctggttagataacagtagaacccagttttcacacatagccttccctagggtgtgagcaccctaggctggggaacagaccttgtaagtccggcctctctgttccaggttctgaccttttgtgtgtttcaggtgaagaatcaagacttgcaagattctgaccacaaagtcccctatccccacccgcgcatacacccctgcacaactgcagtgtctggagaaagcctgccagcccggccccctgggccacgcagacctgcagaggagcaagccaatctggcccctttagcatcacagacaccaccctgaggctacctgaggcaggaaggagggagggggctgccttctgagagcaaaccaggtgccctctgtgaaatgtggcctgactggattttgaaaaacatcaaggaggtgtgtgcttataccctacacgggaggaatagagaagagacaaacagacccaagtccaagtttcctccaggtcacaccaaatagtagaagagcgggcattaggaatcctccgcccagcaataaaagtcaatagtgtaacatgagcaactggttgaaacgcagcgactaattatgtaactgtggaagaaagcaattactcaaaggaaggcgggaagaaagaaagaaaaaggggtttggtatacccgaatcttaaaaatagaaccaaaggcttaaagtcatacccagttgtctattgtacacccctcttttagctgctgaaaaggttaataattttcctaccgaaactgaatgtgggttgtgaaagagcattgaaatgaagaaaatttccccgcggctgctaatgtactatcagcaaagccatcgggtttcagtttgagttgtttgtatttatttgtgaaaacaaagatcagatcagcagaggcctcatcctaactattgtcctggagtgtctgagtctctcgagatggaaaaaaagaagaccctcacatcgatgtgtagacatacactcacacacacatacacacactcacacccactcacacccactcacacactctcacacccactcacacactcacacacactcacacacacagacatgagaagtcaaaacaacagcttagggggagaacctgtttacctcggttctatcatttgaagaagataaagtattgcctcgtgtaaaacatgtttgttctcagtttggctttgtttgtacttttaattgttaatttcttgtttatttatttattttttgtctattgtatggtcaggtagaaacttttttttaagctgtaattatttgtttaatactttcagaagtgaaaattcaaccataatataattctgtatagaagacttagggggggaagtgtaatttaaattctcctttcaaagatcaaaaccgtgagcttggagacctttcagagcaggaacctggatgaaatgcagaagttcaggtgcttttaaccaaaacctgtttcagataccaggtgaacaggttgttctctgaagtttgaaaagaaaccagacagtgaagtggttaatgaggccgggagggagcgcagagactcctctgcgtgtatttccatcacaacataaacagcagaataaaaaaaagagagagagaaacctgcaaaaggaactctccagtggtctcacatcaccgaacaaactgtttttctacctattttgtgttgcgggcttttgttatcaacccaatcggcaaattgtggccaattttgtcatggtgtaagcagacattttgttcccaaactgttttcaacatttttgctaccaattacagtcaatgagaaaatgaagaagccacaatgcaaacagaaagggtacttcatctgcacccaacgaaccccttttaaggttaaagatgcatagatgagaacactggtgtatattttttaaaacagaactctagtaaattcatattctgaaacaatctagtaagccttttgtgtgtgtgtggtggggggggaatcattaatgattaatctgctgattggatttttgaaaccagcaaggagacattctcctgtctaaccacgctgagacactaagactgcctcatttaatgacatgctgtatcattattaatttacaaaaaattacagaaacaagataaagcttgaaaatgcagatgagactccctgggagtcaaatgaattaaaccgaggtaaaagaaaaataataatgaaaaaaaaatcaccagttaagctgttatttactactgaaaataagcgacgcccacggagttcaagcaatatattaatattgaaaccaaacggcagccttacaccacaaatcatttcattaaaaacaaataaagaatggcacctagataaaatgaaaacgcaaggctttatatgataagaagttaaatattaagatcaggacccgatggaaagaaagctggcctgggttttctttctgcctcgttgtttttgttgtggttgttgttgctgttgttctgtgtatcactacaagacaccgacagcagaggaccctttcctaaagattcaggaatggcttggaaggcgagcagaatgtgagtccaggaaaccctgcttgtcgccgtccctcaggtctgaaggcacagcaatgtgtacatttttagccctttaaaataccagcatgcccacacactgcctcagattaaaccaaggagaaaatgacacattctgaaactattttctacagctactttcctgataacactgaggcgcttacaatcgaattaatgagttcttcaaagcccaaacaattgtctacagagagacacaaccgttcactgcagcctgcacatcactctcgggtctccaggcaattctgcaagtattaatctttgttatttgtgttcagaaaaattcagggttacacatctatttcagacaaagacgctgctcgttgttctggatagttaaattgaggaacactttgaaaaaaaaaaaacccacagaaacaccacagtgcttccctgacctcagacaatctaggaattggtggattcttgtcccttgtgcctaggcacaacctgttcacatttgaaatttcttttagtagcaaagagaggaaacacccacagagtccaaggagtcgttgtttctttagaaagtcaatttctgcacaaacagccacccagaaataaacagaggaggtcccaaaccaaacagcaaaaaactcaggaggatggctgcacaaagagattgtcagaatgcttagcagaaggaatttttatttgtgatcgagctaaaagattcccagtgacaggtcgacactgcttctggtgatgtggaacggatgcgaacaccagtgagttaatatcttccattcatgagtgatgtttagcaacctgcctgaaattcagaaacgcttcttgctctagttctctcagccctttcgagactgcgtcccaccaagcaagcagtctgcctcgtggaagacaccatcgatgaacaaaagacagaggaacttaacaatgctgtagtttacaagtgacagggaatttcaagacaaaagaggtcactggtgtttgtcattttcggggagtgtctggtgagaatttgactttagaatactctccctgtcctcacttagcaaaactgggcactcaaactcagaagaagcctgccaggagcacctaccgccctctgtaaaaccacacccagccccaccgccccgtgtgagacttgggaaatgatgatggttttagtcatctggaaaaaaaagcacagcatgacatgggtttgaaggcttttcttcagaacctcggtccttgtcaccctgcttcaccacaacagaaaagctcaagttcacactccactctgcttgtgacccgggaatttcttaagagcagggtggttacacagccccgagctcttcctgaataaatggtcaagattttatcttaaaaaaaaaaaatcccattttttgggaaagtatatataaacgtaaaagctcccctgtatcaaaaattaatgttttagcacaattatttgacatgtaacctagctgacttcttgttattttttccacacacacaacttgaacttgttaacaccaaaactttttaaactttgttttgttttaaagacatacatatgtataaataaaatgtggtttacccttacgtttacccttttgtttgacgtcaagttatcatttataaaatgatgataataattttgctaaaacaatgtgtgtttagaggttagactggctcagatatagagttgggtatagatattatgttctttctttctttctttctctcttttttctttctttcttttttttatgagatttttaaaaataaaagtctataaatagctgcaactgagagacaggagccagactagacaaatgtcagaaaagcccccgagtcaggatgcttatcctagaagctagggtctcaaagcactgcactgtttgtttgtttttctacagagaagaaaataaaattgattttcagtgaaacattaaatacataacaagcaggagtttgaaatacatgtaagattaatttatgaggaaaggcacattatactcctgcagcctgcccctgacccagctcgctggtgcctctcaccgtgcatctgcatagcaaacaggttggctctggtggtaaactcaagagtatggctaagctgaagggtggatctgttaccccaagtcaaaggcactgtgaatgtccctggaccctggagagtggagcatgcttctgagagtcacctagccctttcattgatgatagctggaaagctggggcttaattagctgtagggtgccaaccaatctctttatcaaagccagctgaaagcaaaactgagagacacagcttgtggtttcacaaaaaatgtatttacatgaagagtattttaaagggggttcgatgcccaggcacgatgccatctgtgatgtgtggtgaatttgacatttaaagatatcagaggttgtcagatgtacctgcctccagtctatacttagctgacatgctaccgcccctgccagcaagccttgttttgctgagttccaacttagaaaaaagactcaaccttatttatttcacaccaatcctctcatagtctcttacttacttcctcgcctaagatctgtttggaaggaagtggagccgtgggtgaccaggggaagaaaagccgactttcatgttgttacagggatgctggcagggggaccaaaccatagattccagagttggtggacagagttataaatgacagtggtgttcctccatcgtggctcacctcctcaccccaaattgtctaggaaagagccatctttcctatctgccaaggcatctctccttgacttttaaaaatggctcatggtgtctggagaaaccccaggtgaccccaaacatttaacatcacttataactgcatcaacagaaattacaccatatgaagagccatataagtccctgataaacactggctttagggactcttcaatgggggaactcagatctcagaggccctggatcagtgtgcagcaactaagaatgaaggcagcctgctttatcacaagaagtcagagtgactcgccgctaactcaccgccagtcgagtgatgtttgggaaatgtgtgagtcactgtcccctcattttgaagggtcatttccctggttaatttgttgggaatgaaacttgagccagaatatacatcaggataaacccccaaaaccccaaatagaattcctaccctgtaaccaacaacaccctgcctgtcagagcctcatccctgggatgtacagatacttcaggcagaagggacatggtccttcaggctcctcacagcccttctcttttcctttcagctgtggaggttgagggatactgacccaggaccttaacacaagcaagggtttatgtgcagtggctgcgtggctttcaaccgatgtaagagagagtattttacaaaactgtgctaacttgtttctaaagattttttatttttcaaaaagtctcttctctgaacccagagctttccagccattagctgttttttgtaaaatcgtggtattatttcagtgtgtataatatatacatatgcacatatatcatatacatatatgtgcatgtatgtatatcatattcttaaatgattttttaccataagtaattgaaagcttttaaagactatgttgttctgttattattattatttattattgttctaggaatcaaatctggaatgtatatgaggcactgtaccatcgtgtctatattcccagccaggagaaagttgtcttgactctgatttagacattgcacaatgtatgcacatatcacttggcaccacacaagtatgcatgcttttaaaagtcgtatttattcattaaaattttttaaccaaaaagtatacacaaatgtattcaataataagagtgtaaaaatccaacgtgaagctccacagtttccgttctggagagctgctgttactgtatggaagtctgtcgagacatatagactctgggtctggttaattttgatatgtgatatttttttatttgcaagcatgttttgtaataaagtgcataactttttctaaatgatgatgatatattttgtaaattttatctcaataaaattataaaaattatggtttaaaaaaaactttcccttattggttgccctccaaacctaagagaacagcctgctctgcagggaagctagcagctcagggacaatgacagggacggatgacccctgctctgtgctgatcttctgagtaacaagcagtagctttgatttcttctgtgaacttagaggcacgcagacttcactttctaagaattctcttctacttgcctgagttgtggccttcattctagaagttactaaagctgtgtctcaaacgccaaagtgaggaatggggcgtttacttggccccaaccaagcacaggggtctcttggctccactgtgcccacacaccagttctgtgagctcctttgtataccagacaactgacattctgagtcagcacaaagaggtcccagggacagttgatcatcagctctgctttacagactcacttagagaaagacaaacagacatacaatacagcatttctggtggacttgattcaggtctgtgacaactacctgcacaatcaaatgggtaacccttcaatccagtcagtgcaggggactgactcttctccaggttccagccacaggcaggcagccatccttcgaggtgagctgctctggcctctgcccctccctccatggctgcctttgctgttgacactgtccctgttggtttattagccctcgctgcttgctttctgctgcattctgttgctaggctagggaaggaaccctaatcacccagaaagaataacagttgcaatcttctctcagcacagtttggtgacaaagtagaaataatctacacattcgctttgtcatttttttcttcaaaaggatagcagtgtacgccctagagagatgcgagatatatacttcaatcacaaaaggttggataaggtgcctttagaatgaatctggtttcatattgaattgctgtctgtcatcaccaacctgggtgcccgcaggctctgagagcagcttgactgtgggtcttaactaaattgacagtctttatttactcccctcccaccctcagaggggagggggagaaaaagcaaaccacactgtcaaagcatttaaaaacaaaccgaaggaagctgggtttccaagctttaagcagatgttatttacccacaatccgtatccaagaagtcacttggaaaccggctccgttttcctcagcattcatttagaagcatggaatttcgccggtaccgatgacatatatttgcttcttgccagtgataagtgcagggtgagctccgtcttcaccccggtttccctctgtcttaggaatataactatcctaaccccttacatgcctttccggccaccattgctggtggagaccaagctggtggagatgtgcaagtggttcatgcgtaggtgctcgcatcgcacactgaagccaggtccctgtgccgccttgtgttttgagagatgtgtctctcttgctaggagactggtcctcatctctaagtaccacacatgccttacccttgaggtgtctcggatgctgcacccaagtgtcaagactgactttcaaggatgggaaggctcgggtcagaagtgcgttccccaagccatgcttggctcagagctggcacagggtgagtacctgtgggctgggctcaccaatggcatgacgaagcgcatgaatcaatttcctagcttgggactcaactatcattttaaggttgacccagacaggcccgttaagaagaacgctcgtgcttgcccaggctcactgtgtaatgtaagtactctactcatcctcactagagagaaggaaaccagtagaaaacaacggtcagtttgcagcagatgacagttaagttaaacactgaggaaggcccacagacacaagcagcatgtgcctcattctgtccttgtgactataaagatttccttgccattccactcgatgccccatatgctacagtccacacagacacttgaaccctgtggatttgaatacctcccttcttgattggactgtgcctttccaagacagacactacagcagcagttcttaacctgggggtcccggaccctaaccccctttttgggtcaaacaaccctttcacaggggtcacatatcagatatcctgcatatccggtatttacatcacaattcataacagtagaaaaattacagttatgaagtaaatacaaaaataattttatggtgatggtggtggtggtggtgaggtcatcacagaatggaactgcagcattagaaaggctgagaaccactgagctatagtcagctcacctctccaacactgggtattctacctgaagcatcatagcacatgcttctctacctgtctatcccagagatgcacacatcccgagacatgtgtccatatggacactagctcaaatttaaaaaaaattctcaaaaactgccctgatagccttgccagtggtaccttgatagaacacaggggaaaaaactgcactaagattgtttatccaattaaataacatttatcttcagagttttttttttttttttttttttttttttttttttttgtatgtgtaatctcttcagtcaaagccaggaccagtctagcatacctaatccagtgttcttccaaagattctgggggatggagcctagaaaaatctgctcgccagctgagtggcatgcagggttagtccaaggtgtatgcccagggaagcacacaccgtggtgaccaagctgggagctttctggctagcaagggctcttgcctgctttccaaaagcagcgtattagattcgttatttcaatatcagcactattccccctttgagtgtgcaagttccctcctgtttgctgctttgttttttgttttttaaaaatacatcttcatttaaacttcacagggccctgggaggtgaaaggtgggtgtactcagacctgttaactgttcatttgtctatctgaaagaaaaaaaaaaaagcttgtttgaaccaacagaaaggcctgattcagggttcttaggacacagatctcctggcaaaagaacccagagccccgcttcctgattcccacacccatgtctaggagctgtccagatgaggcagcctcagctatttcaggacttagcccatcttaagggtagagaggggaatcagcatagaatggcttcaggccatagaactgtgccctataactaaactctgaggcactatctagtctgttttgaagccctggctttacaccactttccagctccttaggtgtggcctgcatttcccagtcagccacgggaggcctaagggctcatctctagggggtttaataacacactacaaggaaatgattagtgaggctcatcaccagagtacacacgacacacatggcaggcatccaagaacaccttgctcctctggaaattagaatccccgtacttcaccccacattatcaagctccaagaagccaggcccacatctggaaggcagaagcagaggaccactcttccagaaagacaaggagaggaagacctgagagtgagcaatgttttctctgttgcctgagtcaaagtcactttagactggtcccccatctccaagagaatgcagccacaggcagcccatagactcctcccctagctccattgcttggtacctcctctcccttcaagcacccaagcaatggctccatttactgtagccacatcatgtctcagaaagaccaggaggccctctacagccctgggtcactgagctgtgtctaacagaccagaggtggacagagtacaaaggggaggttcctatgcttctgaaattctagaatcagggctacatcggggcttcatgagtcacatctccaatcctagcatttgcaaagcagagacaggaggatgtagaagtcaaggctaatctgggctgactatgatttccaggtcagcttaggttacagaggggaagagagaactgggctggggagatggctcagttggtaaagtatctgccatgcaagcacaagagactgggtttggatccccagcacctacattaaaaaagtaggtgtggtccagcacatcttcagtcctatcctgggagggttgggtcaaaaggatccctgaagttcactggccagactgtctagtcagtgagtgccaggttcagtgagagagcctgcctcgaaatgataaggtaatggatgatggagaactatctgggaagacgtgctgatctgtccatacatgcattcgcatgtgtacacagccatacatacaatacacacacacagataaaccaagagaagaaaggggtggaggaagggagagagcaaggagacaaaagtacacaggccacactcatttcgtgccagatcaaaaatgcgggggaggtgacatttggagcagggcctatctcatcagcctgtggcgcacttgtctttttccttgggggagttagaaggcctgctctgcctgagtcctcctggtcggcttgaagtcctctttgggagaatggcagccatgatcacctgcaaggcctggtgggtccaatgtggcaggcactccattaagccactcaggtctttgtggcttttctggtcctttgccacagaggctggcaggaagctcataccctccaggaggggataggatcctgctccagcgagctcctccagaaaatgccagtgtctgaatcattgtctctgactgcttttcttcctacaggctagtaagggtgggcctgggaagggtggctttgcttaactttttttttttttcatttttaaataatgttctcttttttttcccccttcagtgcaggagatcaaacccaaggctttagacatgctgggtaagcgctctaccaccgagctgtctccttaaccccgcgacatctttctagtaaataatccacatagaatataagaaagtagaatgatgggatgataaacagccagaagaaaaaggagtaaaaaggaaagggattgtttgggaagtaagcaagatgggaggggaattatcacaaacactaacctcctgcagagagaataacagggagagccacagactcctttttgactcaaatattattttgcagagtatttaaaaagtggttacagaaataaagtagaaagattcccactgttctgcagaaaggcatccacaggggaaaacccatctcaccacgagaaggttgctttgctacctggcctcctggagcagtcttagcagcagggcagtcaggaagccaggaagacttatcctcggactgtaaatgtagccagggagcccctgctaatgaaataaatctctgcccgtgggggaagagcacacacaaaaggaggctccggggagcaggagggggcatccttccagcccttttaagaagtgtggttttaatggaaagtgttttaagattagtgatgattctgcaatttatctgaaaagtcaaaagagggtttcaaaatgatgctctatagacttttgtacttgtgactccacaacccccatcgcgtgctccagagaaggctggctggtctccagaacccagactacaggactgcttggagaattttctaaagcactaatactgtcccttcggccagcagccccagcctggctaaactctgagcacatatcagtcatttcccttcactctggccacaaacccagtttgcatcttccagttcctcagctttttgtttcagccttctctgtcatgtcaggggaacacgcctgccccattcctcatcacccccatctctctctctctctctctctctctctctctctctctctctctctctctctctctctccctccctccctccctccctccctcctttgtaattttcttccttttcctgataagcccatttcacactctgctggacactcaaccccccccccccctgtttggaagcatatttctgatattacattccaggacctattctcttggtttcaccccattagtctggttacccctcttttgagcctgctaacttcttcatatacctcctgggtataatcttcacgagtgggcgagctactttctcgttctttttcctgctcagacagcatccgggggagctcaccctctttaattcttgtgagctatgtcctgtgtctttctctccccgcactaggattctctgtccctgcgtactttctagctatatattcttaagtctatgtgtgtggtccctaatagaaagaatttataagaggaacaaagtaagggtgggtgagtgaggtgggggtgggttggcatcagattagaagatacaagcttcttttctctcaacaactaaggacaaaggtagccactagttcacactattgcacaccctgtgttcagatgctgtttgatgtctagtctccaatctacatgaagtcaaacatgtccccaaataatacttaaactgcctgtggatgggggtgaaccaacttttccagcaagatgtatgtcagaaatctaaagatgcactgtcttgccggttgcgatgctacctcatttgtgggtgggtgggtgggtgggtgggggaaacctgttgtgttttgtgtcacccagatagcaatgccacacgtgaaggcatctgcagtccccactcaggcaatttcttcattttgtcaccaccttgaagcaggactgttagtgctggcagtggtcagccatgtgctaccacaaaacatcgcttaggttcaaacagtgcttcctgtcaggaacaatgtgaattgttggtcacagggacaccagcttgtgtggagctgaatataattagtgtctattccactgacatgggctttacaaaaatactggctctggctctagaatgtactatctcataggggagtggaagccggggtggagactgaagggctgtcctagaaatggcataggaaatagttttctcaggtcagaggtgggtgtggactttgtttcatggtgttttagctctctagctaataaagaccacttatagacacctcgaggagggactggggatttagctcagagacacagtgcttccctggcgagtacaaagccctcgactcagcctccaacattgtaaaaaagaaaagattacgttggtaattctcatttatgtatttctcttagtaaaatggcacgcttaacacatacatacataccacacatacacacccaacacacacccctaacacccaacacacatataccacacatacacacacacacacacacacacacaagagaataatagacataagaaggaggggtggctgatggcccaggcctgtagctcagctagtcagcaggctttgataggtcataggtggaaagccagcctgggctgctgagtgagactctgaaactctttaagaagggtatagctcagtggtagagggcctcctagcctagtatgcaagaggcttaggactcaaacctcagaacctaaataaaaacttttaaaaagatacaaataaaaatgttaagtcacaggtcagattctacctagttcaaagttcacataaagccacccagtctacaagacatgtttttcatgtcctcctgaaagagccgcagtttcgctgtagacaagagagcgttactacaaatacaacttcatcagcgaggaaaggctcctggcttgatggcattgtggtgtctcaggctggagcaaacaaccaaaacaacaagttttgtcccgcagacaacaacagtacagaaatgtctagattaaaggttgggatcctaggctgatctaatcccagcaagaagaaacagcccacctagggacaggtgaagtggatgcaaagaaccccacactgaccaccctctgagctagagagtgatttttttttttttttttttttttttttttgctgtcctagaactaaatttgtagactaggttggctttgaactcacagagatcaatttgtctttacctcctgagttctggaattaaaggcatttaccaccacacctggcttttttcttttattattaaaaaattaaactttatttctaaaaaaaaaaaaaaaaagtggggaaaaaaaaccacacatcttagttaaccagacccacagtgtatacaacatgtgtatagtcagagtagccattctgaatggaagttttggtaaattcttacaaatcacatctagctaatattttattacacggtgattcaaacacccaatttccacagatgtgtgtgcattgtttaaactgtgctaatggtcacagcactctgagcactttaaccacatctctgtgtgtccttcagtgtcctgtttccattcacgttgctgcgcaatggacagcagcacctttctctaggacatttttgtcttttcaaactgaagctggccccattacactccctcccccacctcctcccttccagccccgccgatctcgatctccagcttccactctttgtctatgaagtaatctacgcttggtgtctcagaattgtgatcccactttttttttttttgaacattaacaaataccctgaacaccctaagcacaggagagggtgacagtttattggctaccctgtcccgcaataagtaaatccccgttcaccacggccctctccaggtctgctggcaggagtgatgcttttacaatctaaaaaccaaaaggtgatttttttttttttctttttctaattgcacgaagcacaggagcaagaacactaccaagaaacctcagggacacactacatcttgggtttggtaagtgacacacttttaaatctgatactttaaaactcatttcagaagtcaaataacccagcccgccacctccgacccaccccccacgccctgtgaattctctagactctgtcacctcgaaggagggagggtgtagggggttggggggaagctattcgaaacaacaggaagtttctgtggatcctgacattggcccctggtgactgagagcctaaatcagtgagtcattcccccaagacataagaagccgcgaggacaagtgaagtcgattgtttagtatttcaaaataaatagaagaactgacaaaaacgggggggagggtggggggctttgttgataggaaaggcaagatgctttttaaaaacccatctgtaagtgacaagaaaggcaagtcagatttattttgtattatgagggtccttacttattttttttttcaatgttactccacaagaggtattacagggccacaggaaaaatagtttctaggcagccaaatagtaattaataatatcacaggtaagtttgtgtgagatataaactttatgagctattgaacactgcttctgcatcataaagcccacagagtcggtaagtccgtgcagttcggacaggaagtgagtccacaccgtgttgctcttggatctgaaaagttctgatgttgggccaatgctacagcttgtctgaggaaataatacaaaaaccagagccacagaggccacggagtcagatttaggtaaatgtcaactcgtcttaatttctgaactgtctctcttattgggtcactagtgacttggtgtccaaaaccaaaccaaaacaccaaaaagctgaggttggctaacaaaattctctttcagaagcctcaaatgacctgtcgtcatgcatagctgtgcagggtaaaatatacagaatagaaatacataagaacataaaaaggggcagtagctaatatttcttcctaggaacaagatgaaagcaagctcagagaatcagactctgcatttgacagttaagctggaaatccaacagctaagtcccacaggcacaccaccaaagacctcttgtcacccttcttataaataagaacaaaagctggaccctccgcaaaggcagtcaggtgacccgtgagccagcagccgtccccaccaggcttcatgtccatactgtgggactctgaaatcaacaagtcaccagaccacacaccaagcagggcctgctcatttccccgagggaaaataactatgtttaaaatgaaagtatgaccaaccctggcctcaaggctgctcaaacgatcttgaggaagtttcaaacacaccgaattagcaatctgtctgtcttcaattacagaagtactaaaagccaaaattagccgattatgctcaatgcacccgagtttaaaaatgaccccgcgagcttctgccatagaaatccctacattgtcactgcacgataaaaagagccctgggacactcactcttgtccaaccacattgcaggtggcagagtccttaaggacggtgacctccacaggaccttgcagagggtattttatttctctctctctctctctctctctctctctctctctctctcacacacacacacacacacacacaccacgactatatattgtagctaaactcaaggcagccatgtaccaaactcacatgactgtgaaagccaccaccccagagaaagatgacttaaagcaggcccacgggagggtagagtgactgagatggacagcccctggcccccgggggtgagcatcacactttctaatgaacataactgaaattgccattaaagaggatatctgcatatcttctccgcaaccctgtggtttcggagtcctgtggttgcagggatctgcaagaacccctgataactggagaatcaatgtccctgacacagaagcagcagagtatgtagaattaatttggctttgggatttaattcaaataacttaggcctagaatagaagacaggcagctggacgttttgctttctggaacattccatgtagtgggacctgacttaggtgggtgaagttcttgaccctgaacagaaaataaaatgctaaaaatagttctgagaatactgcctgtcttcatagccaaccctagaatgtagaatgtgctacgtgtctgtgaaatggagccagagactctaagaacaatgaccccatgccgggtcctcaaagaaatacgctggagcctaggacacagggtttcttttcatctctgtcataaaatgtaagcacaaacttcactgtgaaacccttacccctgagaccttcctcagaacctaggagaaaaatcccttactcagaatccaggtcttccccaagagggtgaacccagagaagccttttctaggggtatggccgattgagagcccaaggtgtctccaacggtctttttcccaccttgtttttctgatcttgctgttcttgtgagacagggtctcataaggttatatagcccaggccggcctgggactccctgagagcccaggctggcctttctaccccagccccgcaagtgcttgacattagagatctctgttatcatgcttggctgcctggcttctctcccactttttgacataaacaacagcaatattttactgaaccaaacagagctcaagccagccagacctctggcattccgtttcctcccgtcagcctcacagccctgtagaagtgtctatagtagtcttccagttttgtcattgggttccacttagcaacccacacaaaaactaagaagccaggagagggataggtaagacagtgtgtgggcttcattgataggctcatggaacttcgaagttcaaatgaggccccaggggaatggttcagggacatcagtgttgtgggtgccctgcctctggcagggactggcatctgtccagactgtagctcctgtgtgctcggctctcatttccagcaacctgtacccctgtttccttcctggtctctcagctatggaaaaacacaaacaaggaggtgggaccattttaggtagtcctagaggcaaaggttgtgtgtcccagtctcacagagaagtgggaagccacagaaggcagaagggccagcccagggctctgctttgacgggacaatggacacacccgagggtcacttccttttaccttctgtgtgctctcagaggcaagagcctccaaacccctcagctgacaggggccaggactcgagaaaggtagagggcctgggaaggtgagggtagactttaatcttgaagtggataatgagacaaaggcaatggtcattgtggatattaaagtcactccttaaaaaaatagaggaaataaaacttcaaactttcttagtgttttgaaatcacaacagtctcagattgtggataattccatgtcataaaaacaaacaaagggatgcatattgctattaaattgtttgtgttctgctacatgtatacacacacacacacacacacacacaccctcatgcaagggtttgaggaaatataatatccttgttattcaacatgaaaaataaagaagaaaaatatattttccacaggaacagccatcttctcctccttgatatcctacaactttgtttgggacacataaagaggaaagtgctgggaagtggagcgggctccttagggccgggagcccaagcctcagcgggaggccagcagctgcggagaggctcaggctgcttcatttctttctcaacaccgccacctacagggcctgccgggaatggcactgcatggtgcggcccagacacccttaacagaaaaacattcagaacaatcgcatcacttttttttttttcttcagcttcctgtttattagtgttttatctaagagcagaacaaaagtctacatgggggtggcaaatgcacggtcctactcacaataacacacacagttttcaaatacaaggggattatatttttacaccaaaccaactccaggcaggcctttattaacttctgaaagttgagaaacaaaaagagtggaattctttggcacatcaaaattataaaatatcttaaagattttttttttaaaaaggagatggggagaaggttcagttagtggaatgcttgccccacaggcatattaaaaacaaataaataaataacaggtatggccctccaaagctagggagacagaggcaggacagctcctaggacttgcccagcctagccagccagctgataacctctgggttttgtttgtttgtttgtttttccttttctttctttctctttttgttttttgatttttttttttttttttttgagacagagtttctctgtatagccatggctgtcctggaactcgctctgtagaccaggctggtctcgaactcagaaatctgcctgcctctgcctcccaagtgcaccaccactgctcagcttaagctctgggtctggtgactcgtcctgcctcaataaaataaggttgagagcaattgaggaagacagtaacgttgaggtatcatcaggacacgcatgcatgggcacacacatgcacaggcatacacatgtccatacactccacacacaggtacacacatctgaacacacacataccatacatgaaccaataatcttttttttacagataaacaagcgtgtttgttttctgcacatttgaatggtagtattcatttctatacacctcactggtaagactttgtatgttgtttggcaaactcatgaaggcaatgaaaacctaagtgtccgcccatctgtttcggagattgggtgggtgatggaaaggacaaacgcaaggtgcccgctgtttccatgctcagaggtgaataagggctgggaatgcctgcacttctcacacaaacacgagccctggcgagactccttctagcctttccctcagcctggcatgctgctcttccaagcctatgttctcaaaagtctcagggacaataaaagtgaggggcatgccacacagctggtggtcatgggaccactgacctcacatgccaccttttaaaagaaaggttatgtgttttattttctgaacatgggtggtttgcttgtgtgtatctaagtgtgcatgcctgatgccctatgaagtcaaaagagggtgttggatccctggggactcaatctacggagtgttgtgagctgctgtgtgggtgctgggtaccaatcccaggtcctcctcgagagctgaaccatctctccagccccacccacatgtgcacacgtctctcatcatcctcagagatgaacatgcggggaattcttataattacagccagcaagcaaaactgttgttgtatttggtgaccttccttgttcttgtgatgactcaggtcactttaagtcctctagcacgctcggttattcagagactgtttgttctggcttccaagtttgagtcttattctggttggtctatcttgtcttgaccagcactaaacacatttcaactctgctgcagccttccctgtctgcagacacattagttgttagcccacacaattaaaggccttttgtttctttatccattccattttcatgtgaatgagaaaattaacattaaaaaccacccaaagggccgggggggggggggggggaaaggagctgtggttaccatgtaaccacatgtgctgcctcccttccaaaggatcaagttgggttcccagcacccaaaccagactactcataactgcctgtaatttccagctacaggaggatgtccaccacgtctggcctctgtatgcactatcacatactcaacataatctcataaataaaaacaaatctcaaaaaaacaaaagaccctctaagcaaggccatgggaatatgcgtgtgaacatctcatgaaaaaacaaacaaacaaacaaaaaaacagctgggcatggtggcacacgcctttaatcgcagcacttgggaggcagaggcaggcagatttctgagttcgaggccagcctggtctataaagtgagttccaggacacagagaaaccctgtctcgaaaaacaaaaacaaaaaacaaaaacccaaaacaaacaaaacaaacaaacaaacaaacagacataaaaaggttgataggtgatttcctgagatgataaagtcgtctataggtgtctgtcttgagtaggaaatacatgatattaataagtatatgttaatattgtaataaaacatgtgatataacacaggagcctgccccattcttggtttaacctcctgagttctgggactgtcagcatgtgccatcacacccagctttcccacaaggctcctaatcacaggtccagcccggggttgccccttggtctctagaatgtctgcctggtgtggaggaagccttgggtttactctccaacaccacataaactgtggcatgcacctgtaatcccagaaaaaggagaggtaggagataggaaattcaaggtcatccttgccagcacagtgacaccagcctggggcatgtgagactctgtccctaaataaataagtaaacatgtttcccacctcccctggagaaagcagtaaatgtagatttctctttccaaaaccaagtgttcccgtgtcacttaacagtctaccacattcaactaaagacacagagagatgcaccaaagtgcccaggaaacccagtgcacagtcctggggcctctgttctttaacactgggaaatcccaccgagaagtgcctcccaggctgtcaggcagatcctctgatccccttctctagttgtccaagaactacaaaggcagttactgtggaagctacagccttcagaaatagaaggagccccacgaactggcatagtaaaacacaattgaggcaatgaccttgattacatggcacgcacaactgtcagctctctactcattttcaatattgtcttcatccagtcattttggagacatcaactccattctaccctgggtatcatgttttctttcgggctcagtgtcctgtggagaaagtgagaaggcctgagcgtagatcgccttctgccttctacatggaacaaaatacacagctaagcttcctggtgttcctggttccttgttgaagcccacaataactaaggataataagggttttggaaaggctcagcaaagtaaacaggactccaactttgattaaagcatacttttaaagatggtcttggcgttctgggtttagatttgcttcacagacataactctaactctactaggaggcattcgatctgccccaatctttcattcattcatcactgagtatcaatcaaaaatttaaaggccttgtcattagactgagactctacaataagaccaatatccactcaagttaagggccagcctagtgacagagccttgaccacaggggccctgtcaggctacaggtgccatgggctgcccttgtttgtttgtttgtttgtttgtttgtttgtttttcctctacaagtggtttctgaacacagcagccaactcattagctttttctcttctcaggagacaaggcaaggaacagagcagtctaacaacagaagtctccacctcacacaggggacatgttagctcttcctccatcttcgcctgtctcctgaaaatctacagtatggctcagaatgccttagagaccagcttgttcactcttgggctgttttctgttcaatcagagcagagcatcgcaaccttacctgcagatggaactgcagctccttctgggagtcaacactgatcgggttaagaaacccatccatccacagcacccaactctctaacaaggaccttctccctacctcagggctccagagcctcactgagcccatggctctgggtacagagagctccctgcccccagcttggactttaagtctcacagaggctgcagcaacagaaacactgactctcagtctgaagcctggacatctgagatggccatagactaaacgccaagtatctctgcgggctcatgctttgagtaccaacaggctgtggagtcttcaggaggtgatgcctggttgatggagccactagggtccatttaattcctacgaagagtttgccatggcttgcatggtgacagagagacgttctcataggcaaacccctcaacacgatggtggcccggaatttctgaaaccacaagtcaaaataaatctgaaattgtttctgtcagatattctgtcactgagacttaaggtgtgagcagggctggtttcgccttgactagcggatgctgggtcctcacccgctcttcatgcgctgtccccactgcacatgcctgggtcctcatctcttaggaggacactggtcatgatgaattagggtccattggtctattggtttcattttacctggatttcatctccaagtgcagccccattccgaggcactgggattctggttttgcctcagaaactcaggctggggagggactttgcccatggcaagcaccagtaagacatcctgggttggagaagatgaagaaggaaaagaaagggagcaaggagtcaaagatggctgaagcatagcctcgctccgaagtggacagcccttcccacctgtccatcacactggctgcagccttggttggtgcctggatagtctctccccaaagctactgtcttttcctccatggaatccctgaccacttatccttctgcccccacggagcccagcacctcttcccaatgctgcttctcctccccagggaagaccataaagggggaagggaaaagtctccattccaccacagtagcactcacttgctgcacaaggagcccgagggaggctggacacagccagcaccaagcaagggcttgattcctgtggaagatgcttattctctgacaacgagcctcctaactgatcagagctgctgagggggtggctagggacacccagtgccccctccacctgtcttggcatcttttgtctctctcactatgctcaaagcctaaagccttccaactatctgagtgtcatgatgaaaacagtctttggggttttatgctttcactcatagacagagccctgagttctctgcccttgctgcttctgggcactgaaatggtgattacgggcatgctctttgaaatctgatccaactgtttaccttcatgtataggctctgccagctacacgctgtgtcatctcaggaaggttacctctctcagctatgaaacagagtcatactggaaccttcttgtggattctgtgaccgtgaaatgagatgattcacacattgaaccttgcgtgcagcctgcagcctagcgtggatgtgatcctcaggaaacctgagtgtgggtgctgggtttaccttccaaaccgtgaagtcgccaccgtcaggggcagtcactattttttatgtcaccaagatatcagggatactataaccacccggggaatgctagggaaataaacacggcagctcaattctagttttaaaaccactctcccctcacctcaaactgttataggtaaaataataccaaccagtcacaacttagaacttagttaaatacgacattcctgtttctgacttatggtatcatccataggtttccaaagccagcaccacaccaatgttttgcggagccgcaggtgtgcaggaatatagcacagtggttgcatgcttctcagtgttagcgaggccctaggctccaccctcagtactgaaaaacaaaaaaccccacaaacaaacagaaaaccaaacctcctgtgcctgggcaaactagcacccttttttccccctcattattcgaataaaaacatcttcaaatacaaagcagacagcccaaagctgatctctccttggaagactggaaaccaggaccacgacatttgtcccaggtacaaatggatttaagctgcaagttcctggggcctttgccgcctacgaactaccacatccttgggaccttcccagccagcttcggagcacccaggaaactgcaactcttgcttctgagccagagtccagctgcatccacacggccacacgctctgtagttattccgttatcttgccattaaggaaaacccacatgaattccactgtggccatgaacaagtttaaggttaccaacgtcatcaccagaggctccggactgaaagctttcatcaaagaggccatgctcttctaagccagcgtggtgttcccaatgtctgacaagtcaacggatttcagaatgttcagagagaattcgaaaaggagctgagacctcccacacacacgtgaaaactccagtagagaggtcatcccctctttctaccaacaaggacatgaacccacagcaagctaaagacagagcgaaggaagtatagatataaaaggcttccactcttccacacctatcagggggatgggttccatagtggaaaaccctgtcctcagggcaaatcagtccagtagcaaaaacacgctggcttcatttatattacaagaactcactttgccacctggagacgttattcagcaacggtaacaggatctgtaaaactgtcggactttcacattacttctgagtgaagataccttatcagacaccaagtaggtagaaaagccatttatcgcacgggagagctggatgtcccctcttaatctgtgggcttcagccacggggattgggaagactccagttgactgaaaaatgactggaggagagaagccttgcctcacagtgtcaaaaataactcagctgggagagcattccactgaagatcaaaatgatttggctctcctggcaaaggctcaccctgccacacgctgggccccaccaatagattgcaatctgaatcagaaaaaaaggacacccccccccccccatgcttgttcacagagctcagcagcgggcctgtggccagtaggagcaccaggtgttttatctggtttcgcactggtgccctgagtccctgggcctcaccatccctaggcctctgtaggagcctagagggggcctggctgctggggtggggggtgggggcagctgtgaggagaaacaaggccccacccacacaggctatggtttcagtttcacccagcctcaaacaccattatgcaaatgagtcgggcaccccagctcacctcctccttctcatcctcactcttcatcccaaagttgaggagggaatgtgccggggaggcagtatttgcatcatatttactttcaaatgcccaggtgccattggcagcagattctcctttcagaagggcaatcacgaatataaagtggagaattagtccaagtgtcaagagtgaagccctgcggctaatgccaagcttctcacataaatggagtgtcaacgacgtgcctgggctgggaaggagtggggcagaaggaagaggataccctccatttcagaggcttattggcactagtccaaggggagctggggcccccaagagtggacagacagccacaggctctgcagatctgcactgcaaatctccagtcccgtgggctttgggaaaacaattccttgcttcacattcaaggcacgttctaaaagtagggagggcaatcattttgtccgcatcacacacctgcagttaatgcaagtgatccgaggtgatatccactcagacaaaaaacaaaatctgcagcccagagtagtgtttgtaagatttgattgagggcatggaggtgcagaagcgggctttcctgcatgactgtgtcaaatgctggcttgggatttttctttcgagagtttaggaccagaataattagattgtcagctcacacgaccttgtgtgcctggctacgagatgccctaggtttcccctagtgcttctcacgtcattttctggataacaaacctctgttcccgtcaggaacactcttcctcagcccctcttactactcggtttcattttcaagtgttgggtgtaactcacagctgcaggagagaaagatggctctctctgacttagcctgagtgcaaagaaattccagtcaggtgggcacatttgaaaagacaaaaacctacagagactcttgaccagctcagaaagagagggcttatgcacgggagtgaggtttgtctctgttaaggatgctggaaccaatgctttgcagaggtcaggcaactttgccctcagagatggtttacgatcttcatacatgattaggtccacagggcaagcagaaccaccaggtgctctcagtctgcccatactctgagcccttagagtctcaaatggtttccttttcctgatgtgtgcaaggaggcctgtagctgccaggcccctcctgcctgtgtggacagactggcctggtaagagctggggagtgcagtttggctttcacagaggtcccaccggacaccttctcaccacctttgggtggcacagtcactttctctgacttcccgtggcacactgaggatccctggatcagccacagcacatacttagtgtgttcacaatattcttagacgcagcacctctttcggtcatcacaaataaatgtcacaatctaggacatctataaaaacggccccctgctttatgccaaggctcataactgattaagtgactgtcaacagcttagccctaaatggagcataagtgttaccctcttcgaggtctggggaacactggagaagaaagggcaggaagaatgtaagaggcagtcaatgaggagggctccgtgaaacactgtctcttcaacaagatgtggtcactgcattcatgaactctccgcaactcgggttacctgaataaggctgggtacccaacatttcctcacagataggatggtcatctcaagccctactcattcttctggggctgttggtgattaacggtttttctgttttttttgttttgttttgttttgttttgttttgttttgttttgttttagtgctgtggccactaagttgtgatgctctaagtcccccgtctgtgctcaagcaagcaacctcccctaaactcagtggtccaaaacactgccctcaaatgaatctctaggaacttaaatgtgtttacacatgtgtataagtatatttacctgtatgttaaattttatgtaaataaatgttgtttcttcaagccgccaatcttaggatgctatcaactccaggggttttaaacattagagaataaaatcagtgaagagatgctgagagaaacaacaaaatctaggatgacacagtctagtggagaaagtgtcccctgcctgtggggaccaaagccatccatcctgagtggatgattggtatgagtttttaaatggaagttggtagaacatgctcaggaaaatgcacttctacataagctagagaaaagtaaaagaacttagttgcaaagggaaataggccacctctgctcttgttttatacccatgcatattctgtctgtcacagagaacagtgttaattctgggaagacgaccacatttgtcaggcttctccagagagacaggacccacaggagatatacatgcatatgtgtgcatgagagagagatagacaaacagacacagacagtgatttagatttaaagggctggtttgcacagtggtgcggattcaagcccacatgagagagcaggttacagagcaggctacagagcaggttacagagcaggctacagagcaggctacagagcaggctacagagcaggctacagagcaggctacagagccataggagttggtaatgcaggagccactcttcctgcggtgttgcattaaatgctgagaattcccagtcctttggggtttaggaaaacacagtggtgggacattgagactctggggcatttttttcttggaggttagtctttctactgaaggcccctaactgattgatcaaggcccattgatataagtggtaatctcatcttgcaaattacctcacagcaatatcaagactagcagtgtggggttaggggaaacaggggatgaggctggagagatggctcagcaattaagagcacttgtgctcttcggaggctctgggttcaactcccagaaccacatggaggcttatggattgtctgtaactccagttccagggcatccagtgttctcttccaggctccatggatacataccttacatacatgcaggcaaaacatccatacttataaaataaacatttaaaaaaaaaacccacagaggggcccgcaaggtagctcagtgggtaaaaggatttgccggcaagcccaatgaccggagtttgatcccgcatggtgagagaagaagagaattaacccctgcagattgtcctctgactgctatacttacactgtggtattgaagcacccacccacccacacccacacagattagtaatggaatttggaaaggtgattgtgagatagctctatatcagaaggtatttaccatgcaaaaaagtgattaagagaattgggggctggctaggaggcttagctggtacaggacctgtagttcaaatataaggacctcagttagcctcagcacctacataaaagctgggtgttgtagcacttgtctagaacccaggctcgaggggcagagagacagatggatccctgtagttcgttggttagctagcttagctcaggaagagaccttatctcaaagtagataaacaaataaataagtacatatggtggagagttattgaggaagacacctgtactgagctctgtcctctatactcatgtgtactcatgtgtactcatgtgtacagacatacacacactcacatgaatatgtacatacacttacacacacacacacacagagtaacagaataacattggactaaataccagcaaccattttctagcagtcagcacgtgcaattaaccactgcaaggaccgcagatgtctgggcctggtcacacccaatgtgtcgtctcagacttgtttcagtttgcagctttagaacaatgggggcactgagaagacacagggagtgtgaccaggcagcagaggaacttcagatgtggtagagaggacaggatatcagggtgacgaagcagatatgaggcttctgtctctgagtgacttgcagccaggagccgcactctcagctccacgtttaaaacttaaattctaaaactggttgccaaaactcatgatttaggagatttcgtaaaaggtgtccatgttcctggacccagtaaagtaggtcccagcctgttttcttatggtaaaacatcaaggcagggtaagtgaggaaatcaggtaagaggctgtaagacctcagcaagatctctggctcttttttattttattttattttaatttatttttactttatttggtagtagagattgaactcaaggcttcaagcacaccacacaagaccctgccactgaactacagccccagagttttgtttgtctatttgtttcattctattactttgagactgactcttgttaagttctccaggctggccttgaacttaggattcttctgctttgacctcaagcctggctctggccctagaactctgaacagcaccagtcgtgggccacatctgtgtagtcacactccagattgctgctttccatctcgtcccctctgtcacctgttcagtgatttggtaacctgtcagatctgcttaggactgacctcaggtgggacatgaattctaaacaagagaacaggagaccagacccatctggagatgtgggtgatgggtgatgacttaaatcttccaaagtagagtttagtaaagaaatgtcaggttccaagcttttaagttcagcaaactaacaaacaaaaccctaactatacaggaggttgggcttttgtaacaaaaagagagaaatgagaatctcagttattaacagaaatggtacaagtgaaccacagggagttatggaaagaagcagctgaaccaagcgtggccactgagacagggtcagaacagtgcccaggacacaaaaagaccccaggaggtggtctgggcgtgaacactgtaagtcttaggatttctgttgctgtgataaaatacgaatataacttggggaggaaagggtttataagcctgtcatccaggaagtcaagagagaaactcggggcgggaatctggaggccacggaggaacagcattccttgtgtcttgttcagcctccttcctagtacactcaacactgcctgctcaaggaaggcactgactcccgtggactggtgctcgaacatcaatcatcaatccagagaatgccttgcagctttgcctataggccaaacttattcccactcttctcagatatatttaggtttgtgtcaagttgacaaaaacaagcagcacaggaggtgaaagaaagaacattccagatacacttggacttttcttactatcagaaccagtgaacttggctgtgcaacccctctgcacttctgaactctcgcaggcttgcacactgaaaggcttcataaaagactaactcgataattcaaactatccccgtgccttggaagtcacgtttgaatttcaagctctgcctttggagtagctcctcagacacacacagtgtgcttcagaaatcagcccagtgtgttgatccttccagcactcccagacagacacagacagtagcgccccctcctggcacacggccttcttagcccacagaggggttactccctcctgggacacttctgcacataactttgacctgctactcaaggcctggtctggactctgcttcttttctgactgagcacaaatccacaggagagtcactgtccactcctgatcattgagagccctggagtatcctccctcctttaagccattcactgcttaggtcttacttttccatagtgatcaaccatctttactgaaattcctgtctagttcatttcatatctatcagaactcactgcactgagatgaattgttttctggtggcgatgggacaggatccagagcttaacccaagctgggcaagtggctccaccagtgggctacatcctggccagtgtgctgaggcctgggagtatgacttttcagtatttgaatagtattattccctaatcactacacaggaatattttagcagatttcatatcagagcaggtgtatccagggtgttagcagccataaagattagtggcaaagcaaatggctattggtgtccttgaggatggacactgactacaacacctgccccagagcccctcagccaaccaaggtagcgtcctgctcactgccttggttgaaaaggatctagcttcacacacaaatgtgcttgtaggattgcacccgacagtgcttgggcatcagtgtgtttgcaaagactgtagagagtcagtgtgtagggatggacttgctgggactcctgtgggaggcacacagggtagggatggacctcctggcactcctgtggaaggcacacagggtagggatggacctgctggcactcctgtggaagacacacagggtagggatggacctgctggcactcctgtggggggcacacagggtagggatggacctcctgacactcctgtgggaggcacacagggtagggatggacctgctggcactcctgtggaaggtacacagggtagggatggacctgctggcactcctgtggaaggcacacagggtagggatggacttcctggcactcctgtggaagacacgcagggtagggatggacctgctggcactcctgtgggaggcacacagggtagggatggacctgctggcactcctgtgggaggcacacagggtagggatgcattcaccgcaaatatgagccttggtccaaaaactaatgcttccagaacgttctttgtcccacatgtgaacacaaaggagtgaaactcatgacttctgaaaccacagagtgtatttgactttttcatctgcattctcttccttgaacaacttctgtgtaaggtgggatgacattctagaacatgcaactcaataaggagacaattttgctggttctttttttttttttaaagatttatttatttgttttatgtatatgagtacacaccagacacaccagaagagggcatcagatcccattacagatggttgtgagccaccatgtggttgctgggaattgaactcaggacctctggaagagcagtcagtgctcttaacagctgaactatctcttcagtcctaattttgctggttctaaacagcaaaaagagttgggttcaactagagtgttctttatttcctttattttccctggtgttgtctgggtctatagctgctaaccagcagtagttaaggtcttcacacccatcctggcaacagaccacagtgagcctcgtctcctctatagactggagctatggcgaaggtgtcttacgctgtctccatgttccacaaaagaacacccttgctgaaggggtggctggggtatcatctggcacacaggtgtccccacttgttattggtggctgctcagccaatatacacttggggaatcgaggggtagtcccttagagatatttcactgatttttataacacttccactttgtaagcctcttaatgcttccatgaaagaaactgtgccacccaagcctagccctcacacatggtaccctctctagcctcatccgcacaaatggaggcccaggtggtaccatctgctctgggttcttgaaatattgacctgaccagagtggcctggagtttcaaaagtcgacctgtctctgttgtcgcttctgctgggactgtgactcctgtgcgtccattctcctgtctcccaagcgcagggtacaggctctttctgtcgcaccaaagtcccacacagaaagccagtagttccaagaggactgagggtctggctagttttgtgtcaacttgacacaggctggagttatcacagagaaaggagcttcagttggggaaatacctccatgagatccagctgtggggcattttctcaattagtgatcaagggggttggggggcagcattgtgggtggtggcattcctggtctggtagtcttgggttctataagagagaaggctgagcaagccagggaaagcaagccagtgagaaacatccctccatggcctctgcatcagttcctgcttcctgacctgcttatgttccagcccttacatcctttgatgattaacagcaatgtggaaagtgtaagccaaataaaccctttcctccccaacttgtttcttggtcatgatgtttgttcaggaatagaaatcctgactaagacaatcttcattataattccgcccacaacgtcttaattagaaagctatttgctcaccaacccccccccaataacctgcaagcacccccaagtgtgcagcctgaaggtgagagactcccataccaggctctggcaaccaaagcttgacacagatgtctccccatcaccgcagcctgagtgaggtgcccagttgtgccagtcattctcctctgccgtgccaccacaccaccatgtcattcctcctctgtaggattcttccccgttttacctttattaatttttaactgtgtacgtaatatgtgtatgtgtgtgtgtgtgtgtgtgtgtgtgtgtgtgtgtgtttgtgtgtgtgcaggttaatacaggtgaaggatgaggctgactgacagttatcaatctctaccctgttttattgagacaaggtctctcactgcacttgaactaacttgttcagttagcccagctctgcagatctgccttgttttgaccctaaccccttgtactggggatcacagatatattccacctttacgaggacactaggtatctaaactcaggccctcacacttgatcaacaagcacttttcccagtgagtcatcttcctggtccctttcccattttgaacacttacttcaatctatttgtcactttatttcctagcaacttatcccttctcgccttttacagccgtcatgtttcatcctacactacattctttgaaactcaggtcctatgagattttaaaacagagccattcgtggaggagggttccactttagccatatctaacatctgctgcacagtctctgctgtgttagtgtctggatacttgtgagtcgtgaccaaaggtcctgagaagtcttacagcttaaaaaaaaaaagtatgtatttctattggctcatctggactttccagtcccatcccaactgtaggtctttgtggagaattgcagcccatagctcactagcgccccctgacttccaataacacctccgcaggcctgactgcagtagaacaaccgaccaacaggtggcctgcaaagaacccagcagcgcgcgggcacgtggtgggtggggggagctgcaggtggctgtgtgggtgtcccaatttcatgggcttccatgttagatgagccaagccttgcagctgtgggcttcgtagagtacagcgggggcaaggggtagctttatggcctgtggagctttctgtgtgattgtaaagcactttctccctaaggaggtattcatttgcatgctgacctcctgaacatggaggggcagaccctgagttcagacggtgtgtctctgctcccattgcctaaggtgaagtgtcgaggtgtggggatgggcaaggagtagaagtgtgtgatgggaagagaagggtccagagcagaagcccacgtcctcattctcaggggagtctgaaattgacagacaaagaaggagatacacaacagtccacccctgtaaccaacattccagggacctggagtcctaaccggggagacccttgatactgcatgtttcaggacgaggctgtggttccatagtacatacgggcctcctggtggctgccctgagtcaccgatctagaggcctgacctcgggaggaggcattaccttaccacaggctctatccccgcctcttcatctatgtaaattgcttttacagcacgtgtcataaatcagcaggagccgctgttactttgtgcactggcgggaagtgcaagttgcaaaggctatgctggctctgctttcagcaggggctccctagagcagatgcaggaggacactcatgtaggctcatcaagaaaggaattaagaccaagtccgggcctggttactttaggcatgagcctaggtaaaacaaaacaaaacaaaacaaaaatcccaaaacaacaacaacaacaacaaaactgagtgtgcgagactccatgtttaaaaagtaagtttccaaacagggctgggaggtggctcaataggcaacgtgcttgctacgcagctggaagacctgagttcagatccgagggacccacgtgcaaaggcaggtggggcggcttgcatctgtaatctcagtgctggggagtggggaggagatggacagatgcagggggctcgctgagctgagatggtcacctccaggctccttccagaaaagctgagaagcagggctccagaaggtgcacacagacatgcatatcagacatacattcagagatgcaagacagaggccacagagcatttaaacaagcacacacctttttgaaattacacaggatgtacgttccagaggccagccgagcctggatctgtcatgggctcagggctcagagccggagagtgcgggacttaactctgaagcagaacaatctggaaagacctctttgactggtggctcccaggatggctccagtgtgagcccagatcccagcttctggcacactccagagctttagatcccccatcttctgcatcgtgagtctgtttcataggtgtgtgcgttcttatgcgaggttatctttccgtttccccacttactgagggacccagaaaaataagacctattttctcctggcttttgcttagctacctttcagtgcacaggtacttgaatctgagacattgagagtccactggtctcccaggatcctgcctgccctgggcctggcctgtgtccaggcctgtgtccagcactgggcatatctgtctctcctgggctgcccactgctaccctgctttctgtcctgacttcctcagatcctggagtggtggcttcttgggcacctctgttgtcaggacatcgtttgcctcatactttgatgtctctttagcagttacctcagaataccagcaaggcactcaatcttataaacatacagcttttgctgtgctttagataacagcccattttacaggaaaagacttgctaagtatttatgtaggaaatggctatgttctgcaggcccctggtggaaacaatctctgcttggccacaagagtatccccctaacttcagaagaggacaggtacctgtaaattcctgaaccccagtgcaaggggacacccggctggcagcctgccaccagagacccgctgtacagaccacgtccagccttgagtcctagctccccaccttctgactttgaagtcaaagtttcacatccttgaaaaatactcatggcagaaggctagtcccgagactaaaataactttccacgaaatgctcagaaagcagctccttgcctgtaaatgctgtgatattataagaaacacccttgtttgtgtgcggttacgtcttgtgtaactgcctcagtggggcctgcgagatcatttctgtaacttctaaaaaccagcactctttcactataatgtggcaccttctcggttctttaaactatttttctctacaagttctcatgaattgatggttcctgtttttctgaatgtgctgttggagcctgtgtttctgagggttctccaccatgttggtttaacaactaggcaacaagccaaaagttatcctatcttgctgctgctgctgctgctgtcccttggagagtggtcctcgcttgctcggtggaaaccatcccctgtgggggaagcatcactggctccctgaggaactcggacttcagagaaagggaaaggagagcggcagagtgggtgaaagttcggatggtacgagactctgagattagccgccgtgagccaccagccctgggctcaggaccccccagaggataccctgttctgtataagtaagagacacacctttccttttttcacgcacccccccttttcttagcaaatgtaagtccaaaatctactttcaaacctctcattattcagccactttaaaaagtaattcttatttgttgagattattatataattacatcatttcttcctttcctttcctcctgtcaagtcatctcatgtgcccatcccccttgctttctttcaaaaatcatggctcctttttcttgaattgctgttacttttaagaaaaatgtagacacagcaagactatttgattcacctaaatattcaaaaaagatttcttgctaacaggctgacagcacacactcactgtcaggagacagccttcgaggagctaatccacactgaagtggacctgagactcctcggagcacccctccccccgcatgttgaaacacatacgagctacacgctctgatcaaacgctaggtctgaggctctgcagtgctgcacagcagccatctgtctctcaggtctgaaggttagaggccaaaggcaaaggctcagccaggctgtgtgccttccaagggaagggtctgctccaggcctttccctcatcttctggtgatcctttggctgaggctcggtgtctccagcctcctaggacctgggtatatatgtccacctgcctgttttgttttgtatgggtgttttgcctgcacatatatccgtgtaccacattaacgtctggagcccaggaaggtcaaaagaggatgctggatctcctggaattccagatggttgtgagctatgggagtgctgggaatagaaccaggacctctggaaaagcagccagcactctggaccgctgagccatttctttgagccccaggttctaacgccaccagtcatcctactccaaaggcccttgttcgaggtagttagatctgtaatggcactgttatagaaaaaggacatgttctaagctgctgggaacatatccattttcagagacatagtcaatcccagacatacactgaggctctacctggtgcctcacagcctgtgactcctgctcacttctctcccaccaactcaatcccctccagtaagcacccatttgcttcctgttctgtcagggtcaatgtccctgctcaggaagatcaaagttgctcgtagtgaagagttttagtcactctgttcacgctgaatagagcccgttcctccttggctgagtctcctgtcagtctagtctctgtaaggcaccagacaagctagtcatggattcctctctataaccccatgtcacctggggatgcgctgaggaaccttcaggaagtcacacgggccctatttgcattccagtgaggtgagttggggcagacaccagcaggcagactgcgagcatgtctcaatagctactgaaatagtcctgattctatctgctttgtaaatagcactgggtgccccggagactctggtggcttttggtctcacacaaagcacatggtgcttcatatcagattatcaccctcagggctggagcacaggtccccaagagcatatctgatgctgactcttaattgatacagcttatcacaatggccccctgagactgggctagagactggagaatggccactatgccttccctgttatccaatccctaccttctctggagggactttattgtcttttcttggggttgcgatatagctcatttaatagagtacttgcctagcatgcacaaagccctgggttcagtcaccggtaccacttaaactgtctatgatagtctgaataccattttatacagttccattttttttaaagtcttatataaaaacatgaattaaagcaagaccttctagttcttcattcatttcatttgcaggctcaaagagacctcttgcttggctcaagagcttctgggaaggccagcagcaaatcagtatggtggctctgaaggcccctttccaggtaaggcaggaaggacagctggatggaagtgtgcctaggacagccttggatggatcccaaagcttttcattcaattctctgaggtcaaagaaagattgcctcagcccaaggccaggacaacagccatcttcctgagaaataacgcgcccgtacagtctcagaaaacagaatccaccaaagttgggtatgcgcagctcactagaggctcaaggtgaccaggaattctgcatctacccctaggctagcacttctcatggacactcagtttgattagctgtgacttttgtgtgtggagtaaatctgaatggacctttaacatacattcttgacccactaagtgtgccccaggaacaccagtttctcaccacctccataaccagaggcccttttcaattttccaaagaaatttgattccctacctacagtttaggcatcatggctgatctctcttactctcttcaggagatgaaatcaaagtctgaaacccccaaaggacaccatgcttccatcaggagaggtggacagggacagggatggggacagggactttacagtgcattggctacagtggtaactcttactctctgccattcctaaacacactacacacactacacacacacacacacgcacgcacacacacacacacacacacacacacacacacacctatttcagcaagacacccaacccctgacaccaatttccacttgagccccagaaggagcaaattgtcatagggagaggagtcttattatcctggaggctagacacaggcaggggtgggtgagaggagctgggagcactgcctgtctttatcgcctgtacaggatctcagagaggtggtcatgtgtccttcctccaactggccagtctgttgtgttcagagctctgagcaagggtgaggtttgtgttgagcataaacagcagatgagatatgtttggacaagtgagttttcatgtcgcccagaaggtccatgtctatgctgggtagcagcattgtacactgggcctcatgttcccttcctcgagcatggctgtgagcaggcactttgagtgaagttcaaagaccccgcccccacccccaagccctggggatatgagatgagccacccagttgtcagtccagtctcagagggtaacacaagctgtgggctggggttaaaagcacttgctgtttttgcaaaggaagcccactgcatggttcacaaccacctatgttctgaagtcctcttttggcttctgaaggcacatgtacccaggcggagcacacatacacacacacacacacacacacacacacacacacacacatacactcaggcccacatgcatatactaaaaaataaaacaaaggggtagatagtgccagctgggaaggcaagacacctgccacaaaaactttgaggataaaactgcacacaggtgactaaggcaatggtacccaaaggtcgtgttccaaaagtgaggattgctatattagttactttcctctggttggaacaagagctacttcatggaggctttatctgggctagcagctccagggttcagtccatcggggcggagaggcatggcagcaggactcgggcactgcattcacactcgggaagcagagagttgaaagcaagtattcagcttcctttgttttctgcagcctgagaccccagctggtggaacggtggaatgctgctgctaacattcaaggttggtctccccacccctataaacccaacctagaaactccctcgaagatgacctcagaggctctcttcctggatggctctaaattctgtcaagctggaaatgtagctgccacagtaactgactgccaaagtccctgttctggagagagggggattgaaagaatggaggtgagacggaaggataatcatgggggaagtttgaactgagtcatttccacctgcctcctcccccaacccccattgcctagataaccactgtcacacatgctattatgcaatgtcccatgactgacagttaggcaccatggtcaatccctgtgttaccaagggcacctgtaaatgtgtggataatggcaaacttgaagattatctttagggacgcactctgtccccagccttcaatgacacacatggtcatttcataaagaggtcaaggggatgcctttccaaattcatgtcttgtatagaacagttgagccatggtagctgatctgatacttcagtgaaaggaccggaagaggtgtaagaagaaataaatacttttccccctaagttgctattggtcatggtgttcttcatagcaacagaaaagcaaactacaacatgagccaagacaagactaaaacatgagcaaaggctaggctaaaccagggatgatagacattggggaaaaaagatcaccacctcagatacagagtaaggacatggctttatgtgtccccgcagggtgtgagcagaccttgagaaccctgtggtcccagcagatggaaatggtcaccaataatctcagagtagcattcaagataaaggcagttgtgctgaagtgcagatagctggatcctcaccgaggagttgggaggacctcttggtaaagaaccagggctcaggatataactcagaaacatctgaaagtggtcagaaagctgccattggactatttacagaagcaaattccagaacttgaaggagcagtgatatggcgttaaatagcctagaagtgtgtcagggcctggccagctcctgcacatgctacttggatgcttgtgtctctaaaagtcccccaaggacaatttggaggagtctggaacagtgacagcaccagagcatggagcttctttataatcaatctagtcagatggcagaatgacttccttcacacagacaagaacacaacagacctcctgtcctcagaggaaacactccaagacctcagggcatgcctgaagcttcaggaagcacccaaaacatgggggtttttcccagagtgtatctgtgattaaggctgaacttataacttagaaaaaataagagacaaatggttattaatgaagtctcccagttaaaacgatatactgtataataaagtcatcacagttcatgtgcactggggccaatattaagtaaaatgaaggttacttagacacaagcactatctactggacaatctaatggcagagatggcaactctgaagggctagcaggcaggtagaatatacagtgtggatactctggacagagggaattgtgactaggcaggatgaagcaggtctgtaagagttttcttcacactgctcccacccacatgtctgcatgcagtttaaaacaggaattgcgtatttatggctgttaaccctctgtgggtcacgtttgactgtgggaaactgaaaccaaggaaaacgaaagtgatgccggggaaaatcgttggggaaagtacatacacaaacccaggagctcctagccacacacgaatacgatatttacattgtcattacgtgattcatcacgcatttcagttcctggtcacactgaccacgcatccactgcctggtggccacagtgtggtcaccatatcaggcagggcagacagagtgtggcggtagctgcaggttttgttggacaaagctgcctcaaagggattaagaagccccaggaatacactgtcccacttcaccagatacccaagagctgttttcttgtctccaggcagagacaagagcctccacatggtcagcagccaatgggtaaggcacgcatagactgtccccatcggaccctgctgaggatggctgtagaggaaggtgagctcaccatgtctgagggtgggtatatctccagtatcaagattgttagtctttccctatcccaggtgggaccagccctgagtggctccacgagcccccagtatagcagtgggtgacagccactccacccctgtggcctgatttctatcatcatgttacctaaaactatctaactacacctggaacgaagtgcccagtaatgaagtaatccacaataatcaggtacagggagggagggaagagcggggtgcacttgaaatggatttaatagaattcagaggtagagaagcacatctttcccagacttagatgtgtacacactaattggatgaagtatgtagaggcagatcctacaggggaaaaaaaatgaagaaatataaacaggactgggcgggcagttgggttgaaacagtgcttgccttgcaagctggaagacctgagttcaattcccagaatcgatgttaaaagccaaatgagatggtgcacgcttggaatcctagcactagggaggtgacacaggtggatcctagcactagggaggtgacacaggtggatcctagcactagggaggtgacacaggtggatcctagcactagggaggtgacacaggtggatcctagcactagggaggtgacacaggtggatcctagcactagggaggtgacacaggtggatcctagcacttgggaggtgacacaggtggatcctagcactagggaggtgacacaggtagatcctagcactagggtggtgatacatgtagattatctgggctcactgccagccagttcagcctggtctttcagtgccaggccagtaagatctggtctaaagaaggaggagaaaggagaaacaagaggaggaagaggagaaacaagagaaagaagaagaagaggaggaagaagaggaagaagaagaggaggaagacggggaggaagaagaacaagaagaggaggaggaggaggaggaggaggggggaagaaaagtaagcaaacaccacctaagaattgacatccaagtttgtcttcagacacacacacacacacacacacacacacgcacgcacacgcacacacactcagaaatgcacatgaatggacaagtctactctgaaagtccaaggataacatgagggtctgcattgaggctcatccacagaagctaacggtcaaacctgtttgctaaggcagaagcgagttatatactcatggcctgctgtggccgctgctatgtatgctgctgatctccacagatcatatgctccttggatttccttccccaaggcaaagtgtttccaaggatgatgctatgattccagaagacttagagggtaccgtgcttggagcccatggcagggtccactccaaatattttcattaaagagaaaacatgaataatatatttcaatgggcataatcatgaatccagtgtgaatgaagtacatcattgtacgaagacaaacatacttttttttttaaggtcaagaaggctgctagagctctagacatctcctctgtattatgacagaaagagagaagggaggaagatctgaaagtttaagccaaagtacctggaacacttgggagtccagagcagcaaagtcaaggatcagagatgtcagagtcctttaaagagctttccagcatccctggcaagcccactactagtcttcatctttctgactgcaaaggagcctgggaaacagcctttacaggaaacgttgttgtccctaacaacaaagaagctgttgttgacagcacaggaagaagaggaaggatgtaaggcaggagacttatcaacagtcatgtggggctgtggagatggatggctcagtggttaagggtaaatactgctctagcagaagcctggggtttggttctcagtactctcgctggacaactcataacacacctctaactccagctcgggggaaatctgacgccctctgctggccaccacaggcactgcaccctatacacgattttaaaaatgctcaagctatttgcattcatgtcatagcttctctgtactgtgaatgggcacaggggcaaacgattctctcctctgtgtctaggatccactttgtagaacctggacagtggtctcacagaaagcagcaggaagctttttgggcagaatatatgaagagcagatcgttttatctgtatagctattgagcacttgtttacctaatgaaggagctgtatggtggcccctgcctttactcccagcacctgaggaggaggcaggaggatcatgagtttgaggtcaacctaaacttcacagtgaagccttgctctgttcatgagggaggtgcttggtgcctggttctgttctgggctccttgtacatccagtctcagactcacaaaacactgcgtgtgacagagtctatctgtcatcatcccacagcatcagatgaggaggatgcagaggacagaaggaaggaacctcctccccactgacagtctgcaaagcgtaggtgaggcccttctcatttggtgactgaggaatgcgagatggttgcgtagtgtaggtgccccaggagcctgggagacgggaagcatcctccctgagtgacttgacctccatgcaactttggaacagcagctcagactcctccaagctgggcttccttcctccaggaagacacaccagggagccttccctcctgaagcttgttcccaagtcaggacagggcacctggtcacagatggcagccaagaagctggtttcagaggccaggctggtgcccagcatggaaacaaaggtgacttttctttctttctttctttcttttttttttttcaagacagggtttctctgtgtagccctggctgtcctggaactcattttgtagcccaggctggccttgaactcagaaatccacctgcctctgcctcccgagtgctgggattaaagatgtgcaccaccatgcccagcaaaggtgacttttcttagagcatcaaaagaggtatggccctaaggccaggggctctatttatttgaaattacctgattaaccccagaggacctgaaataggtgggtccccatcacctctggggccagagagagccatatgatatgaatgcgacaggagcccttgtcctctttttgtgagccctgttttggggagtctcaccccccccccatcttctttcacctatgcatttgtagacagtgacagtaaaattcagtcgagcatgtttgctgaggattttagggaaaccttaaaggatgctgacacccataagattaactttttcccctccccacttcctcctgtcaatgcaatgatgattcccagagcttcagcagccttcctgaaactataagacaagttggagaagggacaccagtgctacggatgacggaaccgagcagtggaagagccgcctgccttgttggctctcccaggacgaatcacttcctgcccaagaacagtacaactgtgagaacagaacccgttagccgtttgagagcaagtgagcttggctcctttgggagccactgatatttaataaatgttgctttatgtccagctgaattgccaggagtctgtgcagccctcatacactgtaaattactagtgcaatgggaatatatgtcttctgccaccattaacaaaagttctctacctttaacattatgcattttcccagggcagagtaacaccctgcccctcctgtcccagaagtccccatttgcatgtactcaacctagaaagcaaaagataagctgggaacccaagctagattagagatactgcctctctcacttctcaagctatacaaaggacaaccagcttttcatcagaaagaatcctatgagaccagctgatcactggctcccctctccttcctgtgaaccagtttccttcaaacttgctgtctcttctttgagaaccaggatccagccagaacctgtgaggatccctgcccttgacccagagaagggccctcaggttcctgctattagagtagctttggggacccacgactgtgccaaccacattgtgatggtttgtatatgcttgacccaggaagtggcactatgagagtgtgtggctctgttggagtaggtgtggccttgttggagtaggtgtgtcactgtgggtgtgggctttaagaccctcatcctagctgcctgaaagccagtattttgctagcagtcttcagttgaagttatagaactctcagctcctcctgcaccatgcctgcctggatgctgccatgttcctgccttgatgataatggactgaaaccctgaacctgtaagccagccccaattaaatgttgtcctttataagacttgcattggtcatggtgtctgctcacagcagtaaaaccctaactaagacacacacattacatccacaatgctctaacacagccaggccagtctcagctcctggagcttaaacactgcacacaggactgacagctcaaagaccaaaatgaccctagctccttctggcccccgagggtgggcacgagaatgtggctggcttttgagactttggagttggtaaggaaatgccacactgcttcatttgggtctctgggggcttatttaatgttttcagtatgatgtgtcttccattcacaatcactttcaagtagcaagaatctaaatgagttaagggacaattgtcactggattcagctggaaaacaacagcaccaaatcaagttgtgccaccttcagcaggcccatgtctcaggggcctgggtttcctgacctttggcccagatggccctgcgtattacacaggaagccctattggctgcctgctcctgctcattttcctgtgctgaatggatgggtagtgtctctctggcaccttcactgagacactgagtaaggcaagtaactgcccccttcctttggtcctgagggctgttgtggagttaaatgaagggcccatgaagtgtggttgggctgaataaaatgggaactgtacttttgtaatgttgttgataataacaatgaggaggaggaaggggaggaggacgaggaaggttatagtgataacaatgatgttgataataatgatgatgatgaggaagatggggaggagggggtggggaggaagatggagaggaagaggaaggttatggtgataacaataatgttgataataatgaggaggaggaggaggaggaggaaggggaggagggggatggggagggagatggggaggatgaggaaggttagagtgataatgacagctaaaacccagtttcctgagaggaccaagaagcagtctccatttgcctaataagcatgaccctggtgagtgcagagcctgctatagattgagacctcaaagagaccttgtttcaaggacagtatccattcttgatgaaataccacagggctagggagcccagaacagatgcaagaggctggtgacatctctgaggacatacctgtcctggtgacagtatctcctggcaactggtatataccccaaggtcttcccaaggttcacagtcataagagtctcactcttcctccacagtgaggaaggcaggacaccaggcaggaccttcaagctctcacagcacttccaccagaagcagacagagtttgtgctgtggagacctctgcacaaaatgtctcagggcagatatcccatgatgatgaagacaagaggagacagggccacaagtcccaggttagtcccaggttgagcctaccatgacagcaggattctgggcaacttccactgtcatcaagtctgaagcactttctgtttgtcacagtgctaggttacaaaggtaaccgtgtacatctttccctgggtcctggtagtctgaactcaggtcctgctgcttgcacgtcacgctctttacttaccatggagccaccccctcaatgcacaaactgtggtttcgggcacccgttttcacacttgtccttagtctttttcctgccttgttcaataactctcttctaattacttaagagacccgtcagtccatccctgctatttcttatggtaagaggccattggctgtcagaatccacatgactgcctgacctctatatgacggatcaaaatcaatgcctaaaacaaaacacaacaccaccaagccataatccagcaatcctcacatgaggtttgaagacacaaaacccagcgataggctcactgctgtgacctgcatatatgtgacgacatgggaacccatgtaagtgtgctcagcccacagacatactgtgccacaattcttgatcccatgacgtggcatttctctggttacttggacagcttacttaccaagagcaccaaaccaactaggaatgatgggctctctctattggctacctctggcttgtcaatcactttctgtaaaagtcctgtggccaactacaaacatgcaaactatgtgccttcagaggactggaaactaagtggaccagggagaggtaagatactggagtcctgcctccatccaggccctttcctgaattcctggcaggtgctaactccttgggccccttgcgcgggggtagatgaacaatgatctagaagtccaaggtctccagaagtgggtcagcaggacctggggcccactggcctcccttctaatccaatcttaatcttgctatccaagttttgtggcttcagggtgtggccccagagagctgggacccacccacagttatctaaacacagataaacaatcttcaggcagagccacagaactagccaggaaaagattcaaaccctgtgttgacctgtgaagcctttggcgactccttgggttccgtgtatagaactgctctaggataggaattcttctcaaaggtatttggaggctttctttctctgaagcttgcactctgatttatttaagccaagttagtgcctgcctcttgtggaagccagcttcaaaattcatgtctcacccgattctcccaatcataagggtgtgaactatttcaaagggtggggtgcgactgcggctctagactaccctggtccttcctgcaccccagagttcgtttaacaaactctgtgctcggtcaggggcaggacccaaaatgattgtcatcagcccaggcatgctgaagaagccgaacacagtattcctgacaaggagacagccaagagacctctcaggtacattccaggagaaagctgaacgtgtgtgactatcctcttcacagagggccaggcaatgctgatatcatgcaaagacccgagccggcaaactcctgttacgctcagagtgaatggagctgctctcagggctcattcagttaggttgctgactcattcttaacccgggaagccccacacgccccagtgagttgctcagaacaggctcctgtcttccctgcagcctgctatgcagctttttaagcaaatgaccgctttttagatttgctttaaaagtggcacagcagttactgtaactgtttatttgacagtaaagatgtttgtaagaatagcagtaactcagcccactcccttcccccatcttccaccatgcccttcctggtccctagcctgtggcttttctttctgcttttgaacacattttccacctggagcgttaaagggaagcacgggatgtagcgtgttcagagaaaagacaaaattctgcctcgctgccatacttcttgccctgaagctggacagctcaggcctggctgcctgagtcagagaccagaagctgcccccggggttggctcttccttctgcttcttaggagcggaaactagttcaacctcagtgcccagttaacacaaactcacccacctccgtctctgaccttcactttagcttctagctaggaatccgtggtggcttccttcccaggcaagcctcacgctctcctctgagacagcataacacacagccaccatccacaaggcacagctcagaaacttcctccaagagtcccgcaacagacacaacaggtgggctggaggcagagggagccacttttctgacctcacaaaaccttcaaagtctgggagaagcagtgtctaccccagaacacagcagctgtcacagctcagaggtgcacggaaaacatctttgactgagagtactcaccagggagaagctgatagacgggtccgcctgccttcccagccactgtgctgtgaagatcccaagatatgcgcagcttgcctggaaagtcactttgaaacttagaaagcagacactgcaaagtcacccagtcccctcattctcagagatgtccacatgattaggaaaaaaaaaaaaaaagacaagaaaagaaaaaaaaaaactgcaaagcagacacctcagtcttcattgtcactggaaccagatgactcgtgctgac

SEQ ID NO: 419 - DNA, 6911 bp, Mus musculus
tttcagagtaaaaaagaaaaaaattgtagacttatgagctgattgtgcaagctgggtaaacagaggctggaaggagaaagggacctggaacctggccagctgttaagggatgactgcagttgggagcactaccgatgacaggtctgggttcaagtcatggcctctgctcctgccagaggttccaacctagaagacttgctcgggaagaccacgcagagagtgttccagaacctccagttggcaggttctcgggctgtttggctttgtcctgttgggacccaacatacagagggaaaactagattaaaactaggctgtccttctcagaggcgggtggggtggggtgggggtggggggcagctgctgttcctcacctctgcctaacatccttccctgaagcagcaaagcccctcacctgggcagtggctggggctccctgcccacactgtggaagctagtggaccttgtaggcagctgcccctgacctcccctcctctccgtctcccctcctctgctcctcccctccctgcctcagccttgctggagctctttcaagtcctccgtgctcctttgcctggactcctccagcctccaggcctttgcacatgtgcgggtgtggttttcacttctggaacactcctaacctcaccctgcttttccagttaactcttccaactccatctctccttagctcttcccttcatgtgtatcacagttagcatcaccccacaaacacataattcacacataccacacacacatacacacacacataccacacacacacacacacaacacacataccacacacacacacaacacaacacacacacactccatccacatggcacagaaggagactcacttcccctccatcacacagcccattctgcacaccacagaccccagacactggctctcaagtcagtcaggcctcccatggcctccagccttgtcccctggtggatctcctctgagggcagaaaccctgatagaggcttttctggttcagagactggcctctactccctcaacctcacaattatcactgtcctggccccatgctccatccatccaggaactattcttcctgtaaacaacctttacccacactcagtcactcatctgaccccaactgcagcttaaagttacagccctaaggtaatctctgtcttgagtctcaaccttttcatctgtaaaatgggacaatactgaaaattaccttgtaaaaacacagcaatgtcatggtgggaatcctgtatggccaaaaaaggtgagtgagcttatgagagatgtaggtgtaaccagcccctacagacgagccacccctccacccccacctcccaccccccaagccccattcctttgagtactaaggcctccctctcctttggatcagcaggaatccagcactcagattcagaacagggcacatcctttcacatgtagagctgggagacaccaagactgtagaagagtgggaaggtccgcatcacccctccctcgcttagacctgaaccatgcatggagggtctgcagcaaggatccagttaccctcagtgtacccagagtcaagcagagacaggaaacaagggaatgagggcagtgtgagggaaggctgctgggatgtgacccaggagcccccatgctcattaatgaccatgtctgggagcgaggaatggtgggtccacgagcagagtgtgtgcccagcacgtacaaagtcctgggttctgtccacggcaccacatcacaccaggcaggctggcctaggtctgcagttccagctctcaggatatggaggcagaaggaccaggaatccaaggtcatccttggctgcatagcaagtttaaagttagcctgggctacatgagattctgactcaaaaaatgaaaacaaaagaaaacgaaagatttggggagtaagaatcccttgagcgtgttaggtatggacctgtgaaaatcttgaaattttctttatcagttccattccctgtctcagtacgatgtgcatgcgtttacctgggcaggaagcagggtgtttcagagcaaacgcaaggggagcaggggcaggagagatggctcagtggttcgcagttgctgctcttccagaggacctgagttcagttcccagcaccaaaatcaggcagctgacaactgtccacaactctagctccaagggaccctacacctctggcctctgcctgcatgtgcatacctgtgtgcgcgcacacacacaaatgtgtttaaaaaccacagagaacttggcatttcccctccttcttgtgagctcagacaagtctccatgccctgctgaggacctgagtggtgtcccagtgctgttgagaggacctttaggtgacaaatataaatcttatggcatgggaaaccaagaaccctgctccaattcctacccacctcaccccagaataactagcctcggcgcccccccaaacctttagctttgtatctctgaacctcaggacctgatagccaaggcaagtcctggatttggtaggctaacaccaacacaggcgggacctgtgacaaagtgaaagcagctcaggctagacctgtgacagagtgatagctgctcaggctagacctgagacagaaaggcaggacagtttggtggtctgaccaggtactcaggtccaacttctcagttggatttggggaactcgtctgagtggagatgacattcttcaaccacgtggttaacttgactgataagctgagaacacaggcaggtggaccaaagcccttgtgtccattctgacatgacagccaagtgctggcgttgtcctcacaacccaggaagcacccagggctcaatgagttgtgacagatgaagagcctggtggacagcgaccctttgaagccacactgctatgctaaggaggtggcaggatctgcacttggcccaccctgaagctgggtgttctaaccaccaggcttccctgccttgtctccttggcagtgaagcagggtgcacttcatagagaagcctgggagaatgattggaggtaggtgctagctgcaggtcaggccatcagaggaactgtctgaaggtcacaaatcacagcacccccagccccatgttaactgggaagaatctcaaatgatcacccacccttctggccagtcctatacaaagcaaagcttccactagagaggttgagacatttgcccaaagacccacagcaagatattgccccctcggtctgtagctagaaggagggaggtggaccacctgggttctgatctgggtctgtgactcgccttttgtgtcaaagaacctttgtgcgtagtgtccttgtcctggagaatggaaacatgaggtccctttataaagggggctgtgcgggaggcagtgctgatgaagactagagagcccaggggcctgctgagatccagagatcccctccagcacccagtggtcctccatgatgctgggcattctgctgagacccagaggagcagctgcaagcttggctgccgggcagctttcctgctgcacactggccacggggggaagctagctggccaccggatactccgcagataaccagctcctgctgtgtgatttctgctgggctgggagtgggggtggggatcagggacgccccacccccaggaggtgaggggcagaaaacaggactccaagccaagcaagtggagagtgcaaagacccagcgcagaaaggaacagaatgtgccctacctaatcagagctggggccaatggctggagcccagagccacagggggatgagacaaaaaggtggcatccaggggaagctggccatcagtggggcacgttgtggcagggaactcaacatggaagccagttctgttgctgaaggaagcagcagcctggtctgagttccaggaagatttgcatggctggctttagggagggataccaggtgggcagggaatgtgggagaggagctctgggagggggcagagaggggtaggtgcgcacagcacaggccgaagcagtgggaacgggaactttgggaagagtccgcaatggcttaggggtggcgatctagctagagtgggtgtggccagaagcaaagggcagaaggaaattccaagagagcagcccctggctccagcgaagaccaccccagctgcacttgcagcccagggcgcttggcaggacctctccacttaagactggtggttcagagaccagcgtggtcggagccccggagctcgggtctcagaggccccgagggttgtctaaactgcctcgtgggcactctcagcactcaggtgaccagcagatggctgtctgtaggggcgtggccccagctgactctcagcctgcagtgcccactcggtcctgagtgtgcacagcccgcggaggacaagcagaggtggtagatagagctgaggatcctgggaggaagctagccaccgtgtgctcccttctgggcaccagaaaaacccgggagctagaaatacaaacccagccttggaggcctgtatctttcctaaggaaggtggatttgtcagggtggagggaagggatttgatttagctgcttgctagcctgatttataatttgtaaacactcaggcaggcctgtgggtctctgcatatttccaaagtccagagaagcagccttctggaccagtagctgactaaccctttgctatgcttcagtccttcccagtagtcctttctttgtgcttgccccaggggtcctctgccattgggggttcagtcccagcttatattcctggagaccacaaggctctcctctgtcactggtcaactacagggggtttgctggggtctgagcagctgggcacaattccacctctactgcgggaagcaacacttccctgaagagcagaagaagcctgtaagaaaggcagccctgagatggcggggtaaccttgagccgtttgctctcccgaaaccccatcttcccaatggtaccacttgtgctcactcaggcgcaccgtgggacgcagagcccacgtgtgccccgcatttgtcaagcacatggcagggattaggaagggcgtgagttacatcattcacttctttttacagctgagaaaaacaaaccgaggctcagcgaggtgcagcagtctgtccaaggtcacacagcccagaacaggacagggatgtcccagttacacagcacccatgggactatgcggccgtaggactgcacctccttcacctattccccggtcctctcaactctcaggctctgcaggctacgtgggggacacagaggtgggtggtgtgggcagagcgcagcttgctgggaggaacgggttaatgcgctccgccgcattgggccggcctccaggagagccagccaatgggcatgcttggtgatgaggtaatgccaggacgcgcagagtgggtggggcttgagtggacccctctgctccttctgactttctgctctccttagcaacccctcacctttgaccttgatatcccggctcttcttccaaccttgagggactgggatcatcagccccctgcagcactgagcctcacgcactgctgcagatgttcagatgcatcctagcctgaataacaccccctggacctcagtttccctagatgtaatttcttaattgtcaaagtccctcccagtggggtacctgcatggatccccagagcagcaggcagccttgccttgcctttgacctctgccccgtcgcaatggttcccagaatccggggccaaggagtcactaggccagtcacacccttcacgtggtcccgacccttgggtgcctctcctgactgatcccactgaccccttcctcctaagctaggaactagctagccacacaacagccgcagcagcagcaggctcgcagcggtagttagatgacaaagttcaccaaaccactcggcctagcagagctgggttagttaaacgtctactacgggcccagagctccggctccgtgtggcctggtgccctacaaccctcctgttgtcgctatatgctgaacgccacccgggcacgaagcagttaacgcccttgcagcgagctggcagagccggctgcccggcttattagtcagccggcggggagggggcggagggaaggagggaggagggagggaggggttcagtggagagccgcagaaagctattctcaggggctcccgtgtgtggggagggcggctcagcgggaactgccgcttcccagaaagttgattatttttaacccaggaagaagaaaggaaggaggcccagggaggactcagagaagacgaggaaaagagaggagaggagagaaaaagaggagaggagaggcgagaacaaggagaggagaggagagagaggagaggagaggagaggagaggagaggagaggagaggagaggagaggagaggagaggagaggagaggagaggagaggagaggagagggatagatatttggagggaaaggacaggcagggcagggaggaaggaagatgaggcttagatatcccacagcaagggttggggaacgctctgggccaattctggaggaggaatagatgtggggtacccacccctgctggacctaccatcctcctgtccttgtggactggcctagttgcatgggggcttgagggaggaactgggcacaaggcagttccagctcctgggagtgctctcaggtcagtgggcagcacaatggcacagccttgttctggccttcacggtgactcctgggagtctgcatggaggccctgggaaagaggacaaagaggttgccttggtgcttgggccgagagggattcacttacggggggggggggggggggggtgtgggcccaagtcacttctcctacctctaggtggtgtcaggctgggaaggcacctcagaagcaggagctgggttcacagagtgagacaagccagagacagctggcccac

SEQ ID NO: 420 - DNA, 17605 bp, Mus musculus
aatagtaacaagacacaaccttgttgatctaaaacagtctggaatgctaagaaaaaagacgattcacctgggaaaaggtcttacatttccttctgttgctactgatgaaaatgatcttcattaaagaaaaaggtaatgtgaacttaggatatgggaggagattctggtttttctgactttctcttcagtcaggaaatgcccagatcaccatttactcattttttttttccttctcctagcaaaaatgaggattttagcaaaattttagccacttacttttctagggattaaaatcgtgattatgcacagaactgaaattcagtgttttctcccgtttagcatttgaaagacatttattgatgtttagtctgtacaagacacagcttagggtctgaagatctagtgtcaacaaacaagaaagaaagaaagaaagaaagaaagaaagaaagaaagaaagaaagaaagaaagaaagaaagaaagaaaagaaaggaaagaaggaagggagggagggagggagggaggaaggaaggaaggaaggaaggaaggaaggaaggaaggaaggaaggaaggaaggaagtcttcatcaaatacatattgtcagcgattcccttgccttgataactgcactctacatttcattcaaactccaggtgatttgctttgtctgctctgactcatggaaaaggacatttcatgcagatacacatactaataaagacacaagtgtacacctgtatactttttatccacatgcaatagtattttaattcaaattcaactgaacaaatatttattgaagcccaaccctctaacacacagacccaccatctaaggatctggatgaatcagagcaagtctctggaaaaggcttggaaagaagcgcctaccgggaaggacagagatagaacacacctgcggtcctagctttcaggaagcggggtcaggctagagagccacagaacagcctgggatacccaatatgaccctggctcactcgaggacaggacagctagtttcactcttagcaaatgcagggaggtttggacagtggggtgggggttgtctccaggaagccaccgaatcatcactactctttgcattgcagacccagacccacggacagcatcacccgaagcaaactggcagggatcagacactgcattgtaaagattaagcagcactgggccccaacacagatgggactgtggcctacagggagatctgcagtcagagccagtacttcagactactgccagcagagacaagggtaagtagactgaaaaaaacagccaaggaagagaaaggctttcttcaatcaagctggggtttgagtagctcctaggcaatgaatatgttgtctagggagtgtcagcaaacccccttctcagctcatgctgctattatagtactgtgtggcgcttattgccttacactacaatgatttgtagttgtgtctaccctcatcctcccctccctaactccactgtcaaaattcaaagcaggcctattcatctttccatctcctgaacatgtgctcaagaaacaatgggactggcccgctttcagccaagcaattgttagccgtgaagagcaataccttccctggttacatgtagatcaatatcggaggcgtgacatggttgttcatcatgcagtcactagctcagcagctcctgcttcacgctagatatcttcaagtttgaactccctctggtacctgagagtcttgccctggtcagcatcccaaacaaatactgaatccactcaacgaaggttcttaggtgctgatctaaggaaattgaacttgattcttcaggcaatgggtaggtgctgaaagttttgagcagggaattatggcccaactatgacatatctctgtataccataacatactataccataccataccataccataccataccataccataccataccataccatacaataccaggtccaaatactgaagtcttgtctccaactggtgacactgttccagagtggtggaaagttaaggaagtagtgcttaattacaggaagtaggtctttaaatgttaagtgtccctcccagccccttcctctctggacttcctgtctacattaggttaggagtcttctcaattgccctgtccccaaccactgctgccatgatgctcaaacataattcaggcccccaagtcatgaagatctcagaaaccatgtgctaagtaaatccgtcagtgattaaaaacaaacaaacaaacaaaacaaaacaaaacaaaacaactctgatatatgcttaaattacatgtgtagagtggcattaaactcatgagccaaggaccccaccactgggctgccccccatcccaggcctttctaaatgaggccttgaaaggcaagatctagctgtagggtaaagggcacatggtctgtgtacctcaggaggaataggatgccagtggatgctgagtgggccaaggatggtggcagaggcactgtggaatgactggcacctccaagatctgttgatgctgcctcccaaaccatctctaaaatctaactgctaggtccatctccatttctaccatctccaatctagtcagcaacagtaactacttttgagactcactctgtatgctgttgctaccctctagtagaaagaaagctggaatggccttttaaaagcacaaattaagccaagcatagagacatactcctttagtcccagcacttgggaggcagaggcaggcaaatctttatgtgttcaaggccagccagactcacatcacacacacacacacacacacacacacacacacacacacacacacacacacacacactcacacacacacacacacacacacacacacacacacacacacaaattcacacatgtatacatgcacatgcacatgcacatgcacacatgcccaaatattccttcctccagcttgacactccctagtggcgttgttcataccactccaccatgcaccttctgcagactcctctggacactcagacttctcacagctctcttcttcagtagccattcttgtccctgttggctggtctggtctagcattgctttgatctatctgtctagaatctgctctacttcaataccatggtcttgtttcagaatcacagccatacatcctgtgcccttctgtgcagagttcgatgaatggcttacttacaggtcttgcctatagaagctataaaatttcaaaaatttcccccaaataactatgaaattacatgactctaatacttcaagaaaggaaaatattcttaaacattggtactaaaatccataccttaattttaacttcatttttattccaaactatagtttatttgttggtttgtttatgtttgtttacttagtagatttttaaaggtataattttactatgtattccaggctggcctttaactctctatggagtcttggctgacctgactggagatcatcctgactcggcctctccgtgctgagattacagctgtagccctgcaagcatcttggctgctgcattaacgtaactctaaatatcgttttaggtatttttaggtatagtgctaagtgacacaaagcatgatcatgttcatatcgatcgtcatctaacttcaaagcttctctttctaaaatgcagctccagagccattcacctctgcacttcctttcagtcccaaactgaggttcctgcctctgtatgctttactcaggccaatgggacacagcagggtttgccttttatggttgacttatttccctcagtatggtatcttcaggactcacccaggtctgctgcgtgtcggaatgctaaggcagaatcacagttcagttgtatgtataagtctttggaattcattgatccatgatgtgtgtactgcccttatctttggctaatgtatgataataagtgtgtgtgtgtgtgtgtgtgtatgtgtgtgtgtgtgtatgtgtatgtgcactcatgcacacactaacaaatgctcagcctctgatgtgtgtgcatgtgtgtatgtgtatgtatgtgtgtgcatgtgtgtatgtatatgtgtgtatgtgtgtgtatgtgtgtatatgtgtgtatgtgtgtatatgtgtgcatgtgtgcatgtgtatatgtgtgtgcatgtgtgtgcatgtgtgtatgtatatgtatgtgtgtgcatgtgtgtatgtgtgtgtatgtgtgtgtgtatgtatatgtgtatatatgtgtgcatgtgtgcatgtgtatatgtgtgtgcatgtgtgtgcatgtgtgtatgtgtgtgtatgtgtgtgcatgtgtgtgtgtgtgtgtgtgtgtgtgtgtgtgtgtgtatgtgtatgtgcactcatgcacacactaacaaatgctcagcctctgctctcagttctcagggtgcaaaaccaaaagttggattgctgagccatatggtcattctatagcaaagcttttaaataaccgccatgctgttctgcacgttgtctacctagagtggacaaggagtctactttcttggtgtacttggtgacacctacttaccactcctgttactgttttattgtagctacccaaatggccacaaagtccacacaccgtttatggattctgttgtaatataggaacaagagaaattccacttaagtcttgttccttgtgtcacagaagggctggctggcccaagtcaggtaactcatacaatgtcacacagaatggagctagaccgttgaagccagccccctttatccccacctgtctacgagtctcttagacactcaatacagaaatggagaataaaacatgataaataccaggatttgggattcgtctggggtagtgatgagattttgtgatggaatccttgacttgtatgaactttctaataaaatcagataggcttcattcagaaaggctggtgagcctcagtgagccttggtctcctcctcatcaaaatggagatgacaatacttgcctgccaggagtgttgtaaaggttaaatgaaattataaatcatcctgtatagtcctgatattatacctaatcacttttttaaaaagtgatagttgcctagtatttgctaatttgacttgttttttgatgatagagccttccttggtttggctttagcttatttctggtagtttctttccagtttagggagggttctagcaaaaggtcagaggaacaacggcagcagatggacttcctgaaccgtgtgccaaagggttcctcgtccgccttcaggctgcagcctccaccctccacacagcatagagaagctcaaggacagacccagacattgtaactggaccttcctgagcactccccggggcagactccaagtctgacgcagaaaatgtgctgcgctcatcaccgcagctgcccaaggtggagcctattgtcaaggttcttcatgtaacaaaaagaggaaagggcctatcaaggcatttcctgctcacaggagccgtgagcttccattaattctttgtcctgagtcagtctgtctcccctaggccagccccgcggcagacctgcagtcccctagaacagaacaggcagttaattttaaaaccttttcaggaggttaacaagggaacaagttcggaggtcaggtgacaccacctacactttccatatggagaacgacacagagacagtacagttgttcagaaacctgctgaaacttgctaactgcattgctgctggcacagatgtgtgaggacaggagggaagtctttacctgttttttaatagacgctttctgaacactgcttcagtctatacacgcattaagtctatgctcgtattatggaaggatgatctaggcataaaggcagaaggttgagaactgcgtcagttagccatgaggtgagtttaaaatccccaaatgaatgatgggagtttcaccaactaatctaatgtcttttcttggggaaggcctggattcctagagctgtagggtgagttattcagagtatgcatggtaaggagttaatctcacagaggatccagcaatgagccagacaaggaggaagaagccaagtgatgtgtagatggcagtgctgtgggtgagcaccaaacgctaatctgagaccaaaatttaaaaattataaaaaataaaaaggtagaaatcaagacatcatgaccaagtgtctgaaagaggtcaccataagtcatccagctaccagctgaccacagaggcaccagagagccagcagacagtgacactgacccagatcagaagaaagcactcaggcaaacacggagtttgtactaagcacagtagtgttcgcctccagctactacgtgttggattgatctggtacatgtgatgtctgtatgtctcaggggtcaggagggaagctctgctgtgcaaagtccttcagagcttgccaaggtagggtgaacgccctcaggtctctccgtctcccttcccctccactttatttcaccctgatttttagtggttcagtttctcccattaattagtaaatcaggagtcactgttttatattacagatggtgtgttgtgttagcgtgattgtcttcccgagtcaagctgcagtccccagaatcttgggatcctgctctttcttagcttagctgcagggctctctatcagatacagctcaggctggcccaagcagccactgcacctcatttgccctgtgttttcacagagctttctgaaagcaacagcgaaaattcaaagtaaaactcaatccttttacacctgtttcaaaaaacaagaaactaatgtaaagagatgggtgagaggaagcagatttgaaatccatagatatagacccattgatatctttcaggaataaaaaaaaatttacattctagactagatcttcaaatgtgaaagaaaaagacacttgttcatgactgtaagaagctttaagccaaaaaatcagatattccaattgccattttgcctatataatgttcaacaattaactaactgatttattttaaccaagttatcttactaaatgattatttaggataacacagtatgatatatatatatgtgtgtgtgtgtgtgtgtgtgtgtgtatgtgtatatataagatatactataaagaaattatacaaatattacatttcccccaaagtaaaatcaaagcttggttggtaaaacattagcaagccttccctctccagttcccacactacttaaacacagattatggagctgcctaagccattccattgattctgaaatccttcccctataaggtaagatatatagagttacttctgtggtcagcacaaccttttcctcgttgagaaacttccttgcctccgtcatgctcaactgaatgaaacgcccaggctgcgacaggttgtgataggactccaactggaagaagccaggacacagtgttcagctgtcttagatctgtaccaagacatacagagactctatcaaaaacaacagagcagaatgtcagcaaagctgctttccagatgttcaggcaatttgttcccttccaaggaaagattttaagctaccatgcttaagggaaagcaggcaaagtacttaggagtggcaataaatacaccctggccgcatgctgtctcgtacacagctctttcaatataaaccatggctctccctaatgggccaaggagatagatgccaaggtacattcaaagagtactgttgaaactgcaaacaaatacttgtgatgaggtgatatctgttcatgttaaaagcaaaacaagcacttgtggagtgcttattttatattaagttctatgctagaagtgcttgtaatgtttaaccaagagcagagttcacacaccctttccggcacttaaccaagagcttaacagccgcataggttattagttcagacttacagcaatcgagagagacaggcacagaggtgttctgagttgaatggcataccctcagtggaaaacccatgggttgaaatagctcacgatatggctgtgcttggtggtagaccctaaaagagaaaaatcagttaaaataagatcattggactgacctctagtctagtctatctgtgacttagtctaagacgtagaaagaagggcatatgaaagacttgggagcctgctgtccacatggagaggagccaaagacaccagcagtcctgacctcacacacagcctccagaaccgggaagaaataaatctctcctgtttaagctaatcagtcaatggttgtattagttatggtttgtgtcactataacccaatccctgacagagcagtttaagggggtgtggtttaccctgactcatgctttcagactgtacagtcatacctgtccgggcttgcagcagagggagagcattatagtagactgggaaacagagagtataccaggcccagagcctatagccgccgagtgcccactgatggtactccatttctcccagatatctcccagctcctaaaagtcacacagactttcaacacactgccactcttcaggaataagcaacccaaacataagtcacgggcatttcagattcaaactacaaacagcagtggttccaacacactaaaagatgatattgtcatcaccataagttgataatgaaatgggttaaacaacacataagtaacttcctcaaaattctatgaaactaaattaaaaggctgcccgatcttcataaaacctcttggcctactcagtttgtctgtctgctgtccaccatacagcatattcatgaagagagggtcaaggtgagaaaagtcagagagcagctttgtcccttagcaagcatcctgtcgtcgatggttctttttccagtgctgacttcagcattcctgacttgagtctccctggtactctgctgtcctccctgtagagtctctgtggatgaggcgcatcagggggtgagcattcccagagccactgatgcactaactcactgaagtagctgctagtacagatcattaagtggtccttttgaaaagactaacttgtctgaagtaagaaagaaagttccagaatagcagcaagcgggggaatatatgaagaggagaaaaaaagacattcccttattgttttgaaagctcagcaattgctgagactatgcactttggggagtttcagtgatgatgtaatcaccggggactggtacaatcaggttagagttccccggcacagaaagtcagggtaatggtattatttggattagatatgataagaatgagtcattgcatgataaggggcaaaccacacctcgagtcagtctttgcaaactgttccgaggcccacaacacacctggagctgtacagatgaatagaaatgtgcgtgtcttcacagtgaatttagttcatctaaatctgattggtgagtctcaatctgactgagccgtaccaacacccaaggagcaattgccatgcccaggtagcagggtccatcccctgaaactgggtcattaaactcatcctggattttaaagtgttctccagaccttttgataagagtaggcttgcagagacaggctggacctggtattcgatgtggaggacttcccccagtctaacgaggctctcccaaacctttccacggcgaacactagacatacggaggatgagaagagagagtggctgtaaataaacccttgtcctgataagcatatgtgtacgccaaatgtcagactacatccgaagagaatacagcttggcagtggggaggggagatccatcaatgccgactgtaatccttacaataagtgcaaggctcccctccaaacttgagtcatatgttttcaataagtgacagaattactatgccaaggaaagcctcaaagccatgagatagacccttcccttggtcttacattgtgaagtgacaggaggcccagagtaacccaaggagtgtcttggtaaaacatgctttccccagctgctcaaggtgcttggtgaatatcttatctcgggctttatgaccggagcaatttggaatcagggaggcactgggatggtaacagctctacccacattggagatgggctcaaagactctgccctctctcagtcgtggaaatgagtgaaaatattagcaaccagtgtgtgcagaggcaccagccacccagaacagacagagtctgaaagcacaggagacccacacaaggcctctttcctcaccttgtgtctctggcgtgcattgctaatgatcaaaacctttcgctggggttttgttgtgcttaagagaaactcctgcttttggtgggatgccagtgagggaggccaggcaggtacagttcaccattgcccttggggataaaactgccccgtgagaataaaaccggggcagaagtcatccagtcacagacaacaggaaggaatttgcccaaagaggagttggaaatacttcctcccctgaattcctgtctcagtctggtggtatttgtgtactgctgctgtccacgggtgaagaaacaaaggccagagagtgggtgtggggtgtgaggtgctctgggcccctacagccctgtctgcagtgtttggtgtagcgtgcagtgggaaagttactacaggaacaacctgctttttctaaactgcgcaaaaccttaaggggacctgatgtttattgccaaaattctgtaaggtaattttgctagcgggtttctgaactgtatctacagactctgtgtgtccacaccgagatgtagttgctttagtgggcctgtgacagacactccacatgtctagaaacaggcatagtactagcaaagtagtcagactcactgcaccccacgatctaagcacaatcaccgagcttaaggttttaacggggcagtgtggaaggttgccattttcctatctcaccacacagccttttcttcttctgggtcaagagtagctagctgccatgtagcagctctctgtcactaagtaaagcccccccccccatgccttttccctctgcagcacaatggaaaggccatggggttccggaggcatctgagtgagctgtgagttcagctgctctcccacattatttttcaaggccagatgtgcactcccaggtggcaagtgttgctggtgtatgtaaagtccccagtgcttctctgttgctttcaggacaaatcaatcctgctagtccttaaaggctcagcgatcttctaattgtcactctttattgtttagccccaccccaccccaccccaggtcacaatcgatgggagactcaaacacgagtcactcactcctgcctctgtgaacaatatgcccgtgggccagccaaaagggtttcccttttgtctgttactctttcatggaatcttgaagcatgtcccaggttgggactacatgctaatcctcagcacatacacagattcaaacagatacacatgctcacatagctataggctggacacactaacatacactcatgcacacacacacatgtacatccactcactcagacatattcatattacacaagaacatacatgaacacataacctcacatagacacatgtatacacagacacattcacacactcatgagtgcttacccagatacacatatacatacacaggaatacagatttgcacatgaaaacatacacaaatacatattctcatatatccacatggacatatgcatacacagatatacctatatgtatatacctagatacatacacatcaattgcacaaatatagatgatgcacatgtgactactttctcatacagtgtgtgtatctatgtacctcctacatttttgctgggggagtgaataagatacaaattcagcacccctccccatgagctccccatgcaggactggtcatttcatacctaggccatgctgggaatgtctgtataagcagaaagtcacctggtgtgctctgcaaggaccaagaggcccctggcagtggcttttcttttaagttagcagatcagacttttcagagaaatgtcaatgacattcaaatcacccgtgacgatggaagaatgtgtagctagacccacaacccagacctttctcaataaatcctgtatgctacagaatcctcttgctgcgagcaggtagcaagtggaatgaatggaacagcaagcctgtgctttctgtcaggccccaagagaaaaccagcccccagcccctaagtgcccagaggagacataaggaggggccttggttccaagctgtgaatgtggcactgccttaaatgcacagtgccaccgagatgcttaactaggacatgtccacgtggtaagcagatggacaggtgagacaatgactgacagaagccatactctactatcttttcagttgattagtgaactgcagaggaggaggagagcttggtctctcatggtaacacaatcaaagctgctatccaaaggcacgaaggccattcttcctaagttgtatgtcatcagcaagatccccagttgttgaagtttatagccctatgtgcatggggatacatcagtacagacacacattctcttatctattccatcaaaatacgtttagagaattagctggccctcggtatgatacgtcagcaaaagttagcaatgatggtgatcccagtgaggtgatcggattaatgagctactaaacccttcatgcttttatgatctcttattacactaagttcttacagttcatatggccctccttgtgtcagaaaaagaactcagaactgaaactgtcctcctttatgtcgtttaaattttgttttcgattttgtgtatatatatatatgtgtgtgtgtgtgtgtgtgtgtgtgtgtgtgtctgtgtgtctgtgtgtctgtgtgtctgtgtgtctgtgtgtctgtgtgtgggttgtacaagtggatccagatgcctgctgaggcaagagaggtatcagatccctagaattataggtagtttcgagtcatacaagtatgtattcttggaaccaaagtcagtcctctgttaaaaacagcacttgctcttaactgctgagccatctctctgacccctcggctctgctttcctgataatgcctatttttatccgacactactagtgtttattatgcagttaaaaaatcatcttgtacaatcacactgattctgctccgttcttcccaaaagaggggagacagcttgtaacaagctactggtggaattttcgttttttctccttcacgcattggtgaagacagatgacactacactctacagataataacagcatcagaatagagagttctgagagcatgcggggaattaaacctaagttcagcatctgagctgtgcttccttcattgggatgcataaaggaagagatggactaattgatcgtttagacatgatcgtaccgagcgacagttgctggccttgagttcacaatcctctgcctatttctcctgagtggtagggtttcaggcagaggcagccagacccagctctgtctttgaatgcagtgcaacttaaagattttcataatggttcccataaggactaggtcacttattctgagcacacacacacacacacacacacacacacacacacacacacacagctcagtgtgcatcagactgaaagccaggagactgaacagaggacttctccacagtccctactttcatgagcatattctggccaagtgactatccccgctgaaggctgcctctgtggttcttaacctcttttggtaccatctgaaaatctgatgaagagtatgaataatcctcctagataatgctcataggcatttttcacacaaacacacacatacacatatcacaacactcacatatacacacaaacacacaccacacacacatacatatgcacacactcacatatacattacatgtacacacagtcccaaacacatcacaacacatacatacatacatacatacttatcacatacatttacacacatatgcacacacacatcacacacacacattcacaaacacatcacaacatttacacacatacatatcacaacactcacacacatgacatacactcacacacatatgcacacattcatatacacatcacacacactcacaagcacatcacaacattcacacacactcacacacggatgcacacatacttgcatacacatcacacacacacgcacacacacgcaaacacacacacacttgtagaataattctccctccccccctttttttatttccagggactgaaactcaggatcttgtatatatggtcagtgatctaatgctgacctataagcctagataagggtcccatggatcaatgtgtaatgaccttcaacaactcaataattattgacagaatacagatgtttaactatgttcttttctttttataatttttgtatttaaaattctggcttattgggatgtgaagtatataacttaattaatttgaaaaataaaataaaaatctggcttaaccctcctgaaaggttccatatagctcatttgttttgatatagcatattcagcatttaaaagagaaaacttggagccaggcggtggtggcacacgcctttaatcccagcacttgggaggcagaggcaggtggatttctgagtttgaggccagcctggtctacaaagtgagttccaggacagccagggctacacagagaaaccctgtcaaaacaaacaaacaaacaaacaaacaaaaataaaataaaaaacaaaacaaaaatccaaaccaaaaaaacaaacaaacaacaacaacaaaaaagaaaaacttaaaagagaaaacttggtagctttgctgaatttctggaaacttttttttgcctttctattaagaaagcacagtgggcattggcttatgcctttttagaaatgctttattataaattatactggaataaggagagagatattaatgttataatgacccacagaaacttcatcataattcactcgaacttcaaaacataccgtttaggaagaaataaatgggtatgtatctgctgtagtgacagaggagaaatttcacgaaaaatgaagatagattatggatatataaaagcaatattgccaaattactctgtgggaaactctatgccatgaagtttaaaatgggggcggggagaaggctctgtagacacttggcgctgtaacttgttttggaaaagtttggcaatcagcataaagctactctggaagatttagagtcaacccctagaaaagtttacaatgatcaaaatttaccatcctatatttttcccttggggacggatcaccacagagcaaagagaagctaagttgataataatttattagggctatgtatcacttacaatgcataataaataattttaaaaaacccacagcatccttctaaaatcccccatattcatttcctaatgcttactacagtgtctggaggacatttaattagattagattttagcattagtcagagagttttaaaaagcacattcgaaagttgttcacagtccttcggatttatgaagggccccattatttcagctttgtgcaaaccattttgaagtgtgtacaaatcctgtagaaacatagcccatgctgtggggttttactgggctgggccaggcatccagttctttgactttaacagcagggggtgcactgtcttagccattgtattcaatgcaagcagacaattactgatctctaaaaatcttgaccaataaacagcacggagatttagccacatttttaaacattcagatttaaaaaaaaaaacacacaaaacttcagtaaaccacttatgcttcatattccttctcttccctccctccccacttcaatatttaaaaaaagaaaaaaggaagaaaagaaaaaagaaaacaaaataataaaccgaacaacaagaacaaaaaccaagttaggtttgagtttagtcttagggccttgccaacggccctgggtgcgtgcactcagtccccacaaacgcagtgttctggtcagtgcctccatcctctcaggctatgtcctttcctgctgtgagagttctcaacgcctgctgaaggcacttggctcccagtgggacagctcagggctgcaatgagttgcaagtctgtgtagctggtgagttatgtatgtccctttccatcctcggggtcctgtcggaggaagctctcaagccttttcgcgggacactgcccgtgccagagctggcaggctcactgggtctttaaaggtccattggtggatacgctcttgcccagcctgctgtgctcagtgtaccttgatggaatatttccgcagtttgagaaactgaagaagcttgtcttttgtcctcttcttcagggccatgagggctcgagttttctcctccaaatcttggtcgatggcaaaaatgatcttggcccgctcctctgccttcttgtctccggagttcctgaagagcctctgcagggactcctggtctatgttctcaaagatgttgcccacagctttcttgcgagcggctgtgtcgaagtggtagccgtggatggacgggcttactcgaagagacgaggacatgctggtggcttgatggcttggcttggctttcatcgatgtgggtcttccacggctcagcttgggcacttccaggggagtctgttgtaaaaatcgtcccaggacggctatttaaagggtgaacaaagctcgggactcaaattacactggtgacgtcacattgatcccagggaggaaaaaaccacagaacattaacagttgccttgccaaagatctggctccggatgctagaatgcatttcaaagcttgtttagagatagctggctacaagcttgcctctttacacctcagacggcattgtgccttacaaactggctcttccttccagaagccgaaatcaggagagagagagaaaagaaaaggctccaaatctttgcctacgattgaaacaaggagttctgccaagctcaacagagtttcaattagtacaaaagttttaaagtgtgggccagaccctggcagcctaggtctgtgtgccttttgcctgtccctatcagggtgagggtgaggaagtcagaagaaaaaaaaaaatgcttgggaggacaggaagtctgactctggagctaaagtttactgacatggctcagcccgaaagcacaaatctcaaactgtacctgagtgctgtatgtaatttctgctgggaactgcaatttaaacagtaatagcggcagatggtagctccccagcttgtgtaagtattgacagcaacaactattcaaaagcaaggagcaaaggttaatggtggtgctgtgggtacttaatgcccacaaggaatgagctgatcttttgttttgagggctactttggagtcactcagcattatcagaatgctgctatcttcattacacgcttttaatctattacttttgctatccacaagactcagatacgtacagctgttctatgctaaatgtcaccttcctctgacctagagattcctctttatgattcaaatctctactctcctttctggtcctccaagaaactagaatggacttttaatgttatttcacttatagtcaagaaaatcacacacctataaccccatctgtcttagaaggctgaggcaggctagcaagctgcaggacagactgaactacacaggaatgaatgccctgtctcagaattaaattaaatgaataaaatag

SEQ ID NO: 421 - DNA, 13206 bp, Mus musculus
tttcgcgcctccgcccctgggttggcggacaggggaaggagcgaagatggcggagtgaggcgtgccccgggcagctggcctgcgggcccggggcaggcctcccgtgagaagcggagtacttgtgctggaccgtgtgaggtgagctgagaagtccgtctgtctatcgggagacgagcagccggtggggcggcacaactcgggacggggtagcggcgagcctaatgagggagccggcgaggcctgggcctgacagggctttgcattcgcagccgcgtccggtcggctccgccgcctccgggtatgtggccgcgtccttcccttaccagcgctccacgcccttccttgcgcccttcgctttggccgctgcgtgctttgccctggttctctgagttgcacgtacgccggccgtatcgggaagccgctgtgtgcacctcccttttatttttctaagactatctctgtattgtttgaccctttaccgaaggcgtcaccggttgaggttgacaggcctgttgcagctctgggcattttgtgtccctggcgcgttgaccttgagatttgctgtaagaggctccctctggtattttcatttgagtatgtgtattacagatagactcttgcagcctttacctcatactcgcccctgccaaacttttatgaccgtagtaagcagctttgtccttggacgtcctgataatgcccttatggcgcattagtttcggcaaacgggtctcagtggaattcacctatgttgatttcttacccaggatcaagggaaacggcttacgatgcttttcttttcgtttttttagaactatagttctggaagtactgctggaatctcatttgtgtagttggtgtacactggtgacagtgtagtactaacaagatatttatatttgattcttatttaattttatctctttgtaattgggagcccccttacttttattggtattcagctaaattctcggaaagtctttgcttctgaattctggatcggggagacatttgctgcgtgtgttggtgctcagggccagaaatttacatctatcaaaaccttgtttcagaaataaactggcatattagtgagagccagttcaaatggaaaaatcataatgtgagtgaatgtttgtgatagattatatggtttttgttagccctagacttagcagagctgaagcaggaagcacttgcttagggggtgaaaaaaaaaccaaaaaacaaaacccctcccctttagcacaagtagtttttctttttaatatgatccacaagtagaaaaaaataggtatgagccagaggaagggaatataacatccttcctcatcttaaaaaagagaaagtcgtttgctttccactaaaagacagctctacattacgggaggttttctgcggagttacagtttctcgcccctccagagagactacagtatcatatacagtatcataaactcagagttgcataaagcttcagaacttctccaaaaatgttattgtttaaacactaattccactagaggtgtacagaaagtgacattatgattattcctttagaatacttatgagagtgaatttttttagaatagattggttggaatatctttgtatacttaatacctgtagtatcagtaaaggatatgtagatccttgctttggtttgaatgaagatgcccccataggctcgtatgtttgaatacttgggccacagtaggtggaactttttggaaagaattaggaggtctaggcttgttaaaggtgtgtttcactggcgtcaggctttgagggttcaaagactcagagccagccctgctaggtctccctctgcctcctgcttgctgttagagatgtgagtgtaaaaaaatgttttcttttttttaagaattaccttggacatagtgttttatcacagtgataaaaaagaagccaagacacttatctttatgttctttttatttttaggaaccatatcacacaagatgaatattttcctgaccttaggtgcttttatattcagctcaacattctgaactcaggacttggcacgtaagtagatagagataatcatcccaagtcctgttgtagcggcttgaaaggctccatagaagcgacatactaaactgttaagagcaacagaagatgaagataaaaatgagtacaagccagctaccatggctcacctttatgcccagctcttgggacctggggaactgaggtgaggattgagagtttgaagctaatctgggctattctgggtagcaagacatttgtgttaataaataaaacccacaagacctagttattgagaattattatctatatgtgcacatgtgtatacacacacacacctggcttctattttgttttttaaccaaagcagttacagtgtgtcagatgataaatcactcaaccaataactttcactgtgtacagaaaacatgcagatttaattaaattgaatataaactgattaaaaaataaatgttgctaagcattaactttgtgtgcatgcatgagcatatgtgttagagtgtgctctggaggccggaagtcgatgccagttgccttcctcatgtgctcctcaccttattttgtgagaaggttgtgttactaaatctggagctaaccagttttggctagactggcaaattagtcagccctgccatctgctgcttgccagcacagggcttatgtgcaatcgttgttgaagctttttaacattaggaactgggatgcaaacttatttgaacaccaagcactctatgtttggtgcatgcaaggagatggcccccatagactcagagagagtgacactattggaggtgtcgccttgttggaggacgtgagtcattgtggaggccagttctgaggtttcctgtgctccatcgaggcctagatgacagtctcctactgctgcctgtggatccagatgtagaagtctcgacttcttctccagcaccatgtctgccatgcttcttttcatgacaataatggacaacctctgaactatgtaatccggccaaccccagttaatattttcctttataagtgttgccatggtcatggtgtctcttcacagcatagaaacgctaagacaagccaggcgtggtggtccacgcctttaatcccagcacttgggaggcagaggcaggcagatttctgagttcgaggccagcctgatctacagggtgagttccaggacagccagggcaacacagagaaaccctgtctcgaaaaaaaccaaaaaaaaaaaaaaaaaaatcgaagaaaaaaagaaatgttaagacagtaagccatattctcagctctcacttcagttctgttatttttattttgataaaggatcaaaaccaggacctcagtggagagaggcaggcggatctctgtgagttgaaagccagtctgcttcatatttagagttggagaggactatccagtgagacactgtctcaaaaaacaaagcaacctctcctcaaaaacaaaacaaaaatccaagaaaataaaccttaggatgttgcatgctgggcatcatcagccccagttttcagttgtttgttttatataatatttatatgttttatgcatttgaatgttttgcctgtgtgtatgtataccacatgtatgcctggtgcccatggaaatcagaagagagtgttggaaccacagaaggctgtgagatgtcatgtgggtgccaagaactgaacctggctccctgcaatagcaaccagtgctcttaaccactgaggcttctctccaggtcctactgtgggttttgttggctagttggtgagttgtattatgatggagtctctctgtgttagccagcgtagccttgaattcccagttctacttcagcctttcaattactgccattagaagcatatgtctacatactcagttttgattactaaaaatatttgtattttaattattaatttgttttcctttccttaatgtagtagcaggagtgaaacccagggtttcataaaatgttggacagataaacagcattgtatatgctttctttttagttttaagatatatttattttattttaattaattatctttttttttctttttgaaacatagtttcactctgtaccctaagctgtcctgagatcaaggtctctacctcttaacacctctcaagttgctaggattacatatatgatcaatatctgtttgtttggaattttgttattgttgttatatctttgagatggggattttactccttaattatgtttgcaactttatattgatcaggctggtcttgaactcacagagatccctctgcctctgcctttgtctcccaagtgctagaattaaaagcaagtgccaccgttcccttctgcacctgtcctttcctaagtgacaagcacctatcagcaccaagtttcacggcctttgtattactttccctaggctttatataactacccataccctgtggtgctggggaccacacccagcaccttgcacatgctaggaccaccgaggtacatctccatcaaactgtatggtttacaacaaatttgttgtctcggagttctaaaggttggtgccccaaatgaaggcagccttggggtcatcctcaatcatttcccaggcctctgaagggcgttgacttgtagcacatagctatgttcacactgatttctgtctgttctccctaccccataccttttgtgggtctgtttttattctttaatatgtgttctcaatatgttgtccagagagttttttataagctacatttattcctttatgtgtgtgtgtttgtatgtactcatctacacatatatagagaaggaggcttctctttttctagtcctaggattatataggcatatgccaaaacttttttttggtttacctcatgtttatgaattttcccctacatatgtgtgtgccctgtgttatgatctgtcatatgtgtgactgcttggaactgaactagtgtcctctgacagcgtaagtgagccatctctctagccccacagtttctatttgagggatagaaaagattccatttgtttgtgttaaagtctcactacgggaagagtcatcctggctttcaacgctgtaatttttatgctccagccttagtactacaggctaaactgtttgtgtgcacacacatgtatgtgtgtttgtttgtttatttattttaaataaaaaaccttgattctcaggagccgtatgctatgtgtatgttttaaatactgattttacaagtaagtttacatagaggtgccatcctattttccatttgatttgtatttccaggaattcctatgtggactgctcagtgaggcgtcctggttcttccatcctgttactttccccagtgagatgcagatgtctttcgacagattacctccatggtttaggatgcagagactgcctttcttttacgtcagactcaacacaggaaagccgtgaggatgcagccgtcctgttgacttcagcaagaaaacaaaccatggacttgggtcttctgcagcttttgaattggaaagacggtgtttgcaagtagaaggaagatgctgaatttgaaacaagtgcttaggttctgtggcgtgagttgttttctttttaaaagatccaaacaagaagactgaacaaataccaagtgtgggtgacttcaggttttttttttaatgtcttccaattttaacactattataagcacagttgaccgcagtaagttccaaatatttaatataatttgaagtgaaagaaatgttatctaaattctggctcactctttgacagttttcctggacaaaaacaagatacgataaaagcagaaaccaggtttgattttgtatgggagtgaaatcattacagttttatgggtataaatctacatttttaaacaagatttttctcttggagaagaaacctgttgtttataagaaggctttggacagtttaatagtcttaaatgttctgctttgctgttctagtccttctcaggaaggcccagctgggcctgtggctagttcagaatgggaggaaacataggctgggacaatgctcaccctgaactgccagcgtgtgggaggccaaggcaggaagagcagatgttcagggccagcttggacatcaagaggctcaaaaccagtaggaaaaaaaacagagcccagtaacaccctcttttatattccttttgtggaatcatgtagcatgtgagactgggttggaagggaactggcatatgtggtatttcagttaaggtgatgtggtggaccctgatgtgtaactggccttcacctttggacatacaggaatgaaggaaaaactaaagcttggcatataaatcttttcttctaagaaaaagaagcaaagctgtctaatgtagcattgtctgacttttcaacatttttactttatgtggttgcatttttttataaaagtataaataagttccttcaacccaaaatgggtacttggacagatttttttttctgggtgataatgtaatgttatgctgaaaatctgggactcaggtaaattttcccagtttgaattgagctgtcttaccagagaatgggcctcagaagcaatgttcccagtcctgtggttggttcactataatctcagaagaaatttggaatatgaatcaaatttcaaataagaaaagcagatccgataagaagtgtggatctagttgcaagtcactgtagatttaaaggaaatttagggcctggggtggggggataactcgagaattcattccagtgagaggtgatacgtgctctttctccctttagtagttatgttataaggaactattgtggaaatatctcttccttctcaatcaatggaagtttattatatgggatgccaggcttttacatgagagggtaccattgtttgcaacggttgccagtagagaaggagttttaagcttgttagatgagagagaaacagatgctgttagagctgacttctggaacgggctctcagtgctgcaggtgctgtgaatttgagtcataaaaatgttcaaaattagaaaatgttgaacattcatggttagtcagattgggcaacaaaattgaatttatgctaaaagcttttttcatgaatatttattataaataacctattaatgagagcaaataataataaaatactagagaaataacatgtttaaggtaacctaaatttctgggcttggttgctcaacctataaccacattttgacgactgaggcaggaggataggccacaaagatcaaggccagcctgaatgacagacactgtctcaaaatgaaacaaaaatataacccacgtttttcaagtgccccagccacttatatttttatttagaagacaaagccagctggtggttgagagcacctcctagatgctgagctgtcctgcaccttgcccttgggcaggcaggggctgtcactgctagggaagtgttccccatttgctccaggtgcttcagggaagtgcactttgtctgagccgctcccgcatcctgcatcattaacaccaaatggtgttcacagcatgggtggatcccagccctaattgcttggtgtgtgtgtgtgtgtgtgtgtgtgtgtgtgtgtgtgtgtgtgtgtgtgtgtgtgtggcacatttccatttatagtcttacttgagttttcttcttaatagcagcaaagactaccattttagagttgtgcctccatttatagctgtgcctcctcccttctccatgtaagctggcagtttttcttttgaagtttctaaacaaaaacgggatatgtgcaatatatataaatatatatataatgtatattttaatacttgtggacaagtgttacaagttgtttaagaacaacaaaatcaccaatgtcttccattttgagatgtgtatagttttgtaagcagtagtgcttgatagcatattgtagtgccatgttaggggttagtgcatgaatttagtataattttaaacttcaagatgaaatattgataataaccagtagtgtaaaaagtgtggaaaatcctagacctttactttttttgtatatgaatatttgatagtctccctgcggataggagaaaaggccaaaacaactaatgtctgaacagaagtgtggcttcccactgagagccactgcgcttgggggaatgttaggcctttcacgggggagctagaatagctacctttgtagccctttagtcctcacagcaaggcctgggttcaggcttctcttgctctctaagtttgaagctagattggtcctgtattgattttgcattgtatgttttgggttcacttttcctcttttgtgtccagaaaataattttctgttttgcatgtctgagatgccgtgctgattgctttggaatgtttactctgtggccatttcctttcctgcttgcagcatgtgtgctaactgcaaagccttgtcagcagtttggagtatcctgtactttaggctttgccccattctacatctgacttgggtgttgagtccagtctctctcatgagaactgatagctcagtggggcccatgtaggttgacaaaaagtatgttggccttcctttggtaattgttgagagctttcacattttttctactttccttatgaaaataaagtagttgctttgttctgaaaaataaagttttctataaaatggaattcctacctctaaaagctgcctaggaaacttggaagtaatcattttctgaagtgttgtagggttttgtgggttttttttatttgtttgttccttttctataatttttagaaatagagtcctgccgggtatggtggcagatgccttcccagccttgggaagttgaggcagtaagatcaggagttcaaggtcatcctcagctacgtagtgagttggaggtcagcctgggatacatgagaccctgtctcagaaaaccaaaagaaaagagagaaagaaaagcgtatgtaggatttcttaacatgtattacattagtatgataggaaatgtaaaacttccccctagaaactaggtctgagtctagtattagatatgcagggtcccaggaagagactctcttcactcaagaagatggtcagcacctgggagaatctgcttcagaaacaaaggggaaggacttgaaaaagtgatgcttataaagtagcacagtataggaaaggacatttcctactgcaaatcacaaaagccatagtgaactaataatactgtcaaagaggtggaattctgtagcaataataggtatggatggatggtaaattgtgctcacaaagctgtgtggttgagtggttactggttgagtttgtggggccctgcagtttattatagagttccacaaaaggaaaaacacatcttagttaaaaggcatttaaactatgaatgtatatgaatatatttgcgtgaaaaaataccaactttcatatatgtgttaaagatcctattttgtttccccagagtttacagctgttgaaatctttctagtacttaatctggaatcccagtgaagccaacatgtaggggtcttgcttaaattgtttgtattaatagtcatttactatatagaatgatctatgctttattcaaataatataacctttgctcattgggttcctggctactgtttcaaagggaaaagtttgtttttgtgtgtgattagtgtgtctttgggataggggagcctcaagaacttactggtatttccttgtacttagactcaaggaagttaggactaaaagtgaacaaaatgactggcagtgcccaggcagggagttatctaaacatctggtaagtgaatgtgataagcttgtggccagtgttcgaatccttatatcaaagagaacccagcagactcattcctttcttatctgagatgtaaaatggaactagggccactcctcatttcctttacctcatggcatgtggccacttagcaccttcaacatccctgaaaagatctgggtctctgttcctttgttttcccggggaagaaaagtcaaaaagtagttttgtagatctaagactcttattttattataagcctaagggtagggaaaaggctaccttgagtgtagtttctctttagatgtcctaaactacccatgttagcttttgggacaaccaagcaatattcagaacaactgcatgatcatgaagacagctaattcagttacagcagagatcacccttaacagccaagtaagtttatggttctaaatgcaaaaatatgctacaagattttgtggtctcaaaatatgtgattaattagtattcagtcttactgtagtctcttgtttactctatgtacctgtgatatgcaaaatataaaaaagaccccctagccttcaggtttacattctcatggtgctgtaggtgcaagtatactgtctctagtttattcagaacattgcttggctactaattataccattttggaagaaccccttagccaagagttttaaaatgcagagggctatgttgaatttcagggcattactgcttatgtttacactgatttagttctgctcctcaactcttccccagggagctgctcattaatacaaaccaggaaagaaaccattctgcccaagtaccctcaccaccctccagctctcagtaagtggccaagaaaacttgctccataaagactatcacctcagttcctttttcccagggctttacacttattcattatcttccaagggccaggatttctagctaagccttttagaaccaaacagaagtcctaaatttagctttttcctgtatgacttgtttgttttgaagcagcattatagtagataacggagtacctgactgcatctccgaggaatttgacttgacatattcagttgaagttttgcatgtatcattgctttttcccaagattctgaaacaaaggttttgcatgtgtgttaaaaccaggcctgattggaagtgtaagcaatagtagcaggcccataactgattctagaatgctaacattctaatgcatggttgaaaattttcattgttaggtagttattagtaattttatatatacatttatcaataatgaagcaatagatacttaaaccaatagcttggttttattgtttatttttattttttaattaaagtttgtcttacttccattgaaattggaagtacaagataaacaaggggcaaccacaagacattcaaactgttaggaaaacagcaagcagtgctcactctgtttcctagctctatttattcccaagcatgtttgcaaataaaagataaactaagcatgttgaataagctgctgttatcagggtagtgcaggatttcagaagagtagggaaataagccaagtagagtcatcttccttcagaaataacaatgttcagtgttaaataactagctgtggggcttgtctgactaggtttttgtagactaagttcgaggtttcttcaaactatagattgagccaaattcatggtctaccgtccccgaacaggcaggaactggcctgagtgtcataaacaggcgccaccatcagtgtgaagttcagtgctgactgaggacccggcaaggccctgcagcaaggtggttttgtaggatacagaagttcagactcaggctgtgctgtggctctgtttacaactgcagagctggagttgttcttcagatgagtcggtcaaaatgtgtcacttgcctgaaacttgattcctgaggaacaggagaaaactttcttcttccaaaaaatatatttatttggataaatgaatattggtttgttataatagtgaaaggaacagaagtgtaatctactggcagaacatttacctgagaaaatgggtttaattgcagcactaccaaaaaaaacctcatggtggtaacataagaatttcttgactttgaaatgcaagttacaaaatgattttgacaaatgagaagtatttataatgtctgaaaggcctaaatagatttcaaataaaactgtttcactggattcagtccaatttacctgttatatgatggaaaactagttccaaatttaactttcaccgtggtcctttgctatggatgtcaactggaatggtgactcctaaccttcagaactgaactaaagttgtcagtgtgatggttgctttccactgaaacacaggaatcaaagtatgtgttgtatcccaaatagaagtgttctttgccacttactaataaagatgtaaggtcagagttcttccttctagcattctcttcctaatagtcaccaaagtcaaagcatcaaacggcaagacttggtgtgtatttggtagactcaggctttataagatacctttaaaggggcttgagagatggctcagcaatttagagtactggctgctcttccaaaggccctgagttcaaatcccagcaaccagatggtggctcacaaccacccataatgagatctgacgccctcttctggtgtgtctgaagacagcaaaagcgtacttattttatttataataataaataaatctttgggccaaagggagcagggactgaacgagtggggccagccagagcaagtggggttaaccagagcaagcagaggacctaaaattcaattcccaacaaccacatgaaggctcacaaccatctgttcagttacagtgtactcatatgtataaaataaataaatcttttttaaaaaagatacttttaaaggcagaatacagttaggattaatggtgattttccaaacattttgacatctttggtaatggtatgctgtatccttaatttaaatgttcttttgtgcttggaacatagctcttggagaacacttggactcaggccagtcctcaacacttgacaccctatcccaaagatcagacaagaattgtgtcagtgtgttatcagtctataaacaacattactagtctgagcctaagcatccctgtaatgacaaagattaagagcggtaatcgacttgagagtggtgcattttctgcccttcaagcataggtgtcactgttcgcttgcccttccttgtatcttgtattgcgccaccagtgtatgaggtgatgttaaagagcaccagtgaatgtttaaagcactctaaaaggcagcttcttaatctatgcatctttgggagttttgaagaaatttgacttcttgggaaaggaactgttttttgagagtctgaaactgcacctgtatgtatatatttttagcaataaagcatgagcagagaatgcactgaaacttga

SEQ ID NO: 422 - DNA, 1931 bp, Mus musculus
ctctgcggccatcatgggatcgtgctcttctcgctcgttgagctggtcccttcgccgtggcctgctggtgacggtctggagcgatgctgagcccgggcccagcctctcagctccgccttgtgcgctgcacagatctaggggagcctggtaagtcgaggtctgcatcgcggggcgccgcgcgtgggcggggtgtcggctgcaatgatgatgaaactagaaaaaaaaggaagtgccgtccgatgcgacaactgacgacatccctagttagctgactgcagtcgtttaagcctcggcgacccagtgctgaacacaagtgttctaattgcccctcatgactcttactcttctaacctttcagacgggacgttgacaacgtggaataggagcagtatcatcccaccatgaggtaagggtttctggagtatcaggtggggttcatagacaagaggctgtgtagctttcgctccagggactcccaacataccctggcccatgtgggcacatacataaatttaagacgtgtctccatttagtggctggaactactagttggaggacagcagaaagcttgactgctgtgatgagatgactaagtaggaagtgccgtcagagtcgataactgacgataactgctcctggctgactgcagtcaagcccacaccggtggctggggtttaggtttaacttgggctggacttttaacaactgctgtacttctaggttggggatttaagagtggaagattgccaacagctgtggcctcccatgaggtaagctttcagcttgggattttagaccgttttgatttgagctagagtgttcatgtatgagcatcagttttgcctgtactcaatactggttgtagctgatgggggtggttaagtaaggcaacagtgcacagctcttactgtagagccattttttttttaagatttatcatatctaagtacgctgtagctgttttcagatgcaccagaagagggcatcagatctcattacggatggttgtgagccaccatgtggttgctgggatttgaactccggaccttccgaagagcagtcggtgctcttaaccacagagccatctccagccccctatagagccatttttgtgtgtgtttgctgtcttgatgctagaaaaaaatggcaccggacttaggtggttgtgagccacaattagtgctggcagtcaaacctggtcttctaagaacttagaccttctagtccattaacttgggtcttaaaattttcagttaatgtggtcttacaattgaacccagttgggctggtttggctagttgtaaatgtattttagtaatttgaaaaatacttcccttttaggtctaggatgtgttaagaactgtagctttcttgagaagaggcaggcagagttcaggccagcctcgtctacagtagtgagccagggctacaaagaaatccaaaagagaaaagccagggtgggagggcagccattgattttgcaaggctgttatatataatgtcctgttttctgcaatccattttagggtgtcccctttcaagttctcagaacggacgcaggactgcagatctgtgctggcagcagcagaggtgagttggtctgtacagtgactatctgttattactctgagagatatcaaatgatgatatcacctaaaatagctggaattaccggcagattggtagtggtgagcctatggttttctgaagatatcattaaatgttctaaatgccattgatccaggcaggagtgattctgaaattcagctcttttgcaggctatattcccagaggagtctccagccggcctgaaagcaaatatcctaagtgacatgtctgccaattttgttctgggtgggcacatttggtaatcctgtctgtaccacaggatcttctatgccttttaaaaataaacatttgtttataaacca

SEQ ID NO: 423 - DNA, 4192 bp, Mus musculus
ctatttatattctatttatattatttatattacgttgcttttggttttcttcagcatcctgtacctgtatttacaaagagaatagagacatggcttatctctgggctccttgggagactagtacttgttaatatataaaatacataataacttggactatatcaagtaaatatattgaaagacccattagaaggcaaggaaataagcagaaaagactgcagaaagaggtcagatcatttcccaacactgccttgcctttaactttgtcagcctgggtaaaaggctagcaagccttacatttcttcttagacaacccctgcaatgtgtctctgtgtagccctgtcctgaaacttgctctggagattggccttggaaatcagagatccaactgcctcgctgaggctaaaggtgtagatgtgggccataccagttttgtttcgaagtaatttacagcatctcaccctgttttgggtctgtgagatttatcaatcaatgaacctttgactgggctcaagtgatcttcctgccttagactcgagttgtttccctattttccatggaaattcagttactcttgaatagccagtgaattaagcaagaaactaaagagaaattcctatttcttcaattaaaaaggagacaacaaataacatgtgatacagcaaaagcagagctagagtttgcagaagtcaacatgcatagaaacacaaagccaaaaaagaaaaaaaaggcagagtatcaaatgaaaacttttgtttttgttttttgagacaagttttctctgtatagtcctggctgtcctggaactcactttgtagaccaggctggcctcgaactcagaaatccgcctgcctctgcctctggcgattggccttggaaatcagagatccaactgcctctgctgactgctgagtgctgggattaaaggtgtgagcaaccatgcccagctatgaaaacttttttaacatcctaaagaaataagaataagtaaataacacatggaaccaagggatcgtgactgtcagtgtaaacataagctagagattaccaactagacgtgtttcaactgcacccaaacatggtacagagaacccataaagaactacatagttacagccaactcatttttcaaaggtagctaggtttcctgtgaagaaattaagtccatctcatcaatgataccaggaaaacttaattacagggggaaacaaaaacccaagtagattcttcccactaattatgaaaactgtagaccttgaattagtgataaactaggcagacggctgagctgtggtgacacatgcttttaatcccagcatttgggaggtgggggaatctctgagttcaagggcagcctgatctacagagttcttggacaaaaacaaaacagaactaagaaaaaagaaaaaggctaagtgttaaaacactttcagtacaaagtttggacaagggcactctggactagtgtaagaatttcaaaccacaaaaaccaaaaatttattcccaaccaggaacactggcactactttgtaaaggctggtaacaaactgacgacaggcaatttagtagcagagtattctaaggttaggcatggcagccttttccttaatctataaactgaggccagccatctctatagttgagtaccaggtcaattttgagacactgtctcaaaaaaacgaaggaagttcaacccttgccagttacctcaaaggaaaatggaagtatgcaccagtaagaacttagaagtgaaagctatcactgacagcccacttagttttagcacttgggagggctggacaaatgtaatcaaggcattgtgtgacaatttcacagggaaacctgatcatgtgcacaatcgtcctaataaggagattggcattagtgcacgtagctcaccaactttgaaaactcaattaccatggaagtggaacatgtaacaggacactctggttaatcagtctgctgacacaaaaatcctgaaaagcacttcctcggaggcaaggtacaagcaggccgagtctaggcctggacaggaaactactaaagttcctctgggatcaaacaggattttataagaacataatggatggagtggagaaagcctacagcggctgtgaaggccctgatgctatgtatgtgaaatcattgtcttctaatggtcatgaatttattgtaaaaggagaacatgcatcaacatcaggaacaagaaaggccatgtggagcagtccaggttagtttgcggagaatggaaccaacgaggtcaattttagagagatcccctcacacgtgctattgaaagtgtgcatgaatttgacctataaggtcccctatgctaacagctccattgaaattcctgaattcccaattgcatccaaaattgcactggaactgctgatgggcccaaaattcctagattgtcaaataaaataaattataataaacttatttttttcagcattaaaaataaaacctgaagaaatatttgctactgaatgcttattgcagcactcccaagcaaccactgtcagatgaatatggaaatggctcataaccaattttacaatcacaaaaatagtgacctgctgctttatagtcaggattgcattcactctgctcagtctgtacaggtgtgtctgtcaccagctcacccatgaccccatgactgtcacagcagagaacatggtcgaatggattgtcaaaaacaatccatttacatacagcccacaaaaaaacatacaggaatcaactctgcaggtcataccagatgctgtcccgttcactacatagggacagctagagacatgtagatagaccccatctcaaacaccccagtactcagactgtgaattttcttgtctctgccttttctggatgttaccatatctagtgttcatttgcaagaagtctagtgtcactggtcctaaaatataaaaacaaaacaaacaaacaaacaaacaaaaaacaggcatcacattactgccaacattaaagaagaacacaatagtcctttgcaatggtccatctcagaagccagatccgtaagtatggtctttcaacaggaattcaggttcgggataggatcatcatagactagaccaacgacagtaagctcagcagaaaacaaaacagagcaccactcacatgcacttctgctgcaggatcttcacaggcaggctggcatctcactggtcaggtttcattgcagaaagaggtaccatgacatgctatgagaaagaactgcgtaacaaacaagacttaaacttcacttaaacacaatggtcttctctcagacgctgtatctgtcttcaggtcatcatcttcgggatgtagtccatcactgttcagacccggtacgtctcacaactgtttgtacaatcaatttgtacattcactacattcactgcagccactccaacttagaaaggccagagtaggagaagctgctgtgttgggccaggactatttaacagtacatttccggaaagctgattctctttgcaccaacagtaaaaatgtatgctggcaaaaatgtaaatctagatttcatacataccttttaaaagagtcaggctttaatcaagttattttctgttatgaattctgtcggaagctttgggctccccttcatctaatgaaaagaaacacattttaagcatcacacaccacttcctattgctctaatacttcaattagaaaactaagctgtatctcccttacctttttatctttttgcaactgcttcgaggatgttaagaatgatgagccatggtccctgtgaaaggattcatgtgcatataatcggatgtcacctaggtgtcacccgaaccttccaaacagcataaaaagccttgcatatttttctgcaaaccctgctgtgtaagaacccacccaaactgggactaaggaaccagaaagcaagtgaccttcagccaggccgcccagttccaatctcccagggacgggacctaagctccaatcccgaaatctcttttgctgctgcgcacttctcccaggtagtttacacccataccctaagctcaagtcccgagggctgctccgcagaaccagagcatctgtatttactctgcaaccccacattttgcttggtcactgggcggcctaaaagagtaacctacagctttccccgcaggtccctttatagtttcagtggagcgagagcaaggctgcc

SEQ ID NO: 424 - DNA, 169891 bp, Mus musculus
ccttctcacccaccctcccatcaccctccccaacaccccatctccagaagaaggtccatccagggcttgctcccaggtctctcagtccagtgccatctcacatgggttgagatgggtcgtgagagcagctgaatagacacggctgaactcttggaagcggggagcacagcccagccaagcttcgccaaatcggctccagcccatgaagaggaaggagcctgggccaggacgcacaccacagcgcagcaaggtacgaatggaggcccggccttggccctccgagctcccttccttgaacagtggcagtgtctggcggatgacacgagcaaccaccacagtgatgactgattcttgcagctctgtgtcatgggcgaccccatggatggtcccgtggatcactacgaggagacatggtggccagtggtgggcacgtgggaatgtgaggcagaccctaagctctcccgcaacagaaacactcaccaaaatcactggtgcatgcagccaggaggagctcggcatcactgcagggcctgcaggcacctagcatgcaaggcaggtcatcagccaggcctgtgatctctcagcacgagcccacagctcctcccaagaggaaaaggtacaggagcaagagactaaacccttctcccagcatcctatagcctgaagacaccctgcaggtacatgcctactgatgggcacctcagtgcctcatacacaggcttggtaccatctcataaactcagactaacactgggaaacgttctgtgacctcccagctctagctagggatattctagtggactccagttcgggggggtctctagctagggcagaacagtcagagagccattcattccctgcagggtcaggctacaagttccagaagagcaaagcactgggcctggtgccctgcagggaggcagggcaggcagtctccatggtgacgaagaggcacactggacttttgttggctgggcttggggggaggggaaggaggtcaccaccaggccagggagccctggacagccttggccataggctttgattctgcctcagcttaacccttcccccaatccttcagaaaccagagacccagggctggcctctcgggcatttgccccctcctgctcttttcctaaaccgaatcttttaagaggaggaggagagaaaggcgggggcacttccaactcacctccttacgacctggaagccactatgctctccaccggagtggcctctgtcaagctacagaaggactctccatgcaatggggtggcaaggcccagtcccatcaggtcagtgtggagggccaatttctgacacccagccagtctcataatcactcaccatccacaccaagaccttgagcctggggagacatttctgcacgttggtcctcgtgcagttcaaaacggaaggcagcaactctgcggctgatgtcgcggtgtggtgtggcctgcaggaaaagggctcggcgctcgcggggaccccagcgcatgcagcggcccccagccaggtccgggccctcggccagtagcaactctagattgccggtcatacgttcagcgaagacctgggcaccagcgaagggccgctctgggcgcagacagacgatgctgggccgtgtgcccggatcggggccgcccagggtcaggcgcagcgccccagctgggtacagccactcgatagcgccctcagtacagtccagggtcagctgccccacgctgccaggctcctgggtcaaaccgctggggacaggacggtggttctcaggtgggtgaccctcgttccctagcccgctcatcccttttcccgcggctaccaacatctgcttctactctgtgtaacaggacattgaagtctgcgtttcctcagttccaagtgggagggaaccctccaacccaagaagtaaataaaataaaataaataaataaataaacccacaaccctccccgcagtccctcctggtacctgcccctccagctgcagcggtcttccgagtagccagcgtgagcggacgcggccaggaggccgcaacagagcgcgcaaagaagcgtggctaccagcatggttaggggacgcgccggggcctcggactgctgccccgggagggtcggggccgcagcgcgagcagcccgcggcgcggctgcccggcccggcgcgtccccacaaccggcgacccctcgccgctgccccctctgagctccggggctagggggcggggcctttgctctcggaccaatcgccacaagccgcagaactttcctccaattgcagcaccctcgagggggtggggcgggctcaaggcgggagctcggtccaaggcagggttgatgtagaaagcgctcctgtttccccatttggagatccccaataggaacgtttggtgggttggtggggttcgctgtcgactggaatctggaaggctgtccaccccttaccttcagtggacctcggggcagtgggactttgtaagagaagtagtagagtctgcagccaaaatctgaacactggtatcctgctgctggtacttaaggaaaagagattaaaacccctgtgttactgcatctcataagggagggtacagagggcctggagcatggagctaggccaaaccttcggtttggggaaaagaaagaatactggctaggtctggaaggagtagcgtgggtagtgtggatctccttctgccaccatacattctcagacctaactacacactcctccaatgttaaatggatactaagaaaaaaatgaggcgttctagaggacctgcctagggacccacctgactgacaaagcctggtagtctgccggtgccaaagtacaggccattcctacagtcaagatcaaccgaaagggaatcagaaagatatcccaggcagcctgaggatgtagctaggttatagagcacctaccacacaggcatacacccctggctttgatctttaaaataatgttaaactgagagtgtagtgggtcttgcctgtaatcccagcgggcaggaagtaaaggaagcagctcagatgttcaagggcatccttggctccatagtgaattcaaggacagtgtgggctacatgagaacctcttttttttgttttgttttgtttgttgttcatttttaaaaaaatatttttattagatattttctttatttacatttcaaatgttatcccctttcctggtttcccctctgaaaatcccctatccccccccccccgagaacctcttaaaataaaatagagccactgtgaaaccccccaatggggaagagcttccttggagcagcttgtcctttggatctgaccgaagggagggtggaggagatggaaaatagaagaagaaccttggcaggtccccaaggatctctctctctctctctctctctctctctctctctctctcccacccccagggctctgtttctggatcctccaggttccgagtgaaacccttccggttggcctggacctgcgctcagagacagatgagatccagtgatcccactggcaatctggggaggagcttcaaacactgactactttctccttgcctcccaggccctctttgaccaataagaaggctcagatggctccttgccccagtccagagagtcaaaatgacacaaggtgagagtgaccagaactttcctgatgaatcagtaaacacagtgtggtgtgactgttcttggaagaaacattacatatgggctggagagatggctcagcgattaagagcactgattgctcttccagaggtcctgagtttaattcccagcaaccacatggtggctcacaaccatctgtaataggatctgatgccctcttctggtgtgtctgaagacagtgacagtatactcatatatatgaaataaataaataagtaaaatagtaaataaataaataacattaaatatgacttttttctctcaaatagtatagaaatgtgggatgctataaaagcaaggaattcaaattttttttattttctcagcttggtagacttttatgcaaatgttttaatccacccccataccaaacacaaaggccctactatattcttgaattaaaatggtttatcttttaccccttcgttttctttgcacagattctcttaaaactaaccaagcttgggctgagcaaggtggcacacaactttaatcccagcactcctgaggcacaggcaaggcagatcgctgtgagttcgaggcaaactagctctacatggtgagttccaggacagccagggatctttacacagagaaattctgtctcaatacaaacagacaaacaaacaaacaaacaaacctagccaatcactaaagaccgtgaggttgagcccagccaatggggaaaagacacagtcatcacctgagttagaataaaaaccaatccctgtctgagttgcctcttccatgctgtgagcagctcactccttggtcagcagtaaaggtttgccttcttgagacacttcagttagagtggaggtctctttctttgcaacctcaaatttatttctaacagaatgaagcccggatgattctatcgtaaacccttgacgtccgggtttggatgttgctttggtctcatatcatatcttctttccatgtcctatctctctctcttttggaataggagaatgaattctgtgctgttgtatagtggaagtatgtaacttattttttactttataggagttcacagttaagaatttgtcaggatggtagggaggaggtgttgccatggtgtgcaaggccctgaattccattctcagcacccaacaacaataataacatcctttaaaagtagaaagtgcctggcgtggtggcacatgcctttgatcccagcacttgggaggcagaggcaggcagatttctgagtttgaggtcagcctggtctacaaagtgagttccaggacagccagggctatacagagaaaccctgccttgaaaaaaaacctaaataaataaataataaaataaaataaaaatttctaataaataaataaataaataaataaataagaggccacctgagacgctgcagctattgagaggcaaaggcaggtggatttctgtgagtctaggtcagattggtgtctttgcagagagttccagaccttctggttatatgatgagatcttgtaatctatcagaataagtaatatttggggcataatgacacatacctttaatcccagcacttggaggcagagaaaagtagatctctgtgagttcaaagctagtctgggctacatagtgagttccaggacagccagggctattcagaaaccctgtttcaaacaaatagaatatgtaataaatagtggcgcacacctttaatcccagcactcaggaggcataaacaggaggatctctgagtctggagccagcctggtctacttagagaagttcaagacagcagggatgacatagagaccttgtctaagaaaacaaaacaaaaataaaaaaaaaaaaaaataaataacaaagtcagatgggctggaaagatggcttatcagttgagaacacgttactgcatttgcagaggacctaagctgtgctcccagatcccacatcaagaggatcacaacagcatgaaactccatcttcagggaatttgatgcctcttgtcgccacaggcaaatccactctcatgcatgcatgcacgggcacacacacacacacacacacacacacctaaaggtaaaaaaaaaatgtaaaaattaaatcataaatacaatattttcagccaaacagtggtgacacactcctttaatcccagcactcaggaagcagaggcaggcagatctctgtgaatttcaggccagcctggtctacagagtgagttccaggacagccagggctacacagagaaactccatcttgaaagacaaataaataaataaataaataaaataaaataaaataaaattcaatggaaaggcatggcaaaaataaaaatggtaaattcagccgggcatggtggcgcacgcctttaatcccagcactcaggaggcagaggcaggtaaattcaagtagttctctacccaaccccttttaaataagtgttttcaagtgtggagtcccgggggcagggggatttctgtggttataattttaaaactttaaaatcaatctggaaacagaaagaaaaaaaaaagaaaaatatgacatgcctgatgaaattatagcagacaccaaggcctgtaccgaggatacaagacacctcgggcaaccacagtacaactatccagcctgagaaattgcagctactttggtaattctttggtacttcccattgcaagccactgaggcagaaaagtagtctccaggcgccctctaatggtaatatggggatgagctggccagtctcagagttgaagtcgtccgaccctaacctccaagggcaatggcaggagacctagcagtaagaggtaactgctagaggttactaaggggtaacttggtctgaaagaaacactcacctgaccggagtctctctattaaacttactcttcccatcttcatcttctagcaccataacaatgattctgtcacgatggtagattctagacaggtgccacttctcacactggtcagggaaagggacccttgaccatcattagctagcagaagtctgatgcccatgggtatagatcccagaaagccatgagtagcctcagggtccaacagagctgctcctggtgcttttagatacccagaaggaaaatgaaggatgaatgagagagcaccccacatctcagagaacctttagctgtttatgctcaagcttggggacttccttgaatgtctcaagactttgtgcccttaccttaataaatgagttgcaaccgggtgatagcagcgcacacctttagttccagcacccaggaggcagaggcagaggcaggtggatctctgagagttcaaagccagcctggtttacagaactgagttccaggacagccaggactacacagtgaaagactgtatctaaaaacaagaagaaaaaaaaaacaagaaagaagtaaagaaaagaaggaaggaaagaaggaaggaaagaaggaaggaaagaaggaaggaaggaaggaaggaaggaagatgtctctttttatttgatcattactatgatagatggatggatggatggaaagatgagagatagattaaagtgtcagagtcagctaaatgcctcaaagacatgctcacaggccaatctgatggagagaattcctcagttgaattctcccttcacacatatattatgctaacaacaaaaattacccatcataggggttgtccgggctggaaatcacactgagacctgttttctgtactgtcttccccagggccatgtactgcacttgtggatgcagtggggacaacagaggccttggttgttatgagtgtcaccactcaggcaccccatctccagccatactgtcccctgttacacaggcctttgcaggttgaggacatcaataatgtatgtgcagtatgctggtccctaagcagagtggagggtaagcagcccaaacgttcagcaggagagctgatgggagacatgcagctggttcccaatgaacaggccatccaattggggctattcggggaagagctacaagtgaggagagttgacagggattagaaagccaatgactccaggaccatggagatttgaacaaacacaaccacaaatataacctgaaatctgacctactgacagagggtgagtttgggtttctccttgatcttgtgagaaaggggggacaagtttcccacctgcctaggactgcccccttcacagatagcagataacatttgaagccaggtaggggctagatacaggtaacctgagagcgttcctgtatcccttagtgagcctgtggcaccaggacccttacagccaggattaaatgtgtgtcctgctggatggagctgcaaggtggaaataacgatgggtgggggcaccaggggaccaggaaagtgcatcaatggtacctaccccctgagcactgccttcccttgctgtacccagctggacctaggcagtttcagggtggttcagccatcagccccttgaacacagagacctcatccaggatacaatcatagccgtcagctcccaagaagtctcaggtttccagccattcccatggtttctggatacatctcccccccaccccattagcctggcacttcagggggttgggcattgaggtttctatctctgtagtttttcatttgctgagaagcccccccccccaacacaagcctaaaatgcagctgctgattgatttgaagctgagctataaatagccactggctccagccagggccaggggaaaatatcccattgctaggagacgaccgttgccgggagaccgccatcactaggcgactcgtgctgctgaggtgtcagctgggccctgagtcatcctcagtcttgacagggggtggggccaggccaaagcagaggccagcagagaacctcaacgctctcaccctgtcatcagggcagccagactgatgttccacctgcttctctcctgtgcacttcagcctctggctcttggcagggacagggtggaggaaaaggaaagggcggaggagtatagggagacaggaagaggaatggaaaaggacagagggtaagtaaagagggagagagaagaaaggagggtagagaggatcgggggcataaagtatctacctgagctcagggtgactcacttgaaggggtcgctccccaccaatactgtgcactcaaggtattcctccttatagcccaactacgtttcccagaaggggttcagtgaggggaacgacctggggaagatgtgacccagctgtgtgtctccccagcactctccacactagaaccctgaaaggccatgcctggaacctcctgtggtaagacttagagacagtgtagagctatcatcatcactctaggcttaggagtgatcccatgatgctccctcctccctctctatccgagccaaatgtgccagcagccctagtcttcatcatccccattctgtggagttggaccttagaagcctggatagaagacagtgttctctgctctgacatcaaggcaagggtgaggaacataataatagccttagatgaggggtgtcttaagagaggggtgcttaagacaagtaagactgacccgtgaagaaagcatcctggttgaactggccctatatgctaccccatattctgtgcaggagacgaaagtccctggtcaggcacttggatattgtctgacacagttctctcaggatgtaagatgttccaaaagcgtcatcaggaatgaatgatgcaggaatcctccgtggaaggtgttccagaagccagcttccctatcatcatgaccacaggggtgtgtgaacctcccctatgccccactgggtacccaggaaaccccaccctggccctctaagtgttgtgtcagccaacagctcatcataactgtgccatcagagagccagtaggcccaggctgagaagaggggttcttggtgtttggggaagacatgaaagtgaaaacttctggggaggatatagagtctgagagtcaaataagttcattcagtggcaggtgacaagaggccacaccagatgaagtgccaggtgagagatgtggtaccctcctagctggcatagagcccaaggaacaagggtctttaaaaaaagatttatttatttaatgtatgcgagtacactgtagctagctgtacagatggttgtgagtcttcatgtggttgttgggatttgaatttttaggacctctgctcactctagtcaactcggctcgttccggcccaaagatttatttattattatacataagtacactgtagctgacttcagacacaccagaagagggtgttagattagggcatcagatctcattataagtggttgtgagccaccatgtggttgccgggatttgaactcaggacctttggaagagcagtcagtgctcttactcagtgagccatctcgccagcctggaacaagggtctaacagaccacaactgaggagatagctgcctgagagagctggaccattaatgcatgccaactgaactcctggaatcccaaggggagcagaagagagcagtaagttggaagtttctgatgacatgaaggagagcctgatctgaggaggatggcagaggtagagggaagcaggttggtcctttgatgagagaggaaaggcccccagattagtgctcagtaacttcctaagtgctctcaagagacagggccactgtgtgctgggccttcctcacacccaccttcacaccggagtgtgctcatcctatctgccccagccaagacacacgcccagctagtgatcccctgtagcatttacaacaggcagagggaaaccaatcagcacaagtcagaatgaaacttggctcagaccgatttgactgtaaccaacgctggaccaaaacttctagagtctggtccacatcattttactttagccatattttttcttttttaaaaagatgtatttatttattttatgtatgtgagtacactgtcactgtctccagacacaccagaagagggcatcagatcccattacagatggctgtaagccacaatgtggttgctgggaattgaactcaggacctctggaagagcagtcagtgctcttaactgctgagccatctctcctgtcctactttagacatatttaagcacagcacaattttttgggaaaagtattcagataacaatgaactcggttccaagtgcacaacaatttttttaaagatttatttatttattttatgtatgtgagtacattgtagttatcttcagacacaccagaagaaggtaccagatctcattacagagggttgtgagccaccgtgtggttgctgggaattgaactcaggacctctggaagagcagtcagcgctcttacccactgagccatctctccaaccccaggtgcacaacaatttaagccatgcttgcattgagattctttatgatgtacatctggcttctttcacaagaatggggactgttgggactggagagatggctcagtagttaagtcactgcactttcaggggtcctgagttcaattctcagcaatggcatggtggctcacaaccatctataaaggcatctgatgacctcttctggtatgtctgaggacagctacaatgtactcatatgcaataaacaaacaaacaaacaaacaaacaaataaataaataaataagactgagataaatgtaatgccagtgggtgtcaggattggcctggccctaaaatattatagaagtcacttaggctgttgtaaaatacaagtgacatcactcataatgtattttgtggcctaaatgtaatggttttaaggggaaaaggtctgagctaagtcaattcttggagatgagaacagaccctgtctcatctgacagtgaaggatcaccaggctgtaaaacagctggaaagagcagcttcgcacctcattccaccgaaggggtaagttgtgtgtttaactttttctggattccccagtggttatttgtgcgtgcagaggctttttgtcctctgtaattgcccaaggacccatgctaccaccgaagaccaactgcaagggcaataagtagagaagtgggaagagcatagtctggctactcacatctgccctagtccctgccccatgctgatccatcatatctgatccatatccaggcaagatagtgacactctagttccagccacacccatgcctgcctcaatcctggctatgacaagctagactcaaggcccctgctgtaaaaacagtgactcaccctataaaagacagccagggccttggagagagattggtctgcaaagtgtatgtcttgcaagcactaggtcctgagttctgtcctcaaattgcattcaaaaattaaaaaaaaagaaaaaaaaaaagccgggcgtggtggtgcacgcctttaatcccagcacttgggagacagaggcaggtagatttctgagttcaaggccaggctggtctacagagtgagttccaggacagccagggatacgcagagaaaccctgtctcgaaaaagttaaggctgaattctgtggcctgtagctgtaacctcagtatgggaagtcgacacaggtgacctctaggagcagtagccagccagcccagcctactcagtcagttccaaaccagtgagagaatgcacacaagagggaaaaaaaaaaaaaaaaaaagaaaaaagaaagaaagagaaaaaggaagtggggggggggagtgggtgatacaggctaaggggtagttctgtgggtaaagtgcctgcctgaggattagggtcctggggacctgtgggtcaggcagtccagtataaatgtctcaaaaaagaaaagaaaagaaaaatcaggatagctcttcaagctctcacccttttttactttactctctagcccttcttccatctctctctttttccccctctctttatgtggccatggccgctctctctccctctttctacctcctctctttctcccttccttttaacgataaagctctaaaaccattaaaaaaaagaaaagaaaaaaagaaaagacaaaacagggtaaagagtggtagaagacagactggcaagatggctcagtggttaagagcactgactgcttaacctgagcaaaaggtcctgagttcaaatcccagcaatcacctggtggctcacaaccatctgtagtgggatctgacgccctcttgtggtgtgtctgaagatagccatggtatactcacatacataaaatatataatttttttaaagactggtagaagaggattctaatatcagtctctctctcctctctctctctctctctctctctctctctctctctctctctctctctctctctctttctctctctctctctctcacacacacacacacacacatatactcactcacacacactgcctaagaaatacctgagactgccctctaacttctatttgcaccttcacatatatgatcatacaccacacacacacacacacacacacacacacacacacacacacacacacacacaccagctaggatacagcttacttccctttcttattgcccctaggcctcacatcattcccaggagacagacctcccatctccacagcagttggtctcatctgaggacattccaccctgaagctccttctcttccaagacgctactctgctgtcccaacatctgctgtttctggtctcaagagagacccagattggggtccctttagcctgctgagaggtctggctctccagcagcccttaatgggtccttttacacaaaccaccctccctggtccatacaggctgccaccacctgacctctacttcatctcagagcgaacctgtggaactccataaggcaggtcgattctcgaaccattcctaccaagtgctatggggacagagagggcgtctcagatcatttgtgacattgtcagaagtaacccctccccactatcactccactgtcttgtgttttcattgacgcttgctttagtcacttgcttgcaagtgtgtgactatgtcacccagaacagggattcttctgcctgactcgcaacaggatcggaagggatatgaatcctaggggccataaggagggtgtgtgtgtgtgtgtgtggaggtgcgacgatgtcgatgtctccactcggcttctctttcctcgccctcacaggtggcaatccaagcaagggcacatagggccagttgcatctgcgcaggatccggaaccccactgccaaccgctcgcgccaaggaccgcaattctcctcagctggcaagattctgggtcgccaccactttgtgcagatgggacactcgaagctgctcttcggccgcgcggcctacggggtttgttattgtgcgaacaccggccgctgagcgggtgctgccgcctggcgcgtgcccgtcggtaccgcaccgggagcgcgcggagaggagcggggcggggttggggattctcgacacctcagcctggctctagaacccggattggtccggacgccgggagcgcgcgagggcgcggctcttagggccgggcggggggcacgcgcggcgccggcggcggccgcggaggagcgcggggaggagcgcggaggaggagcgcagggaggaggggaaggggagggaggaggcgcccgccgggttccctgcaaagcggccttatttatctgggcacagcctcagcctccccggtgggaggctcagggcggcagatcctctcccaccggggagctccgctcggaactctgcggagagggccctggcgcggggcgccgggcgcggggcgcagtcgggccctgctagccagtccagcacctcggccgcctccgcgctaggcggctcgggtgctgagctccccatgacgcgaggtcgcccggcggacagcgtggcatgagccagaagccctggccgaggtaaggtgtgtgtgcgcgcgcggccaggctgcggggaggggagggtccaggtcgagccactgcctccgcgaaggctacaatgaggagggggcggggtggggacttgggactgcgccgcggccgccgccgcctgagcagggcttacgtaatcgcagccccttccccacctcacccttcggccgctgagccagcggttccgcagcccctaaccctagtggccggcctgattgcgccccgctcgctaccggcagcgcggtcaggctgtatctccgtaccacggaattgctgagaggaagcacggtggctgcgaggacgcggaactgcaggccgtcagcccccactccttctggcttggctctgggctctccccactccagccctatgagcctccggcggactggaggacgtgacaggtgttgatacaattaaaagggaggagccatgtggatatgtggcctaggggtcctggacgccttctggacatgagctggtatagagctgccgcccacagctctataccagggagtgggctggcatgtctttggttctagaaaaagaaaatgggccttggccaagattggaaggcttcaaaatggggaatgggcatcctgagattgctgagcagggcttccatgtccttctaggatgttagtcagtgggggatcctccccacccgtcatcccaggagagaaggctgcactgttgaggcctggatctggcctagcagccctcctgctagcccctcccagcccgagccagcagctgacctcccaggagcagatggcagatgccacttcacctgctccctcctggaggcccgacttccactgccatcttgtcccagggcccactgaccagggtcttctcaggcctccctgctgccccttcgggacacgggaccctctgttccagcccaacactttgatgaagtgctggacagcagcctcatcgcagcaggggggaggggcggggggggggccggtgttgggacaggagcctggatgattaggggctgcctagatcaggtcagaggcatggtggagcctcgatttcctgcctagacgtggcctgagggccgggctgggagccattgggagaagagagggaaagtcaaggttgaaaacgtgggtgatgttgagatagcccaagattcagcagcctcatttcctgccaccctcactatttgcctccccagtcacccatactgtaagtccaggacacgtatgcactcacctgttctcccaaatacacctgaacaggtcccgtctcgcactgatgaagttaaaacaagtgcatctaggtagccctgagagattgggctctctatttcagaggcactagaaggggcttctggtgggcatcactcaaccttcctgaccataagccttcacctctgagagtcactgatgaaccttccgggactggcactggggggggggggaaggcagcaaagcaaggtcaggaggtcagtgagcagccctgaactgtccccattagtggtcagatggccaaactggctgcagagagtgcaggtgggcctcacttggcaggtgtctaaaggagccttgggttttgaaggtctcatattctacagaacagcgggagggggggcgtgataagatgaagcctgtcgtgactatttgcccttagtttggtcacagagcattagtttgatcttctggagcattgacctaggttcaacctgggtctgtttacctcctgggccaagggtctccctatccccaagtccctggcacacacacaccccagaggcagctccagcagggggtggaagaaaagtgctgtggttgacacgtgcaaagtggcagggatgtgaatgtgcctgagtcacagcactgtcacagaacatgttgcctgctctgtgcccccaatctcagataccctggtcgtcaccccaggccacggggctgccactacagactgaactggagatgggtgttttggttgtccttttcaaacctgaggagctgatcagggcaggtgctatgcaggccagaagccagcctccaaggtggccttcatcctgacctgtgcacagactcagggaaagagtccctagactgagagagatgacgggtgagacattggtgagtgtgtagttggcggtctttaagatttcagggtaacagcagtgaccccgctggaagatagctgtgtgcagaggccactagtcaaatcataggaaaacacaggacccagtgaggcagaagaaaaagacacaaggtacaacagatgtgttcctagtctgagtgctttggggtcttgggacaagtggcagttctctgcagcatcagaaagatccatccctttctgaggcttgttttgaacggtggtgctctaggaagtcatgaggcagggatgttggaggaaggcatctccttggtgactcctgtctctttttcctaggatcaggtcagattttgggggtcagccagtcagattccttagccatgaaaccccagaagagggacttagccaaaagatctcctctccctgagtacctgcacctcaagatcagcgggtctggggagctaggtgctggcaccaatctatttcttttgaacaaatgctgaccacaagcatacccggagttaaattcttgtgcttctcctgccccgccaaccagccaaggctctcagcctcgggcagctgcacccctgaacctgaatggttcaggtgaccatttcttgtccattccttcagcagtacccagaagccacacactcatggtgctatttgtcttcaaggagttaccaggccacgggtagaaacagtgatgacatctccaggtgacacctggaggtgctttttcagagtactaggggatcctatctatggaggcaggcagcaagctcggcactgagaaagcctatgagacaagcagggcaccgccacttgtccaggtgagggggggtgggagaatgaagagcaggggtctggctagggaaggaggaatggatggagatgaggccaggagactcttttgatgactggatatacaaaagaggcaagtcctcgtggttcagcatcagactctgtggaatgccaatctggaaatcaccaagtactggaactttcccaggagacccattgtaccctccatgttccttatgtccacaatgagtcctctagagagggcaaagactacagtcagtgctcccggagagcaccttgatgagacgggctgatgaagacacagcagctgaggaagttgtcactgtcccttcctagcccaggatggacctagggagtcccatctcaagctcccctgcagtctagagatgacccagaattctactccaaaccaagcacaggacatactgggcctggggctgagtgctgtgccagttcggacatcattccagaaggcctctcctcagtattagctcctgaggtgcttgtccgtgaagggagagacaacctgggtcacttggccactgatccatccccccacccccctcctaggaagcaggagttgcagcatcattaaggagctctagctaggcatggcagtacatatttgtaatcccagagaggtaggatggctgtaaatacaaggccagcctgggctatagaacgatacctgggagcagaccttatgtcatcatctggtgagatggcagggccaggtggagtgatccttgcttagaacccctcaataacctcttgctcacctggcaagaaagttccagtcttccagtgtgtgcttagctttctctgaaagcctcagcccttgagttcaggtgtaactgtttccatttttggacgcctgtggggttctcaggcttggttaatgtcaaagagaaagaataagtgagaacctctctaatcacaaagcgaggttgactttgtggagatgaggcttccaccaaggacaggggcctggatgggggaattagacactgaatctggcctggattcacctatgtgacccaagtctggaaggtgggaagggggtcgatcgtgtgcttctggaaacgtgaatctccagagctgcagagaggggcagaaaggagccctgcagatgcccggggcatccacgtgcatctcccccccaacccccagcaactcaggcgctccacgtgcacacccgcggctgggagcattttcagcctaaatcggcacagctcttggattatttctcccctggcaccgcctccgcagcctcctccagatcctagccaagcgggcggcttctccctctgcctcttcctgtggagctgggtttgccggagccaccgatcattcctcctccgctccactgtctctggtgcagaaagcccggctgaccacattgagcgcgggagctgtccgtggtgctgcttgcggggttccgagagcgctgattctgcgcctagtggctgaggttccatgggcagtctagaggtagaccaagacttagtatatggctggtactcaggctggggctgtctctccaccctcagcacagttcccaggaatgcgggtggtactggataagaattggagcacataaggaagaatctcatcctttcccatcatggatgctgctgtcccgcaacaggccagcttccctatattgctccagggaattggggtaaccacactttagacttcccttaccgtagcatgcaaactataactcttcagagcctcgggttcttatgtgattgaaccagtgtgcatttggcaagtgttagcattgctacttgctatactggctttttttttttttttttttttttttttttttttttgtagctactattgcctgttcttgagcacaaagagcagccaaggtctgaaacctttagggaatagctggcctactccccaggtcttaagagtcatattgagaaagggagtaatcaggagacagtactgagggccttagggtggactgccaatggccatccttagacacagaactaggttcatcatgaggaccatgttctggggagagcttaacccgggactttcccttcccagaggtgggaaactagcacagattgcatgtgcaatatagggaaccatagagacagaattgcaaaataaaggcagaaggtagttcttgtctacttctcttgtgtcaagccagagtataagaaagagtagccaatttccttggccctgtagctccagaaaggggtctcaacctaaagggtaacatgagtctttctctgctgagggtctgtgtacttcagtgcccaccacttgggaagcttcttcatgtagcccttggtattgctccaggctccctggcaaggttatgagccaccaaagccaggtatgaaggtatgactgaaggtttggtagaggcttttgttgactccctggagattgtagggcaaaaactgacaattcatgtgtgcatcctgctcatcctgggatcacctatacacacagaaagggaaaccctgccttgcccttgggtcagctctgggactcaggatttacactaccatagactgcaaatccctcccacaggaaggagtttgtggtgtcacctcccagatttcatgttgaggaaatggactcaccagaggctagccaagagcactcatttatagaaggggccatctggagtccagagtattgcctttgaatgttttaagtgttgcattgagcatttcatctgcaggtgaaatccatggaaaaatcacatccttctggatgctgggtggtggtgggtgtgatgtctggaatgcagagcagacagagatcatggcattatgagagtctcactgctctttccctccgtgctgtccactcacagtgtcctctgcaacccagtcacaggcctgggagtctgaggggaacagggagggagtgattcagacatgttggtcatgctggccttccatatgaccttcctcctccagttctgatccgaattttagctctaccacttaactatcggccatgagcttagtcagatagttctcttggtcttggcctctacttccttggttgtacagagacagcacagcactgtttgcgttgactcgggtgggggattagagcatgtgtccagcaggctggagaagtgcctcagtgcttgggtgcctgctgcttttacagaggacctagaggcctgtaactccagctccaggagatctatgtcctcttctgaattccacagatatgtatgtggtacacatgcaagagaacacccgtacacagaaaattttaaattttttaaatatgaaaaagcatgtgtccaagtatcactgtgctggtagcacagtcagctatacaggggatgcgactgagcctcagagccttttatagggatacagattttttttctcttttgagattgggctcctctgtgtagtcctggctgtcctggaactctctctgtacaaggctgctcttgaactcagagatctgcctgcctctgcctcccaagcactggcatgtgccaccactgactaggtgcacagattttggagagctggtctgtgactcagggctattcaagcacctttcttctctgggttctccgatcctagtcctcaagataaactccaggaaggggcatcagaggattggaggtgaaaggaacagttaaggattccatctaccaccgggcatggtggcgcatgcctttaatcccagcactcgggaagcagaggcagacagatttctgagttcaaggccagcctggtctacaggacaaccagggctacacagagaaaccctgtcttcttgaaaaacgaaaaaaaaaaaaaaaaaaaaggattccatctccccaagcctcgatgggaatcagagcatcagaaagcacctttgagcaaggcaggctgagccagtgaataggacagagagaggatgtggacacttgagctagctgtgaatgtggccagcttgcctcttgtgcagacagagaaaggcgcatactaggatctgttctgttaagtggtcctggaaatgctttgggtgaggagcctcgaggatgagaaaaggttagctctccagttcctccagagcctggcacacttatttgttcctcctgtctcatccacagagcgtgcaagaaaaatgtcgagccccggtatcgatggtgaccccaagcctccatgcttgcctcgaaacggtctggtgaagctgcctggccagcccaacggcctaggtgcagccagcatcaccaagggcacacctgctgccaagaaccgtccttgccagccaccacccccaccgaccctcccacctccaagcctggctacaccactatcccgggttgctctggccggggggccatgccccccagccagtggaccagcctcgggtccagtgtctggacccccagtggagcggccaccactggccacagacgagaagatccttaatgggcttttctggtatttctcagcatgtgagaagtgcatactagctcaggtgtgcaaggcttggcggcgtgtgctctaccagcccaagttctgggcgggcctcacgcctgtgctgcatgccaaggagctgtacaacgtgctgcctggaggcgagaaggagtttgtgaacctgcagggctttgctgctagaggttttgagggcttctgcctagttggtgtctccgacttagacatctgcgagttcatcgacaactattctctctctaagaagggagtcaaggccatgagtctcaagcgctccaccatcactgacgctggtctagaggtgtgtcccaaaattggctatgaccagatgggtctgggtctggggaggggggtggggaacatgcagaagcaaccttatggacatgggaggttgaggggcctggaagatactcaggtgtatacaggataaaaagcagcaaggatggtatttcggggcctaatgcaaagtgaaaatgtgggcttgttaaaaagtgattaagatgtcaaggttggtgcaagagagtagtcaattacatgtgggtgtctgcttgcttgtgaagctgccttggtgaatgggctgctgggctggtgtgtggaggggtagctaagagtctcctagaagcaccctgccctgcctccccacacccctggacctggattgtaattttaatattcaaatcatctgttctaaacacctgcactggccacaccctggcttgtgtcccctgtgccctgcctccccccttggaatattgggaaagtataacaagcagtttaagtgcattccttggagttcagcctgatgcatgcttgcacaagcccacgcctgagagaccaccgcttccagaatcccagaaacttcttcgggcaggcgtgagccagggagctgacttagtctgatttgtacctgcctgtaggtgatgctggagcagatgcagggagtggtgcgtctggagctgtcaggctgcaacgatttcaccgaggctggcctgtggtccagcctcagtgcccgtatcacctccctgagcgtcagtgactgcatcaatgtggcagatgatgcaatcgctgccatctcacaacttctacccaacctggcagagctaagccttcaggcctatcacgtgactgacacggccctggcctacttcacagcacgccagggccacagcacccacacgctgcgcctgctttcctgctgggagataaccaaccatggggtggtcaatgtggtgcacagtctgcccaacctcacctcactcagcctctcaggctgctctaaggtcactgatgatggagtggagcttgtagctgagaacctgcgcaaattgcgcagccttgacctttcctggtgccctcggatcaccgatatggcactggagtatgtggcctgcgacttgcaccgactggaggagctcgtgctggacaggtgcacacatccctacactccaggcgggtactggtgggatctccaggaactggaagcctagagtgggtggtgcccggttcacaggcttcggggatggggaaaaccacatagaatagagtgcccaaaactggaggaaaagccatattccaaaaggggaggccacggggtgggaccaggggaagaatagggcattggtgtgtggggcagagacttgctctagggacacctctgaaaaggggggaaggacctaggtggggatggggtaaagtgatttaaaggtgggcagtcccccttctggtgcaaccacaggtgtgtacgcatcacggacactggtctcagctatttgtccaccatgtcgtctctccgcagcctctacctgcgatggtgctgccaggtacctccatgcccccagggatctggaaattagagcgtggttggtggcgggacaggacagggtggaggaccagtacagattatccttgaacttcaccccgcctcattcagagtcctctagaaccagcagccaaactaagcagaatcattgggttccagattccccaaggccctcttggtgcttccagtctacggggggtgggggtgggactgagaaatctccattttgaacccctacctcctgcccctctagtggctccaggtcccaagcaagtggaaataagttaacacgacctcctctcactcccgcccaggtgcaggacttcgggttgaagcacctcttagccatgagaaatttgcgactcttgtctctagcaggtgagacaccccccacccccgcatgcctcatgggcaacgatgcccactcactctgacccccacccccatcaggtcctttgtgcagatagattcatttcaggttttggcaaatcgcatcccaggtagcgggttagagggtgaatccaagccctgttggtgacgccctgctcagatctaccctgcatcaggccaagtctgaacacatccttccctggtggaggtcccgcccatcctgtcagattcccacccctccacgcccggtacaggtcccgcctcattcagcaagcccagtagaatccacccctagcaggtcattgtcctcttcagcctttcccacctgcccagcccagtccagtcctcccgccaggcggaactgaactgctgagcggctgtccccgtgcctcatgcttgcaggctgcccgctcctaactaccaccgggctatctggcctcgtgcaactgcaagagctggaggagctggagctgaccaactgccctggagccacacccgagctcttcaagtacttctcgcagcacctgccgcgctgcctcgtcattgaatagcgcaggcttcccgacccggccgcgggaaccggccacgccctgggcagtagcccttcttccatccctgccggagcatctcttctccgccctgcgctggaggcggggcaagctgagggaaatcccgccccgtgcctcccttgctcctctgctcaactgctccttccctgtctggggcaagaggcagaggggccagccccacgcacgcacgcacactcggggactttgtgcatgcccctcgtgcccgcactgcacgcccgccctccaccatgccacagccgccgccatcactcgcccgccttctgggggtctaggtccttttggggatgctttgagtgcatatgccctcactggcttccccacttcattctgctctctgcctcccctcgctgtccccccatcccgggcagggcccaaggggatggagggattggtcccccaggacttaggggcctggaagagcccccaagggcctcccacatcttccactgcaccgcgcctggagccctccaaagggtatgaggcgccacaggccactgccaaagccatggccccctgaggagcccaactccccatgcccacctgacctagtggcttcccttcttccttgttgccatataggtcagttcttgtcctctgtatcctgcgcccctacccccgtatctccttctttccccctggcctacagatccttgggccctggccaggttgggacagctttaggaggacgcagaccttggaacaatcaacattagcctaaccggtgcccatccacctaagtgcaagggtggaataggcacctggcagaccccaatctggagccacccacagggctatcaggccttgggatcagcccacccatttgagcccctaccccagctgagctcaggcctctcagcactgtgcttctccctggataggtctcctcaggtggaatctgcagagggcctggccatgagtcagggtcagtactgaccagcgattctgatctcccagtggccagcacccccttcacaccccagggaaggagggctccttcccagtcctcctttagttctcccagcttccaaaacctttgcctgcccaaagggtttgtgaccatgttctgtcaggtctcaagaaatttggaagtcctaggggatcctggcatataggtgacaataccgaggaagggactgggaaccttccctcccaaccttgaaccccaggagacacagcacccacaactaatcttgggacacccctatctggttggaagagagtaaactaattcccagagagccagagggagagagagagagagagagagagagagagagagagagagagagagagaggagagagagagatgctgttgacgaaaagtaaagattcaacagcccaaagagttccctgcccctgcagtgttggccagggaggccccaggctgaagtggtcaggagccagatttgtcagcccctcttcccacagtcccccaacagggagggggaagctgtccatttgcccaaagtattaatgcaactgaagctgtgatatttccaatgactgtaggaggaaaatttaaggggagagaggaacacaaacaaaaccaaccaacccctaaaatcattttcttattgtacataacgacctcattctcctgtatatgcggaagatataaccttatatttggtaagtgtttcttgtgctattttatcacgtgacctgtttataaaaatatatattaaaaaagttgtaaaaacacaagtgggttattattttttggtcacctgaccaagttggaagggataactctgccctggatggcccaggtctctgggtcttcctgcctcctaaatcattagaggtactccataaacaggagaggttggaggctcagggctggactggaaccttagcaactgacgaacataagttctctaatgtcctgaatgcacaaaagggaacaatgtgtttgatgtcaaaatgtaggtcttccaaaggatctaggggcggtggtggcgcacacctttaatcccagcacttgggagacagaggcaggcggatttctgagttcaaggtcatcctggtctacagagtgagttccaggacagccagaactacacagagaaaccctgtctcagaaaaaaaaagaaaaagaaaaagaaaaagaaaaaagaaaaaaaaagaaaaaagaaaaaaaaagaaaaagaaaacaaggatctaggatcttgctatccaagagcagaaatgagccttatcttctgcacggggtcactaagtgagggattgtgatgttctaaaataatccagtgatgctggatagatggctcggtagtgcaaagaatctactgttcctacagaagacctggggtcagtttcccagcactcacgtcagatgcctttaagctgcccagtaactctagctttagggatatgatgttctctggccgcctagggaacctgaacacacattggtacaaataaaaactcacacaggcacatttttgcatttacatgtgcacacactcaaataaagattaaataaataaataatcacagactgctagaagatcaagactattgtgtccacctcaagagaaagggcaagtgctgaagggaggactgctagccagctttgtccttctctgcaatgccttctgtcttgctaaaaaccttagattatattcctagagctagccaccatggtatgttcccttatttggccacttctactcctgaggctggcgatgaaggcccagctatcaaagtattgaggtccagcaatcaaaagcccccatgggttcacttaattaacctgtctaatcaaaattaaatacctcattctaacatggtgtttctccctcttacacttataaagtcataaagtgtcatttgtctataggccatgtctgtctcctttctatccagaggcagttctttatcccctctggtcaaatatccctactccctctcctccctgaccctctatctgctgtctgtccctattgcctagcctttgtccctttggggcaaacaatctttctttatgctgagaacttggtcttgaggctcctcagccaacactgatttcttacaatggagactaaatctactaagccactgatgactggttgtcaggctctgaaagtaccaaaacaggtgtaatcatacaaaccacagtagacaaaggagacattagactggggtggcaaggatggcctaagatggtaggcatttgagctaagtgcctacctatgtgtaaaggagacaccttctgcaggggtagaagccataggtagaagccatggttttataacacagctgatgaactgtgaaagaagaaggaaaatactcagagggaaggaagctgggatagaaacaagctgagaaaggaggagccaagaaaggtagagctgcagatgagccagaaaggtcagggtcaggtctctgagacctatacacagtgaaataatgacctagagtagaaaaggcaccaggctgctagtgcttccgtaggggaagtggcactgtggcagagtggtggaactcaaggtctccttagaaaatttctcctcgccgggcagtggtggtgcacgcctttaatcccagtacggatttctgagttcgaggccagcctggtctacagagtgaattccagtacagccagggatgtacaaagaaaccctgtctcgaaaaacaaaaaacaaaacaaaacaacaaaaacaaacaaacaaaaaacaaaaaaccaaaaaagaaaaaaaaaagaaaaagaaaaaagaaaagaaaagaaagaaagaaaaaaagaaaaagaaaattacttctccaagaccggaggaaaggtttaagtactggtattaagatattgagattaaaataaacatagcctagttggtagagaacttgtctctcgggctcgatttccagaaccataaaacaaaacaaaacaaaacaaaacaaaacagaaaccctaaccaaacgatcaatagcggacatatataaccaagttaaaaccagggagcccaattctggtccgtttgctctgcagaagcgctgttcgcagacacggaactcttatggtgtgaaagacgagttgtcactcacttccggcgaagtgagaataagaaaggactacttccggtaatgggcgggcagtaggtgagtctcttccggtactgtagctgaagaccactctgtgctttcggtaaatgactggcgtgcgacggggcagaggcttttctagcacctggttctggtccctcagttgccgctgcacggtgcaattagacacctgcacttattgctgtagcctctcttctgcattccaaggtgtatgaactcagtccatacccatctagcttctctgccctttccactcggttgtttttcctcttggaagccccgcaatcctcggaggcatggggctgtgaagtcaggagccactccccgcccccaggatctcactgatggagaattaaccacatagaatcgggagacgtcagatatggtgctgacgaacctcaggttagctctggagccttctggagaactccaatgaatgtgaaccttcctaagataacgactggctgatggaccatctcaggccgaaggttcgagaggagactgaacctgaattgttaggacaccatggctgaccaggtcagcacacttcactgacctcctcctgcctctgatacctgtgcagacatggaaaagatgtcccgagttagcacagccctgagcggcagtgctctgacgggccgaaccatgcactgccatctggacgcgccagctaatgccatcagcgtgtgccgcgacgctgcccaggttgtcgtggcaggccgaagcatcttcaagatttatgccattgaggaggagcagttcgtagagaagctgaatttacgtgtgggtaggaagccctcgctcaacctgagctgtgctgatgtggtctggcaccagatggatgagaatctgctggccacagcagccaccaatggtgtggtggttacatggaacctaggtcggccatcccgcaacaagcaggatcagctgttcacagaacacaagcgcacagtgaacaaagtctgtttccatcccaccgaggcccatgtgctgctcagtggctctcaggatggcttcatgaagtgctttgacctccgaaggaaggactctgtcagcaccttctctggtgaggcccacagaggaagttgggggtacatctggatctctgtaggtgttagacctgacaggcaggctgaaatgtgtgtccatcagaggccctcagatggaccctcagaggcggaacagcccagaaagagtggtggaaatgggaacggttggccccctgagaaggataagcccaacactgctgttggggtgggggggggggcgaggcaggaggtcagaccagtggaaattgagactgggtggtgggtgtggctaatagggaaggcggagccttcagacacaccgtagtgagtggcggagccttgtgtcttcaggactcagaccgggactcagagtgaggtggggagtacacagcgcccctttcatggcaggccaagctgtctgcattcagccctcattcccctctctcagatctttaatgagaccaaatgatgcgcaggcagagccttggggcctggagaatttgggggttacaacagaccttgagctgtctgtggcagggaaaagcactggacactgtacccgcaggctccttgtttggcgatcttttaaggtgggtatggtctctgagctcttcggtccttcgaggctaactaggcagctggcagggcattgagcagagcacgaggagcctcctcttccattcgttgggtcttccacaagccttggcctgggacatatagacagccaacgagggtgagctcctgtgcctccagtgctcacacatagccttctgaggcaggtctgcagctttgcctgtgcagaatctagggaactgaggctgggagtctgcactgaaactacctggcatactctggcctaggcagattttggtggtgtttctccagtcctgtgtttctgggctgggctataggctggtgaataacatggttggagccactccaagggctcccccacgccctgggggccagcccctcacttatgtctgtaccactgtgtgcccacaggccagtctgagagcgtgcgggatgtgcagttcagtatccgtgactactttacctttgcttccacctttgagaatggcaacgtacagctctgggacatccgccgacccgaccgctgtgagaggatgttcacagcccacaatgggcctgtcttctgctgtgattggcacccagaggacaggtgtggtgtggggagaagatgggccttaaggctggaggctaaacgatgcctttgggtgtggcagggtctcctttcccatgggagaggtcactgacagcttgagtgggacattctccgcaggggctggctggccacgggtggacgtgacaagatggtaaaggtctgggacatgaccacacatcgtgccaaagagatacactgtgtgcagacaatcgcttcagtggcccgagtcaagtggcggcctgaatgccgccaccacctggccacgtgttccatgatggtggaccacaacatctatgtatgggatgtacgccgccccttcgtgccagctgctatgtttgaagagcatcgtgatgtcacaacaggcattgcctggcgtcatccgcatgacccctctttcctgctctccggctccaaggacagcacgttatgccagcacctgtttcgggatgccagtcagcctgttgagcgtgccaaccctgagggtctctgctatggcctctttggggacctggcctttgctgttaaggaaagcctggtggctgctgaatctggacgtaaaccctatgctggtgaccggcgccaccccatcttcttcaagcgcaagttggaccctgcagaacctttttctggcctcgcttccagtgcactgagcgtctttgagacggagtctagcggtggcagcatgagctggttcgtggatacagctgaacgttatgttctggctggccggccactagccgagctctgtgatcacaatgcaaaagtggctcgggagcttggccgcaatcaggtatgtgaagctggagacccagggtccgagactgctgctgtagttggggcatcatgcccacaacccccctgagctcagtcacagtggcagcctctgtcacagtatttgacagtgtaaagatcatgggaaccagactagcccaaactcagggtggaggccaaggagtcccgtgcctacagcccgctcttctacctcgttcttggtgttggagctgccttctgctctctctcttccccatatctgttccattgctaatcttagcaccagacacctcacagatgtgctactgtagagtggacactgctctttccaggggccagtttcctgggtggtagtagatcaggccatgggttggtatatgactctgctcaggagatggagacccctgagtggttggtccctccccctaggtggcacagacatggaccatgttacggattatctactgtagccctggcttggtatcctctgccaatctcaaccacagcgtcggcaaaggcagctcctgcggcctaccgctcatgaacaggtagatccttggctacttcctgccccctccccagagtggactgccggggcctggccacccacaagccttcccttcctatagcttcaatctgaaggatatgggcccggggctgggcagtgagacacggctggatcgcagcaaaggggacacacggagtgatgcggcgctgcttgactcttcagccacactcgtcaccaatgagggtaggcagggatgctgatgggaaaaggctggggtgccactccctgaatgacctcccttccctgctgggcagataatgaggaaacagaagggagtgatgtgcctgctgactacctgctgggtgacgtagaaggagaggacgatgagctgtacccacttgacacagaacatgtgcactgtgagtaggggctgggtcagctatagaggggtccaacccagaacatggctctgtgagcaggagctgagtggagcgggaagcctacactcaggtccatctttcctcacccctgcctcccagccgaggagcctgaatatgtgctgccacaagaggccttcccactgcgccatgaaattgtagacacaccatctgggcccgagcatctgcaggacaaggcggactctccgcacgtgagcggcaatgaggcagacacagcttcattagccccggtggactcctcctcctccctcctctccgtctcacatgcactctatgacagccgcctgccacctgacttcttcagtgtattggtacgggacatgttgcgcttctacgctgagcagggcgacgtgcagatggctgtgtctgttctcatcgtgctgggtgagagagtgcgaaaggacatcgatgagcagacccaggtgtgtgatggatcggggcggggcaggggagggtctccccagactggctgctggttccctcatctgagcctgtttcttttccactgtacccccccccccccccacacacacaccctagtgttcctggaaacactaacctgagcctgtccctccccaccaggagcactggtacacatcctacatagatctgctgcagcgcttctgcctctggaatgtgtccaatgaggtggtgaagctgagcaccagcagggcagttagctgcctcaaccaagcctccaccacgctgcatgtcaactgtagtcactgcaagcggcccatgagcagccgcggctgggtctgtgacaggtgcgatggtgcagttggggaggttggaagggaggcagcccagagctccccagctgaacagccctcccattcccaggtgccaccgctgtgccagcatgtgtgctgtctgccatcatgtggttaaaggcctgttcgtgtggtgtcagggttgcagtcatggtggccatcttcagcacatcatgaaatggctggaaggcagctcccactgccctgcaggctgcggccacctctgtgaatactcctgacctggccttccctaaggctgatgcagcgtcctcagctcgatcccgatgtccaccggactaggctcacagccccttacccatcctgtgtaccaggatggaaggtggctacaactttttaacccaataaaaatccagagctgctgtttggccacttgtcactttcattgcgccttgggtgggaactttctagcacatgggaacttccggtaggggcgctgtagccatggtaacgcacagtagtcaatggctgctcgatacaattttccctccgccttgaggaaatgattaaatagggatgttgtgtggatgtgtgtgtgtgtgtgtgtgtgtgtgtacaatgcgcttgtatgaagaaggaggagacttccaaggccggctggctactgcttgcaggtagctacagcagtccggatgataagccaatggcttgtggttacgcaagtgtcgacagaattcccagcgtgctgcgcgcctgcacccgtatgttcatggcggcggctgggcggcgcggtctgcttttgctctttgtactatggatgatggtgactgtgattctgcctgcctctggcgaagggggatggtgagccataggaaatgggtggcgggagggagcctgaacttaaagctttgactggcctgacctgttgtccctgcaggaaacagaatgggctgggaattgcagcagcagtaatggaggaggagcgttgcacagtggagcgtcgggcacacatcacgtactccgaattcatgcagcagtatgtgtgcctgccccaagtctcagcatgattctaggcatactaccaatcatggtctttggctgcggaggtctcactgcctggtgtgtaggagaggcccctgcagagttcaaactcagtgcaacattctcctctttccccccagctatgccttcctcaagcccgtcatcttgcaaggactcacggacaactcggtgagtattcgtaccctgtgggcaactgcttctgtttggccaagtgctcagttaccttatccttcatccccagaagttccgggccctgtgttcccgggaaaacctgctagcctcgttcggggacaacattgttcgcttgagtacagccaacacctactcctaccagaaaggtgagctacacaccctgcaaggtttgccttcacatctcaaaggcagaactgaccagtcccgactggctcccccttcttgtagtggacctgcccttccaggaatatgtggaacagctgctgcagccccaggatcctgcatccctaggcaatggtgagccagacccaggcagcggtgggagtggggtacttgggagcccactgttgccagtactcctgcctatcaccctctctgctggcagacaccctgtacttttttggagacaacaacttcactgagtgggcatccctcttccagcactactctccgccaccattccgtctcctgggaaccacccctgcttacagctttggaattgcaggtaggggctacttcaaaacaaacttgggggagcccatatatattttgttcatcagctattcataactgaccccacaggagctggatctggggtacccttccactggcatgggcctggtttctcagaggttatctatggtcggaaggtcagtacagtgttatgtgtgtgttatgtgtgtgtgtaaatctggtgtctatagtccattgcacacatagtgaccttacactcctgcctccagcgctggttcctctaccctcctgagaagacacctgagttccaccctaacaagaccacattggcctggctgctggaaatatacccatctctagccctgtcagcacggcctctagaatgtaccatccaggctggtgaagtcagtagctggtaggtgggggttgggctaactcaaaaagccatgaatcaaaattttttttttcttttctcccaggtactgtattttcctgatcggtggtggcatgccacactcaatctggacaccagtgtcttcatttctaccttccttggctagccagacaggcaactggcaagcccactgcaccagcacatgccaatgtagtgctcacagactttattacaggacagtggcagcagcagcaacctcagcccaccctcacccactctccagcccagaagggggacaagggaggctcatggtccagcaaggggtatgctgagaaggggagcagttcagaacccatcagcagggccgatgggggcaggcccagggacacaaactatacagggactggagcttccgtctccagatcctcctgggccagggtgccaggcaggacatggggcctcaatagtcctctacccagccgttctcagagatgaaagcgtcaatgacttccttcatggccaagttggggatgagctgttcctgggtcagagggctccgggtcacagggtcaaagtggcccacacgctgcaacagagtcaagagtgttcaatggcctgagtataccgatccgggtaccaaggctctccatggcccggtctccatgggccctccttacctgcaggtgctcctcaatgtccttgcggtcataggtgataccactgggtgtaatgcagggttcccgcatcagctcaaagctaatcttgccacacaagtagtcagggatatctcgcttctatagcacaaggggaaaatgtctagaactggagggggctgtgggggtcaccataccagcagcagccgatgagcttccgggggtcctcacctttcttttctcgtccacctgagagaagagctcatccatatctgccatgtatttatcctgcagagttgagtgccatgtgtgggcaactcctgtctccacacagacacacacactctgtccaccagggcactcatgtcatgcatgggccaacagatccaccaaaggctggggcacttttcatgccacacacaaacacacacacaatgacccacatgtggactaggggcaccctcacgtgcttggcctcaatgcaggcctgctgggcccggatgtggccatcatcttcatgaccctcgtggttccgctgacactcctccagttccctgagggttaaccagaagctagttggtgatggccctgaccaggaaatcacagagcccgccccatctcaggcctctttcctcctgggcttcccatgtaccggttgttgtccttcaataaaaacacttgtgctggtgactcagtgtctgctgggggagggacccacctctctcgctcagcagcaatgagcctggtgagatatgaatgcagctcactctcctggtggatgcgccgttcctcgatactgttccagcgcttcttcttagcaatgcgaagggcactaggaatatcatccccaaagttgagtcgctgctccttggccaaactataggctaggggagtggacacttttggttacacttgtcaacaatcctggtcccccaaggtgccctcaaccttgcatcttgtcagcccacctcgctgcagattggcaatggcctcatcataactctccatctccagctggcactgccccaggaagaagtgcgccttcacagactgcccgtccagctccagggctcgccggcagtcagcaagtgcctgttcaggctgctgcatcttcagatagcacagggcccggttagtgtagtacactgccacaagtgggttccgagtctggggaccaagaccaggcgtcaaagagtgtgggctcagttgatcccctctcatttagcaagctgaaagccaatgatctggtcaatgctccagctttgggggcccatggctggaatagaggaactggagatttccgaattatcaagagctctggattctggccatgctttcttgcctccaactgcttttgagagaaatcccacaacccctctacaagctctgggcttggaaatctcaaggggcaagagctcctggtgtcatccttagtcttacttaatcaagcatcccgcccgccagttcccagtcaaatcagccctagactcgggaacagcaatccgggcaccaggggagcgagcgagccatcgagtccaggctgccagaaaccctgtccgggatcacaaaactgggaggcacatcgggccccgcccccgcccctcccgcactcacgatggcgcggccgtagcaggccgccgcctccgggtacttgcggcccacgaagagccggtttccctgctccttgagctcttgcgcactcgggctcttatcagggctgccgccgccaccagtgcccagccgcgcgccgccctccttttcctccttgcccttcatggcgccgcgcggcacggcttgggctccgcgcccggccacctagatctcgcagcccgcgcagcgatcagctccgcccggtcggcgatccgccaccggaacttccggtgtggggcggagctggcatggggacacgtgagcaaaggcggagcctcgtggattgagccagttcccttagctctgagaagcttccgccgcgctctacaggccccgccctacagtaaccgagacctaccctgctcagaccaaggctccgcccatcggcgctcaagccccgccctccggccccaagctgggcgaacgtggcagcggtcattgagaagtggccttccgagggccggtcactaggcccgggtcctagcgcaccaccagggcacacacgggctcacgcgacagcctgggaacgtctggaccgccggtaggaaggcggaattgagggtagaagagaggcccgcagatcagaccgctctcgaggggcttcctcgggaatcgggaggagctgcctgcggccattaatggctgagaaacaagcacgtgacacgctgacaccgaaggaccttctgcggttgctatagaagtagctgcgggtgcacggctggactcttgcccttctcgcggtcatggggaggagcttcttcaagggcggagccggctggtttccttggagagcgcctgcaccaagaccctttgaccccatggtctgtcgttgaggcatttctagccgctgctgcatcagctgttggccgctaacacccccaaccccggacttggagaagcagaactcggctttctgctgatctgggcgccgcagtcaaacttcgctgcgtggtttctgccactgcctcgagtgagtaggtagcatctttgcccaagttgggtgggggctctaggagctcaaaaaaagctatccccagaacctccttgtcactctttgcagtggtcctggaggcagaggtttctggggttgcagctttcatatacgaagaggcggtggctacagttcctagcttgctaaccctccagtacacactcaagcactacttgctgtttctagcccaggtgcaagagttcactgcctttctgagcggggctgagcggggcctgagaggtcatccagggccccatcatggttctggtggttagtaacttgaccccagaacccttgtggacctcactagtgagtgtcttagagttgtagactcttcgtcttgtgcaaacttggggggcagatgtatgcccagacctgctgcctgaccttcaccctgactgggcctcccacaaggacctgccaagaattacaggacccaggccaagtgaacctagctctgttgtgggcttgcgtttggaagggaggctgaaagaacaggagattggaagctcttgtagcacaataaacgattgctgaacttggactgacctggaagtccacagtttcttcccaggggccccacctcctgtggattccggccatggccaggagtaaagctaccacctcaagtcaggtgcagagcttgaagggagagagggagcacagaccgtcctggaggggaggtgtctcatacagcttgggtgagggggcagacaagcctgcagagccccaggacagctacctggtgctgtgtaaaatatttattcattctccaaaaaggctcagactgcaagtcctggggtcagtggggagggaaggggtctcctctagggccacgctcaaggtcctccacccagccctggcccagtaacacccctccccctggaaagcctggggggggggggtgcagcaagggctgcagtaagacttggcttcagctgggggtgggggatcacagggcccccctgcccctgtggggaaaagcagccgagaggtccattcatatagggcagacatgcaggcccacctggtgcctggctctagccacatggccctagggagcaggtcaaggtggaggggggatatcggcacccagcaggtcataggcaaagacgttccagaagatggcgaaaagcaggaaggtgccataggcaagtagcaccacccaccagccgcactggtccctcaggcgttcctcatagctccgaaggatggtaaggcccatgcttacacctaccactgcaccagccaggtgtgccatgaagctgggctgtgggcctgaggcaggcagtggtggggagaagcgtagccacacagcccggcccacttcggaactcactgcagagggagcaacaggtgggaggggccctgtctgcaggtaaagggcctcccagcgccccacctgccccactactcactgcacaccagagccagcaccatcctcagcagcttgtatggacaccgcatcccagcccagttctgatgggggcaggcagacaggctgtgaagcatgtccaatgggccccttcccacctccccagaaaggcagtcccattaccatgacaacattggccaggtgtgctgagcacagggcatagacccctccagagccccctaccacgggggcacgcatatctgtgatagagacagtcagggagcctgtgggcaaagggagaggtgagggcacagctggccctcccctcagcaggtgaggtaggcaggggacccacccacctatatgccagtctcacctgccagcacgcccgccaggtagagcaggctgatgcgaagcacgccatgtaccatctccaggggcacaccgatcatcagctgcaggagggcattgaaccctagctgctccagcctggccacagaagagcatggcagaggtggtcagatgggtaccctgcctactccagaccacctcaggcagtgtaacttagctgggagataagccttcagagtcagtgggcaggtgctgggggtaggagtggagaagaggctctggaaggcaaggctcacttacccgacatgcatgaacatgtaggtgaggaagcgccatgcccgagcacggtgtcctgggtgatacaccagagggctcttcatatattcagggtggtaggtctggagcacccacttgttgagacgtgccccgtagcacaggaacacgatgatctggggacactagtgttagggctggtcaagactagggactcaggaggccccagggcaatgtgtaggcaggcccacctgggcaagagtgaccgaggccatgaacacagggggtgggcaggtgcggtgcctgtagaagtaccagcggcggtccacctcgcagggcaggatctcgtaggccacatagcgcacaaaccgcttgtagacactcaggcctggctcatctagcagtccgtctcggggcagtgcccgctgtccgttagcaatggctctcttgaagctgctggaacgcttgctgctgatctgaagggcaggaaccttagtgtaggtgacagtattgttcctgtggaaccctaccttacttggctgtgtggctgctaatggtctgagggtcttccacactgcccaggtctgtaagccctacccagtaaaaagctgtgtgcccacccagctttggtcagggtgctgcgcttgaccaggcctgggccctcccctgctgcccacacaccatggcactgaccaggtccaccagctcctggtagcagacctggccccgctcgttgctctgagccagagccaccaacatgtccaacttggtggggtccaggggcagctcatggctgtgtaccagaccagcgaaggtgtccgcaccgatgaagcctgtgttctcaggatccagctgctgtggtgggggagtagagggtgggccaactcccagccacagggctgagctaggctggctaggaaggctggacctttgtgccagtcagtgcctgtttgctagaaccagcttgttcccaggccctggcagggcaaggtgcctggtttggctgttctaccacctcatattcgctctaccagtcctagaaaggggaaggacctaggtccaaggaccaccaccctccatccccagctttccgtggaaacccgatgaagccagacctttcttggggtcgggagtctcagagaccaaggtcgtgcagggaggggggtttgggaggcggctgcctgggccttctgcgagcatggtccctcccccgaacccctcaccggctggaagggcgccaaggcagtgccagctcccacccaccacgcacctgctcctgaatgagctgcagcagcgagctcctgtccatagagccgggccgagggccggggtcggccgaggccgggaggggctgctctgcggaccgctccgctccgccccggccggcccgctccgcctgctctgctctgcgctccccgagctcagacagcgtcaccgagatgccagcccagcgcgcacacagccagagtacgcgcatatcctgcacgcgcacgcgcggccccaactcgacgcactgcctgggtagatcgtcccccaccgaacagctcgacccagaaccactgcctgcgtccagctcttgcaccacgtgcggcagaagcttctcccagtaggccatagctggcagcctgcagcacccaataccctcttaggcagcctgttttattaccttccctaggatactttctttctactaaaaataggtctgtgacccatccccagaatgtcaaggtccagttgctcccatcatactttctcctgagctggagctgctttcagtagacacacttgtccttatttgcactgttccagcaacgaagccccaggttccctattcatggccaaggctggaagctctaaccaaacatccctgaattggatttgagatagcagggcctccagtgcaaaaacaccagtcaagaaggcacaggggatagccaggaagagccacaaatagccacgtgaaggtagaactgactgcagcttggataagggagggggtgtgctcctgaggacagtgaaggtgacagaccaataggatgtgtaaccatggcaacccccccaagtatcattcaaaacaatctgctactgcaaagatgggatggcagttattcttgcccgatgggcctctacagggaatacagctgcctacaataagcagcctgcctagatgctcagtgggacggcaggccagtaggttgggactggagcaggaggcaaaggcctcatttttcagggatccctgttctgtggacattctggggcagagagaacccacctgacccaacccaagtgactcgttgagtgtatggattcctgtttgggtgtctttggtggtaggaggtcatgtcacaggatcaactccgagtccatcattcactcagcttctggccaggttgagatctatggctggcccttgcttgtaacagccaggctacacataaagcccaggttctcagcagagccaggcaggctgcctgggctgtgtggagtgtggggcaatgaagaaccaacagcagaagcaatgttcccagagaagcagcaggagccctctcacacacacccccacccccatgacactgatggatgctggcattactagacagcagaccccttaactggaccttccgtagccattaatcagcatgactagtgagaccacagaatgggaaccaggacacaggggagacgtctcagaagggtcaggtggcatttccaactcacacaaaaacagcagtcacattgcgattgaaaagccattttttatggggctggagagaggacttggtggttcagagcacttgctgcctctgcagaggacctgggtttgtttccaacacccacgggatggctcacaatcattagttaactccagttccagggaactctgacatactcatttggcttctgtcggtaccaggcacacacacggggcacttacatatatgggcaggcaaaacactcaaactcataaaaataagcatatttttgaaagaaagaaagaaagaaagaaagaaagaaagaaagaaagaaagaagaaaggaagaaggaagaaaggaaggaaggaagggagggagagaaagagagaaagtaagttgcattgagagatcaaaatccaagagatggaaaagacaagtgaaatttaatcaggaaagtcagttccgcttgctctgcagctggcgcagtgtggataaggctccacacctgacaaaaaggtgggacctctgtgactatcgggtccctccctgatttgaccactacctcttgccctctacatgtccactggccatgcacaaccaggaaggggggggaacacaccctgagaacttcgggtcctggtcactggattccttacccacagcccagccccttacacacaatcctccctccctccaaggctaaggcctcacacctggcaccagtactctcaggctcagcaggacaggcctggaatagggcaacagacttttggaagccaagatctaaataccaagttcctgagcaggaacccacatcagtcccagggaccctgtagccagccacacagatattactccaacaggccgaaagcccatacttctttgccgtgtgggcccacataaggcaccacagtgtgctgtgcctgggggcaggagaggctcatgggtcctttgtcatcggctcttcactaggaccctgtatagtgagaagctaaggacagcagccacagccgtgccgacagccaccagcactcctcggagccagaaggaggtggggtgcagctctgtgtgcaccaggtgtctgtggaaagaataatactcaagacgtgtgcttgcgaaaagctcactgctgaaaacccgtcccaggcaggcggaggccaagccagaggccatccagcatagctctctgggccacaggccacgggtctacagctctgacacctttgtacccagacagactaagccccacccacattgaggctgcggtatactcacgggaaagtggccatggtagcaagttgggtaaagacatctgtgctgggcattgcgggtcccaagcaggagaatgaagctggggcaggcagccggtgcctccggcagaactcagcgggtgacagccctgggggggcaacaccttcagggagatcagctttggaggcaataaagaggcagggggtctgcccatccatgtaataacgctgccaggaaaaaagaaacattcgagagctgagcttgctggctaactgggctatggctgggatccccccacaggacctcaagtcagggcttgccttgtatatggtagcacagtgtacaaaggtcttgggatcactgctgtcaaacattaagcaggcgacatcacaggtagtgtctagagaggtgtccagcaggctgtcagcattcacttcacacagctgggacaaacagtagctttagtggcctccccacagctggatccctcaagggccaccctgagacagctccattaggaggaagaatatatgggtatatgggtgtcacaggtatacccttcaggacatggtgcacaggccctcactcacaatcaggtacttctcctgcccgttgacccgcactgtattgatggtatgcagggggaatttctcaggggggtccctggcttcctgtgtggacagcaggaagagtttttggccccagagttctctgtggcacccctctgcccccttgagttcccaggtaggggctggggcctccataattctcaccccaaggctgttgccaaggaaggcttgcaagaaggctgacttgcccactcctcgggctcccagcaccttacacatgagaacgctgcgctgtgtctgccctttctcctggtccagcttcttctcgcgggtaactgaaaaggtgcgctcacgtgagggtgttggccatcaagaagggtttggctgggcccagggaccaaaaaagtggtcacctacctgtgatagcctgtgcctgagagtcctgttcacagagggtagggtaacccaggtagccaaggtgtgcaaggcattgctggacatccaagtaggtcatgaggctgggagtagaggagggtacagggctaaggagagtggaagatgggatgggtagggacagacaggtagacagggactgtacttacgtccactggcagagatagccatgcaaaggcagacagccagcctgagtggggactgtgtgtaagagttcagggccccatggagcacctgagaacacactgaagagattctgtagttccgtgggcgagaggacaccatcatggtcctacaggcaaaggggctatggtgacaagtttctttgcggggaggggtgtcaaggcgtgaggtgacgtgcttacctggtcatgcttctcgaacatccgctgcacaaactggtagccacgatggttgagctctgtgctgcagccaggggggacatggagcctgtggggatgcactttaactgtcacaaggcagggttactgtcacctgtgacagttaaaagtgcctgggcagtcaggcactcccaacagaacctctggttacacggttggggctaagcaaggggggagctaatgagtgtgtgctcagagaccaagctaaagtccccaggccacaaggattgaccccaagaggataagcaccactgcccaccagcctacaactcacgctggatagaggtagtcgggcgttagctccagtgagtcactgtaaccaaagcgccgcaggatggtccacgtggtctcgtgccggccacgctggatgaagagtgtgttcaggaagaggaagcctgtgggaaggtggaaggttagtacaccgccttgccactccccacacatcaggatataaggtgatgtctgcctcaccttccagggtcagccggtcattctgcacaccacctgacacgttcttgcacaccaccctcttcacatcctccagggcctgtggggccaggggatggccaaagcaggacttctgcctccggtaagagagtgcttcagatcagtcagctatcctgatgaccctctcacaagggcagctagggtgtcagggcaggaccacacctggaaggcattgagttcctcgtcgctcagcccgtggtctcggtcctggtccgacagcctgaagatgcgtgtgagcgcctgggcgcatgcaggcctgagctgcagggacacaacaccaagtggcccttttcctggccaccctgtcggtacgcgtatttacttgtactccttatccaaggcccacatggatgggccttcgagaaataggtgtgtggccctcatccactacttacctgtttggcctcagggtcataaaggggggctgtgggatgcagaacagccttctgggcatagtagaacagctctgagatattcctcaagtgcttggctgaacactggacaagggtgagggcaggctcaggagggacccatgacagatctagggagctgcttcagggtcttaccacagccctccctgctcacctccacgcaggtctctatctcaggaaactggctcatgatgggcagcacagcctccatggtactccccggccgcaggtcagacttattgcccaccaggatgatgggcaacctgggagagaggccatgatcaccagggatggggagcaggtgggctctagtccccctagctgaggccctgctggtcacctgggccctgtcgccgtcctgccattcacaagcgggatccacttggttcggatctgaaagaccaagtccaagtgtgaggcgagagcaagcgcatgcgcatgctcaccagcccatgctcttcttcctggggctacacaagctttcagagtgcaggagcaagctggtgggagactgcagacgacagacagggacttgtccgattctccccaagcaagctgggatatgaggagaacacttcctagctcagagctgtgggggttcctgaaaggctcaacagacgtgaggctaggagaaagggctgagcatcaagagccactgtgtactgtccaggccaactgccaactaagccaggcactaggacaaggagggctagagagatagctcagtggttaagagcactgactgctctgccagaggtcctgagttcaattcccagcaaccacatggtggctcacaaccatctgaggacctcttctggtgtgtctgaagacagctaaatgtattcatataaacaaatgagctttttttttctttttttggttttatttttttttttttgagacagggtttctctgtgtagccctggctgtcctggaactcaggctgtcctcgaactcagaaatccgcctgcatatgcctcccaagtgctgggagtaaaggcgtgtgccaccacgcccggctcaaatgagtcttaaaacaacaacaacaacaaaatggccaaggagatcccctcttgcttaccttctcaatggtggtctcctcagacacatcgtacaccacacacactacatttgcctaaaggaaagcaaggcacagggtaagcatagtctgccggctcactatggacagtacaggccactcctggccatgtcccgggtgctcacagcaggatgggtagggctctgaggccaggaaagtccacctttgccaagcaggcctctccctgccaacactccctaagagacaccagaccctagcaccatggctctagacagcacatcctggacttatgacagacctatcacacgcaggttacagtcccaaggcaggtctctctcactttctatctcagtacaagcagcaaggatgctgcagatgcaagcaaggagacactgcaccctgaccaagtgaccaagtgacctgcacctataggacacaaagaaggctgaaggactgcattcaggaacatagtaaactctggcatcagggaacgcctagttaagatggcatccactacagcctagggaggaatagtactggggaaccgaagtatgttaaggaaaagcaatgaagggtgtgtgtgtgtgtgtgtgtgtgtgtgtgtgtgtgtgtctgctcccctcagaccctgggatggatcactaatggcagtactggccaggtcctgattcccagaaagctatgatctggaaaagccaacaatactcagccgtgaaggtcacagctgaattatcagggtcaagcagagtcacctaatccagccgccaggaaaggaagccgattaagactagatggcagcaagttaggaccaaagaattgggctcagtacccaagggcctgcaagatgcaccgcaccttgtggatctcctcctgaagttcttcctctgtctgctccgcttctaaaaggaaaaagaatgctatgtagaatggctgttgcgctcgattcagaccggctgcaggctcaatacacaccggctggggggcagcatttggagatagatacctgagtaatccacgatatgagtgggcaccttctccggggtgacgtcggcggggatggttatctcctccgcgcgggcagggacctgcaacaggtgggtcagtattgaatgcggagcggctgcccagagcctggcatccgccctaagtgcccagtccgccccgcgcacctcctcgggaaactcctcgccgaccagcgacaggatcagagacgtcttccccacctgggctgcgcggggagagggaacagtagtcaggagcaccgccgaggtcacggcgaccctaccggtcttcccgcggccccagcgcacctaccctcgcccagcagcaggatgcgaacatcgcgccgcatggctgctgcccgcagcagcaccccaaacccacccctcccggcccggcccggcccaagtagacccaatcccaaccccaaccctctccttcaacccgctcaggcccccgcacttcctgtcttcagtaccgccctcacccaagcttccggtcccgcccacacagcaccagctagtggttgggctaaggcaaggcgcccgcgcccgcctgccagtagagtgttcctgactctgcaggtggtgcaaacaactcagactcaacgggctcctcgggaggaaagggtgagctcaggccagaagtgatgcaaagacacaatttatgggacaataaaacaatgtatcgctataataaatgccagtgtttatttccttaaactgtacaaaataaaaacaataaaacaaccttcatgtgaaaaacaacccagtatgccaagttttgtgtaggagggagtggttctgagggtcaaaaccacacttcacagattctaagtcactgccacaccctcagcctccttgaatcttttcagatttcacccaaattccaaacaatgcagttctgaagcctgtcccagccatcctggctcggcatacagcaatccacagtctggcttttctgcctatgttcctagcaatagctcagggatcggtgacttcccacaccaggatctcgttgtgagcagctgtgaagagcagtctgccagatggagtgaacctacacaggtggaccgagtcatcatggccttccaagtcctgggcagtccctgacgcacagtctaggagcctcatcatgcactctgtgggtagatgacagggtgctctgagtactgacaccttgctgggaaccttgctgaggggagcagggccatgacatctacgcccccaaacctgctatggctgaggactgtcaaagctgccctctctatgtgtgtcgaccagcactcaccagcaaaaccaaccaccatgagctgagatcctggggacaggctcaaagacatggcaaagaagggcagaggtgtcttctgtatcacctgtaggaaaacaatatgacactgaggtctcctgccagggacaaagcccaggctccatggccttctaaccctatgacacagccctggatgtccacctacagagcagtgatcgcacaaacctgcttctgacggaggctgtagaagatgacctcctcatgtgcacccaggcccacacacaccagtatcgccttatcccaagggcagaaggcagcaagagaggggggcaggaggcctggagcctgtggaaagcagtatgttgtgctgggttgtgcagactccaatccccacccacatgaccgtggaactcttacctctgagacagcaggtgcaggaaagctcaaccattccaggagttcacagcggtcccggagccagtcagagacccagatgctgacacgttggtccccacttgcagccagccacagttctacaccctctacccctaggtctccatactgggagaaatgagggatgtgagaatctgctgcctgcccacagcaccccaaacccctccccaccatcacctgagcttgccttacttctttgctcgtgctctggatagcagaaattggagcaccccggtggtcactgagcacacggaaggtcattcctgtgcaggggtggcttatagccacaagtccgtccttatctccagataggatggtctgacctgtggcagatggagactatgatgccattatgtgagcccaacccacaacctggaagtgtggtgcaggctagctgaggtgggcacgtgactctgtggccgcgtctgctcaccgtcggtggagaaggcgatggctgtcagagcggtccggtgggggtgcatcttgagttccattgctgtacgagagatactgaagactcgaagtgtgccatcgctgtagccggccaccacctgctgctgctctgggagttcacaggacgggggcgtccacgcaaggcagagacagctctagtgttgcatggaggagaaatcagcatggccccaggaaggaagaggacagagggagccgagcacatgaccgacaccctccccccccccaccagatctcccaacctacctggttcagcacctgaaactggatcaccagctccatgctggccaaagaccacaccctcacgctcccatcctcaccacaggtggcacagtgagactcaccggggctgaagaccacctcgtttacctgtgggaccccaggacagttgaggggatgcccatctgggcctttcccactcagatctccaagccaggctgcccacacgggaacaactgtcttctgcccaagcccacttgacccaaccacctccgtgtgaggtacatactgctcctagacttagggatgaacccgtcataggtagggcgtggaaaaccccgggaaacactgacagaacctagagtatatactgtgacctggtgtctccagcaggctacagactgaaagagaaagcacgagccacttggatatccccactgctcagagctcaagtggctttgtggctctttattcagactgctgaatgtcttgatggagaaaatatgtgtacctcgtgggcaccactgagaatcaggatttttggaggcaggtggcacagatgccatgaaccagtaaagttccgtgtaaactgatgcataatagctcttggagaaaatccaaggctagggttgctcaggagtcctgggtcccattgccatcctgggctcacgaggttcatatcacagcctatgggcctggaatgcctgtccatccttagtgctgggaagcagtcagggctgccagcacagctaagggctcaagacccaaacctctgtgcgcgggagggcatactggctatttgaacaacaggaaactggccataggaaagacagaagaactgagacacagcctggatgaacctagaaatctgatggacaatgaaggaagcccatacaaggccataggcaagatctatcacatgacaatcaggcatgaataaatccagatagtcctatcaaatggcaggcctgcctagacctgaccacatctgaaatacccagaccagttccaactgcgtatgagcagatacaatcagaacctggcgggaccgccaggattccacactaggatcctgacgatgtcagcagagccagcctatgggaagggctaagcaggtgatgtgggttctttaataagttacaaaaagaaaagactacagtcttttgagtctccgagtgttactcatgagctgaagacacgatgactgtggtggaagagatcgaggcagtaaatgggcttgctgccctagcctaccctacctgggctggcaatcctgtcttccttcacagcccagagagctcaccttggtcctgtggccactgatgaggcgggtgctagtgccctctgtccagctgatgtaccagatggtgccagctgtggtacccactacacccatgtccatgccactgtcaaaactggcactcacaacagccccatccagggtcagctcacgctccatgaaaacagaactggatctaagagaacagggaaaggagtcttgaggctggagacacaagccagcggagtctgccaggtgacagggaaactggcagctatcagtctggtcctgtgctcccgtgggtaaaggaaccgacccgacaggtcagagattttaagcttctttatcctcggtctgcagtgtgcaaggcccgtgctatctatgcctgagtgcacccataaagaggagcccaactaagacagatatgtagggtagcccgagactaagagctgtgctataccagtgctggcttgcaggatctgtcaaggacttgagactttatagccaaaccccagggggatgatgcaggccagaggcctacggcagctcacctggcactggagcctttgcgccttagctctggcacaacccccacagcccaaaggcgcagcctttttgtgttgctcccactgatcagtctagagcctgaacacagcagcacccctaggagacaaagtgggtataaaatacccatttcccacactgtgacagccagctcagctggagggtgacagagactgtagaacactcaccgatctccccatcgtcagcctcccaggccaggaagcagtggccagtgccagtgtcccagacacagacctggccagagctggagccgcagtagagcagagggctggccccatagcagagtgaggtcaactcggacgcccccagttcctcggggattggttcccggtgtacctgacagacaagtgtggctgtgggtcagtgaggtcctcagacaaccgtttcccattctcccaagttgcccatggaacgcctcggggctggagagatggctcagaggttaagagcactggctgcttttccagacgacccaagatcatttcccagcatccacgtggcagctcacaactgtgtaactgttcaaggggattcagcaccctcatacagaggcacatgcaagtgagacaccaatgctaaaataaaataacacctcagtcagcagcctggtacctggaagcaggtgtctgccccatgatgctgcaggagccagaaggtgatggcatttgtgcccacacagatgagctcattggcatcccatgggttaaaggccacaccatgcacaggctccaggaggcgagtggatgacaggagttcataggtggccatgctccacagggcaaggttcctgtcagcatagtcccctagggacatataacaggaatgtcaggcatagtccagccaccagggctcctagaaatctaccctctctctgcttacccaagcctacctacccagcgttacaaggaactcatcatctggtgagaaagccagagcttgcacagctgtgtcatgatgggaaaggaggtgccgacaaaggcccttgggaacatcccaaattcggatctggcaacgggcagctgtgttgccgcagcaggaggcagaggccaagatctgcaggccggaaggtggtcagtagagacagctcccatgcctgcccttgctgaatggcaggtactcagggacatatcctgcatgctaaactagaaccacagccaccctctactgtacactgtgcccctggacgtggacaagggatgcacctggccatcctggttgagtgccagagtagagatctcctgagaatggccaagccagtgcctctgggtgccagaatgcaggtcctccactaccaccaggcgaccacaagtgtaggcaaagaagcctgtaggcaagggaaatgacaagatcccagcaccgccactgccggcagtaagacctcacggggctttggcataataagggcatgtgccagtgccctacactctagaagcttcaactgacatccagtgtttgttcactgtggaggacctaccctagaggatgagactggacactgcagtcctacctgtgtcgggcctccagaccatgttggcccgcccattcccattgtagcccacaatggccttcagtcgcagccgctccctgccaatgggagggaagtagacactctgcaaggaagcagacccagaaagctggtgaccagcatagctgtccccagactacacaagtcagctggtgaccagcatagctgtccccagactacacaagtcagctggtgaccagcatagctgtccccagactacacaggtcagcgctaagagatatacagagtggtcaggtaagggacctggggtataaatcgggaggtgggatccatgggagccaggaactaggaacttgatgctcctggagtactgaggggcagagaagggcagcagcgccagtgagagacagaggtggtgtgtggtatcaacagaaccagaaagctgagaatctacactatcagatggaggctgtgtgtgagcaggatggagtggaagctccccaggggaagactgagagggtccatgatgagagaagacgatgtttagaccctagcatggtgtgctgctaaccttaacccgtggtgaggtcttatatcgaggtgtgaagtgcttgtaggaatctgggcgggttgggagcccagccttcccgctccgcaggctccattcacctgacagaagagaccatgggacactcaactgtctactaccaccagagattcctccccagacacaaagcgcccataaccctgctaggctaagagctgtgtaccacccaccacaggtatatcagaacccccagagtcctggaggtgacctcaagtcatctttcaggaaagattactacaagcccccaaagtggcctgacagaggtcttggtctctgtctgaggccaggcttactcatgtggctgtggggactgggacgctcagctggtgtccaggagctccctgcagtctcccgaggggcatccccagcaccactggcttccctgtccacgagcacatgtggggtcggggcctggccttggaggagcgcctcagaaacatggttctcctcacagagtccttcctcatcagacgtggagaaggtgcctacggttaggaccagcaagagaaagagcaaagtcagatttggtagtgcacacctttaatcccagcattcaggaagcagagacaagtagatctctggagtttgaggccagcctggtttgtatggtgagtttcaggtcagccagagctgtcttgaaagtgagacaaatgtatacacatatctagtatctgctccagatactcctgctgctccctggagctcactgaccggaccattacagtgtacaattatccaacacagccaaaccccagttgccaggtacatgctgtgggcagcaacgggctgtggctcccacagaggagggcacagacagagtgagagtcggtcttgaaagaaaaaaggaagaaagggaacaacagctacctggcccgacagcactaagaaccagcacaccatgtgaccacgtacacccagacctgccgaggaccccaccctcaccagtactgccgtcaaggagcctgtcatggctactcagtggaggcggtaatgcctgaaacggtatgggcacttgctgccgagggagtccactggccccggatgccaggtcatccagctgccccgaactagagcctagagatagaaagaccatgtcagggctgggcgtgccagatatgtctctcagggaggaggtctcatcaggcaggcacaggagaggagacggtgtcacttgcccaacatgaccaccaaccaacccagtgtcagctccacaccaactaacacggtcatgccctcctctcccagctaagcctgaatcactcaccggcctcatgccctgggggtgcttcatgatcacctccatctctgagaacaagagaaggtgtcaggggccagccagcaaaggcccatgcagacatgatgaagggtagacacttgcctctcaggggtagccaggatgtcccagaggaagatagcatcccccacactgatgacctgcagctgatcaggtgtgaaggctacagcgtgcacaggctctgagtggccaatgtatacctaggggcagtaagcaccacatatagggacccagagcatgcccaggattctgtgctcccagtctctaggtatccccttgtagcatttggcctcagtaagcagcgagttctacacatcaccttccatccttccaatccctgccttccctcacttgctcctccatggtctcctcagccacccctggagagccacagcacacaacacatacctggcagctggggttcgcctgtgttggataatcccatactgtaatggtccggtcagtggctgccagcagcaaatgagcatcctcactgagagccagggagcagcaggctctggagcggacactagataactagaataaagcattctcaagatgcccctttgtggtagagcagctggcactggggcaaggctgcaggaacagggaagggtcggcagcccactgcctgtagtgccctgactcacctcccggagggtgtgtcctgacacagcatccagtaccacaaccttgttagaggatgtggacaccagcagatggcctgagttcccggggctgaagcagatagccacagcccagtccaggtggttgctggccaggttgagggtgctgacatcaacacggagtagctagggggcaagtgaccactagcctccaatccaggcttagtgggcaccacccagggctagggaagtggcttcaggagcccccacctgggtgcccagaaataaaccccacttaggaagctgagcttctggaaagcatggcgaggccaagaccttcattatcggggataggccctggactgcccctgagcaactgtagcctcgtgcctattcctgtacactttatacctaggcaggcagagccttggcctagggggtcccacactcacctcatccaaagaggccgactccacaattgtcaccatgcacttggaggggcccacaaaggccagccggcagctgtctccactgactgccagaatattggggttggggcgaccatcctgacagaccatgttggctgtagcagcacagggcagggggtcagtgggtgactcttaaccccatcccccctgcagcatacactggccctctatagtttgcacagagctcatacttcaggtctctcaggctgtctcacacgaccacttggcaggctaagtcaaggagaaacactggaggcccagacgccatctgaatgggtctctcacaagtgctttcccagtgcagtgcccaggctgcccaccttctgaagcagaagaggcacagacccttattgacccttggcttgtaaggagggctcagagacccctccttggtaggaggcacatgacacaacacagaccctgagcatggaggtaatggccgtgccctgattagattttttttttttttttgtaaatgtgacacaagtcagagacacctagaaaaaaatacctctatcagattggccatgtgagcaaaattgtgggagcattttcttgattaatgaatgactgatgtagggggtcccgcccatttggcagtgacacttctgggccggtggtcctgggttgtgtaagggaagcaggcagagccagccatggggatcaagtcagtaaacggtgcccctccatggcctctgcttcagttcctaccttcaagttcctgccctgacttccctggatggactggaaactgaaagatgaaataaactcttccccagcttgctttatcagagcatagaaagctaaccaatcagagctccccagtgcttggaaccaccgtgagtggctaggagcctgacctgccacacgtaggacgcagcactgagagtcagcacagctgtactggactagggagccctgagagcaggagctgaacaggaatctgccgtcaagggtgatgaccaggctggtgatggcccctcggtgacgcctgcagcacacatgggacactcgctgaccttggtcctgggagccaagatgtggtttatggtggcactggctttcctgcaaaggatcctccccacatgggatcccacagagctcctgagcttccatattcactggtggtgcccgtgtagccctgcccctcacccgtccccgcccctggacactcacgtgtgttctaccaggactccagagctctccaagctgaaggaacgcacggccccactgctgaagccacagaagaagtttggcattgtgggatggaaagcaacagcacaaggggtgtcctcggaggacgagaagtcatacagctggaggaaagagaccaccatgaagggtggggaggggccgagaaaactcaaggggctgggcgtggtggcacacacctttaatcccagcacttgggaggcagaggcagtcagatttctgagttcaaggccagcctggtctacagagtgagttccaggacagccaggactacacagagaaaccctgtctggggggggcgggggaaccctcaagggacaattgtgccccatgtgatttttaacactaagttccagagactgggccggaaggacccaattccctgtggatccctgccctcagcctctgggtgtggtgtctggatttatcccctgcctgccttttgccactccctacctgctgtagggtagccaggtcccagatacggacagtgtggtcaagggacacagtggccatctgtccccggttcggttctgtagaaagcgccaacactggggccatgtgggagcgtgccaacacagtatactcccgggaggggacatccaggaagcccaggtggcctgaagtggtggtggacagcacacgcaggccatcgggactgaaggagaccgaactgacagggccgtcgtgttctgtgggaagggtaggtcgacagccgctggggctccaggaaagctcacaccacactatgtgggtactgaagtacccaagacacagaccccttgctcctctgctgccaaggtctccaaagctctgagagtatcatgcccaccagccactgctcccaaagccccggtggaagtggcctgctgagagcagcactggtactgcgaggcagccaggttcagggcagctccctcaccccatagctcactgtccagcccgagacgagtactcccaaaaccagagccagaggatcccaaccttccctgggccagctctccccacacccacgctagggtagacagatgtctgcaatctcaccggcctctaggagcacggaggaaaagtccaggggccagagtcgcaagtagccatcctcagagcccacagcacatgtggcagtagagacactgaggctactgatagcgatgccggaccctggaaaaggtagccatcagtacctcaatgtcatgtcacttccccgaggaatgggtccccacctacccacgctaaagttctgcttctcggcgaggggagcaccaggggaccgtgcaggcagcaagcggcggacgtgctgcaccgacatgcgctggtggtcaatctccaggatgtgaccactatggctgcacacaaagctacagagggagggtggaatgaggtaggcactcagggtaaagggagggctgggtaagagcaaaggtggggactcacagtgtgccggccgagggggcacagtggccatccaacgcctgtgcaaaggcaaggtcagtgagctccagtgaacagtactcccccaggtccacagcgcaggaccgaagaacaccaccccgcagccgccagagcctcacgctgccccgaccacatgatgccatcctgtaggtatggaagagtaagcaacgtggagcagagaggagctggaggcccaaaccctgtcctggcaccacagagcctggccacgtcacctggtttcatcaaaaaaggccacctggaaggcccgaatatcgaagtcagtgtgcacttttgcaagaaccacgacctcaccgccgaggcccgcctgctctgtactccaggccaccaccacctgcaaccaacatagagtgaactctcacggcagacaccaagccccgcaggagctctgcctagccctgccctgtaaggactagctgagccctcagcccctcaacaggtagggagggacttttccctgacacagagaccaaccagcccctgagcatcaggtctgcagagtgcagctgtagctgtctataaagataagcaaaacctgactgagactggggcatagctcagtggcagggcaactggctaacataaggccctaaattggattcccagcattctgggaaaaacgaatgtagctcacactgaaacaatgggtcagttcagggcagctgaatgcttacaactctgacaaccctgaacatttaaatacagatttagtgtatgtagccctggctggcccggagcttgatatgtagaccagactggcctagcgaatggccctgtttcctggggggaaaaaacaaagcaaagccaatcaaaacaaaggaatgtgccatcacatctaggtcatcttgatattcattttctctcccccccccccagatttatttattttatgtatatgagtacactgcagccatcagacacaccagaagagggcatcagatcccattacagatggctatgagccaccttgtggttgctgggaattgaactcaggacctctggaagaacagacagtgctcttaaccacgcagtcatctctccagcccccattttaaaacaagatagacatactattttaataagcagaaataaacaaagacaagatttttagaaaacaaaagctgggccagggagtgatggcacacacttttagtcccagcactcaggaagcagaggcaggcagatctgagttcaaggccagcctggacttcagagtgagttccaggatagccagggttacatagagaaaccctgtctcaaaaaaaaaaaaaaaaaaaaaaaaaacaaaaaaaaaaaacaaaaaaaaccaacaaaaccaaataatcaaacagcaaacaaataaacaaacaaaaaagcaagcaaaggctggctggagcgcaccacccaagcaacaggtaccaggcttattggcacattaccgtcctcccgtgtctgtccttgcccacaccgcagaggagtgccccgctgccagagaagctgtggtgtgaaagatgaggtcagcatctgatgaggcatctcccactgcccctgctgccctgatccaaggctactgcacctgagggagcagatggtgtgcagtgggcttctgaagagagacaggcaactcccagtctggaagtcccagagacgcaccatgctgggaggctgcacctgagctgaggctagcagcgtatcactgccattgagcgccagggcagagacctggagatgtagaataagcaagggaatgtaatatggcctgcaggttcacctctccctctccaggcccagcaggcatgtaccttgtcggtatggccaaggaaaaacctctgctgtccagtgtcaatctgcaggacaattatgactgcatggcaggggtaaacaacagccacaccatctttggtccacagggcctagcataggagggccaggaccaaagtcaccacagaaacccagccaggtccctcttggttgcttagaaggggagtctgacacacacatgtatgcacacagcacacacaggcatttggccacccaaagacacatcacacacacacatcacacacacacacacacacacacacacacacacacacacacacacacacacacacagaggcatatgtgcagaaatcaactaaagcctcttcaccataaaagactggtgatcttggtagcaaaagatcaaagactcaaagaccacgcccagaagggcctagagagtacccagaaagaagagaaacaccactcctttctaactgaggtctttcctagaggcccactgcatagcatatgctagagcagacttcccacatcacacccaattccaacacatctggtctggatcagagagacccacactcatagaaggtctaaagacatcaccagggctggaaaaatggcggcagaaaaggcagcttagtactcttggcgaagactcacgttctgccccaagctcccacacggtggctcacagctgcctgtgactcctgttcgaagcatctgatgccctttctgatctctgtgggcttctgcacacaggcagtaaggatacatatacatataaaataaacaaatctttatgggactggagagatggctcagcagtataaagaacttggttccttttacaaagggcctcgggttcagtgtgtagctttggctgtcctggaactctgtagaccaggttggcctcaaacagttatctgcctgcctctgcctccaaatgttgggatcaaagtgctgccaccacctggctacataaatttttttttaaagatgtatttattatatgtaagtatactgtagctgtcttcagacaccccagaagagggcatcagatctcattacagatagttgtgagccaccatgtggttgctggatttgaactcaggacctctggaagagcagtcagtgctcttaaccagtgagccacctctccagccccataaaataatcttaaaaaattttacacacacacacacacatccgtatctcagagctcttgggtctttgggagccctttagcccagcagaccttaccaagtgaacagagggcacccatgacctaaagactcacattagccctcaggaataagaggtgggcagggcagggtttcttgaggaaagaaagtgcccgagacagaactaggaatctttccttccctaaaactcactcgtcccacccaatcaaaactggcctgggaacctcacccattgggtgctgtgacccccaaaaccgatgacgcccttgagcctcaggactgggtctgggaggaaaagctgaaataggaaaatgcaaaatgagactgggggaagtcactctatcccctgcgaatgccccacttgtgctgcctctcaaataaaaggtggggaggtacaaagaactcctgctagaagcagtcttctggctgcagtggtaaagtctttagaaaccccaggtcctgtcctttgacagaattggcaacaggaacaaacccatctctagaggcccatccactctggatgcatctcaggaggctcaggttagccagcctgttatctcactaatgcccaatgccttcagatgggcactcaccctacaggaaccaatgtcctcaagggccatgggcacgccagatgatctgtcagcaagaacgtgtctctcgccggacaccgtgtgtgcatcgggaacctcatcgcgaactgaaggacgttggctctggatgctggaggcacttacactggagacttctcgatacctgtaggtccggctgacctctggaaggcgactagatgctgaaaggacctggcatggctgtaatggaacatgtgccatcagcacccttaggggcaccggtccccagccctttcccaagcgcactcaccaatgcagagctacatgcctgggccacaggggacttactgctcagcaaaggtttgcccaagacccctggatgaggcaggtgccgtgacatacgacctaggaagactacaatggagcaaagagccagggaggagcagcaagaggacccatgaggatgtcagccaaggtgcagggaggaacaggaggttcccctcaccattctacagatgctattccataaacgctgccaccattctatcctaaactctggcagagtctctccaacacgaaagcttggagaccagatgccacttgcatggaccttacgattctaggacctcagagggccaccagctccgcccttctctgggcctatttccaggctgccccaggcacataccatgtgtagtctccatgctactgatcctcattcaggatgccccaaaactgttcccaccaagccctgtgcaccctgtcgaaccacagcccacctgcttctgggggggaacagctcttctcatcctgctcatcaggcaccttggaacagtcacttggaaaccttgtggggggcaaacacaggtagaagcaaaatcaatatctggggactaaaggccacctgacccctcaccacctgaggtccagagctcctcaccgaacgtggatgtaattgtcatgccagctctccccttttggcaccgggaaagccatttctcgaggcatagggttaacagacaactttgcacgccgggcctcagtgacagtgacagctacaatgagcaggactgttctagatcaagggacatttgtcctatcccttcccaccccaggcaacatgcattaccaagtatctgccactccaccaaccaacccaccccaatgctcttcctggagctgggagccctggtgcatggctctcctctgaaattggtaagtggttcttatctgccagctagcgggagggttctagccttctgactgggatggggcatgaagtgtgggcctcaccagggtcaaagcacagatcactggtgtagaggtttctgactagcaggctggcacacagcctgatgctcttgagatgactatagtgcctgcccaggtagaacatcaggatgtcacgcaggtccagctgtaggcaggtccagcgggcacgaggaagagctacacctgccaggtctgcaggacacgtgcgaggtcagcacctaccattttgttgcaacccctctcagccccatcccctagctatcctcagggccacacagaagcacatgcccagttgggcctgtaccatcccgttttaggccttcattcaagccgtccctcttggaccaaatgtcaccacctctcctgggtgtcttagtctcgaagacaaaggggaactgaagccacgttgtggaggacttgaactccttaaagaggttggagaaagacacacggatgacctggccgtcctatgaggcagagcgaggccattagaaggagattatggcacggtgggaaagcagcaatagacacccagccctccttccaagctgggcacctcggtggacacgtccaggtggatgacaaagtgcttggtaggcacaggccggaaaagcacatacaggtaccgcccagtcagccccagagactgggtgctagttctggggagctggatgtagttgctggcagatacagacccacggatgcgatacacagcgctcttcaggaccttgtcctagaaagagagaggtgctgcaaacaggcgcaaaactggaggacagtcacagtgcccactgggagatttctcaggagcaggaaggaccccgcggccagtaccgtcaccacagccacatctccctctttgctggaccgtttccactcatccaccctgaaatgtctgaatacattgaggaaagggtgctgccaggctgcagaagggacgccgcctgagcaccgatctggggcagcgcgccgcgaccctccacctccgcccgcgggacgggcttctgcacgaggtccagtcactgacgcggcggggacctcggacccgggactcccgggacgcgagccctgacgacagcgcgtctcgcgcgcgccgctacctccggccatggcgctacagctcgcgcttcccgcctcagctgacgctgtcttacgcaaaacacatagcacggcgcctagcaacagcctcctggcaacgcgcgtcacttccgtcgccgctgcagcaacgcacaaatatcccgctgctgcgtggtcctgggcacctagcaggcccctaggtcttgcgtgggctcgccctgcccacttccaccgctgttgcctcctgcttggggctttgcggcctcgcccagccggggcctcagcactgtgcagggaactgtgctaagtagccgtggtcgctgactctctcagaggcctccggttttgttttgagagctgaacctttttttctgtatgtgagccagaaaggtcatgctgagacctgtccacatccacggtccacccaggctgggcctcatctctgctttctaactgtgtggaggtatctgatcagcatccagggtactctgggtctccctgcttcaggagagtaaggtccctgtgcccactggggtgcagctttcagataaccacatcaccacaggttcaacatatacccaaagacccttgaggcattttcccagtatactacagcagacctccagcttgagagagaaggtcctgcagtcgagggctaggattctattccagctaagtcctggtggagaatggactttgcctcccagacatgctctgtcttctcctaaggattaatcctgttaactaatgcactgggttccttgctcaacttttttttttcccttttagacggaatctatgtaatcctggctgtcctagaacttgctatgtagatcaggataactttgaactcacagctccagcctctgtagttcagggattaaaggcctgggccagccattcccttcagaggcccttctgcaaggtagctgaccttatctctaagagcaaagcttttcttcttccttcccccacagcagtttagaacatttatagctgcctgccttggggttttccctttaaaggctaataaattcccaaacttctatttcagtctggttttgtccttgagcttgtttgtggccattctctttcttgtctctttctgtctgtctttttgagacagaatatctctgtgtagtcctggctgtcccagaactcactatgtgggagcaggctggccttgaactcagagatcctcctgcctggccgtttaaaatccatatattaatgaaacttaagaaccccaagaggggaccttgatttctccagtatcaccaagatttcttccttttaattctttaatcggcagagaaaacaaactctttcctatatctcactccagtatcacctgggtcttgggtctgactttggccattgtcaagaaaaagaggtagtggattcagatgagacagcttgaaactacatatttccaaaatgagctggtcaaggacctcatcaccctagttatcgcagcatggtggggcatgtctttaatcccaacactctgtgagttccaggccagccagccacctgtctcaaaaaaaaaaacaaaaaaaaaaaacaaaaacaaaaaaaaaaacagagctggacaaagcttaacttcttctagtccaagagtaaagaggttgtgactaggagggggatactgcaagccagtctataatcccagctactggggaggcaggaggatcaaaagttccaggctagtggcacatgtctttattccagcacttaggaagcagaggaaggcaggtctctgtggactcaaggctagactaatctacatagcaaactgcaggtaaaccaggattacacactgagatgctgtttcaaaagaagaagagggccgggcatggtggcacatgcctttaatcccagcactcgggaggcagaggcaggcgaatttctgagttcgaggacagcctggtctacaaagtgagttccaggacagccagggctatacagagaaaccctgtcttgaaaaccaaaccaaaaaaacaaaacaaaaaaacaaaacaaaaaaaaccaaaaaaacaaaaaacaaaacaaaaaaaacaaagaagaagaggaagaagtagtagtaaacagaaggcagaggatataggtcagtaggtcagtagaacagatacctagcctgtgtgagaccctcagttcaattccgagtatcacaaagtgttaggggaggctagaagctgagactgagaactagtagactcgtggccccaacacacatcccccaccattcaccaatcaccaacacccgaaagggcagtttctcaactttattagcctgaactcctccctgccagccccaggggctggtccctgggcacagtgagcaggactgaggttagacaggtttggcccctggctctggcagcttgggacagccaagccaagggaacaacaggtgcaaaagtccaaatgttggcacttcaggtgtggccggtacccagccaggccacaaggtggatcggcgcaccatggtcctcttctggcaaagggtccactatggcaacattccttcccggacagctgctaggaacagttggtgattttagccagaaactgctgtgcccaccactcatcgaggtcaataggtacaaagtctgtgggtagaataaatgtcaggcagtgatgctgcttttcaagctggctggtacctctgccctctagctgatcacaccccctaatctggactctaagcacagcaattaatggaaaacaggagactctgacccagcacctccttccccaactacctgaggctacctggtatagagggttctttagggatttgaggcataggagaaggctcactctgtagccggggatcaggagtgctctccacatactgcacaggccgtgggccactctcatcggcagggccgccatccagttgtcgctctacctgctgccaggctgtgggggaaggaacagttagaatgaaccgggcccctggtgtccctcccaccccagcacctgggggccaccttgcactccagcccagctcaaggaatggacatgaccaggcagagagccaaggaaaagtctagcccgtgacctgctaggagtcagggtattgtggggaaggacaaggccaagccatggccacagtactggaattctgtggcctgagccacaccccctggtcccttactaccttcggacacaaatcggacgttctcctcgtgggccactgtgtaggtctcttgggtcccctcgagggatggggaggtggtgaggggtcgccggccgtttactcgattgaatacaagtcttggcccagaactgtgggagggtaggagagagatacagttggcaccagccatgtccaggagctaccttgcagggttcaagagcggccctggtacatacccactgcacctgcataggcccaggcccaaactagacccttccttaaccagagcagctgcccttagctgcttcgaaacaaggcctctctgctttcagaccctgagctgactgcagctcagctctgtagctctgggcccagggaaggtgagtgattgcaagtcagaaagagtccagctctgtatccagaccttcagcaggggtcccagagaccactcctctgcactcccaatccccaccaggcaggcttccagcagtctgggtcagacctcaacatgatcagaaccttttgccatctccacccatcaagcatagtccccttcttctagagatgtcctcaatgacaccccccactgttgaacacagaccaaacaaggatggatcggcgtttactcgtccctgtccccggctgcccccagacccctgggagaggaacacaaaatgctgggctgtctctttgggaaaaacatgaccttaagcctgacccactcctcaaggcaagagaaaaggggcaaattgaatgagatgctcccccaccccataaccctgtgctgtactctatatcaaggggtgtaggcccaggggtgaggccaagcaggcccagggcagggcagggcagtgcagggcagtacagggcagtaatgtgccatctctgttgactggcggcaactgaccaagccctgtgctcgtgaagcctggggtggggccacggagggaatggggccgcacctacagtaggaggtgggagtcctgggctgcacctgccactccgccaggcactcgcggtcccggcaggcctgctcgccttcctgggctcaggtgccccacgccgctctgggttcctcctcaggtgagaggggcactaaaataaagaggagggtcttgaggggtacagggtcctgccagccccaggtctggccaggtctggtggctacagaaaattttagatgtgccagtggagaccagaggaggcaggactcctcccaaacccacgggtacctgtgtatttggtaaactagagggcataaaggcatttttatttttttctagacagggtctctctgtgtggtcctggctgtcctggaactcactctgtagacctggctgtcctcaaactcagaaatatgcctgcctctgcctcccaagtactgggattaaaggctcaagccaccatgccccggtgcataaaggcattccaaatggaaacccccacccccttgcctgcaaccacctctgcccccgaaagggctgaagctcaatgcgagcgagctgttgggattggacactgagtctttttatgtcttttgtttggttgaggcgggatctagactaacagacatcctcctaagtaccaggacataggtgggtgtgtagtagcacacctacctgtgccttacattgattctttaaaaaacaaacaaaaggaaatcccagccaggggctgtggattaaggtggtggccctggagctggaaagggccccagagggcaagtgctgcaccaccatgctgagccctgcccagcttctgcttagaggccgtggttatataagaccaggctctgtaggggaaagggcactaatcccagagtgcacctgtatccacttctaggcccactgcctgctgcagcaccaggccatagtgccccatagacatcctctcatgtactctcctaccccctcaaggtgaccggtcactcatctttcagcctgggatctccctgcctgtgacacacagcgaagggcatcaagattcaaaatcaatatttcaagatttagcagtattctgaccccagtactcccaaccttgactctgtcccaaggctcttctgcccagtggtccctgaacattttctcaatctgctcttggtggggtaggtggtaacatggtcgcatctcaagtctcccccatctgtctcttgccgccaggagaaaagaatatgtcagaggcacaggcctggccaccataactggcagcacccatgcctagccatttagtgggttgaaagcttcatgattttgccccacagcagcaggagaatgaccagtgcctcctgtgttccctgatgctggtggacatgggtgactgatgggtggccttgaaaagacaaaggactagaggtaaaattccatgtgaaggtcctattggagatgggagttcccagcccaggaaagggccacctcagaggacatagggaagactccttagcctatctcctcagttcccagaactcaggacaggaaaccaatctcccgggcgtcaggtgttctccctggttgctgacagatgagtccaggccttcacatcagcttatcttactgaagcctttttagaggaaacacgcagtgtggtgtctcttgcaactcagcattctggagagtgttactaccttctcctcttcctggacactgacccaaatattgccacaagcctgtccgtgttgtcccccaacaataaggactttaaaaggtgttttcccgccgggtgtggtggcgcacacctttaatcccagcactcgggaggcagaggcaggcggatttctgagctccaggccagcctggtctacagagtgagttccaggacagccaggactacacagagaaaccctgtctctggggtgggggtggggggtggggggtggggggggtgtttcccaggtagagataggccagtcaccaaggcagctccaaactccctgtctgggtaaccactttgtggttatacatctgcaccatagagttctcccagagacataagggcaataaggacataaaccgatgtcatacggatgtcccctagggcaaacacaggccacacaggcatctcctacctatagcttccgaagcctagtagctgagagctaagaggggtggagccagccacacagactcccctgctgagacgagtctaactcttggcctccctcgagattgtggtctctttggtgctctctcttaaccggttcacatgccacctctaccagagtagagcctacatgcctgcagagtccagtctaccgatacaggaaacagtaaatggagccaaagaagtaaaaggttcagccttggttgagtgggatcacttccaggtcacactggctgaaatccaagtagctagggctgaacttccctagacacattgcgggttaggaaaatcagaaaactcttggaacccacaggcgcgggcaactgctggggaggagggctccagtgtcccagggtgttagtgaagggcagggacctgataagaccagcgggaacacgtgcgcttcttctgctctgcaaggacagggcctgaagtccttgagagccagggccttgggcaactttccccaactttgacctcgaccacttcccaaggggtccaagttagcggcccaaggtcaccaggtccctcggttttgagtacttgcggtccttgacaggcgggattggtcggaagccctcaaggctccacgtggccaccagggtccactcaagccagctgggcccagaagtagccggcgagcagaagtgcacgagttgcctgcgccccgccccctgcccaccaggacgcgtggtccccatcaaccttctccaaggtcaccctcgtgcccggcggcctggctcaccttgcaaggggccagggtccctgagtctgtgccgagggctgcaggtgcgcgggtagcgcggtcggcggcaccggctgccggcatttcaggagctcgccaagcctgctctccacctgctgctgtgtgggacctgcgggccggggcggagggcgctgtcagccgccgcgagccagcggtcaggacgtcccgcctgcccgcccgccctgcgcacctgtgcggcgctgcgcgaccagcttgctgggccccttggtgatagtgtacatggtgcgccgtcccgcccgcccctggcagcggccagatcaggcaccctccaccagcttcactttgcggtcccagaggctcggcccctttaaggagggaggacgggcaaaggggcggagcgacccacacacgccccctgcccttaaaggagcttcgcctacttggtagccttcccaaccctttggaaaattggccaagtcactaaatttgagctaagaacgggttgtactcgccaaggggtatgccatctctagactggagcgtgcatgtgcgagtgtgcatgtgtgtgcttgtgtatctgtctgagatttcagagagagaggctctttcagttgaggagggccctttgtgtactagggtagtgctagggaccctgaacagtctctaaaaacaccagtattccagctcatatttgagacaccaccaccacccagccaagtgcctggacaagcctggattgttggggatcactgtgtcaggagtcagctttagaatgagtgctctaagagtgtttaagtagatctaaagtactgtggaaccagaagaccaggagaacacagagccctcagggggtaccctattcctaaagtactatactaaccgctcttcaattcatgtcctgagccttttccccaactactggggaagctggaaattaggtctgtggggagagccacagggtttcccagtacagcctggaaggaggaagaacccagcaagagtggaagcagcctgaccccccccccgtaccccccccccccgcccccaggtctcctttttttgctgttggttttttgtttggtttggtttggttttttgagacagggtttctctgtgtagccctggctgtcctggaactcactctgtagaccatgctggcctcaaacttagaaatccgcctgtctctccctcccgagtgctgggattaagggcgcgcgccaccactgcccggcgtgatgtgaagtcttgaactgtatctgccaagacttgtgctgcccctgccaccaacacctggccttaaggttcctattgtcatatttgaggagggtcagtctgcaggcactagggactaggggaggcaggtctgtcaagtcttggaccacttaagcaagacgaacagtgaggaaggagtgagggtgggtagctggtccacctgaattccagagtatctaaggaactccaggggacttttatcccaggtgaccaagccttcattcctttggccctgggcctttggccttacattatgcagagcggggctggagagtgaaaggccttctccagctctgagaagactgttgagtgtactagggaggcatgagacatctcactcatgtctagttgatgagccagtgagtttattgcggttacttactggagcatgggtgactctcactatgtcaccaaaaagcccaccacagtataggtgacagctcatgagtgctgatcctgggagcttctttcccaaccctacttaagagtcccctctcggggctggagagatggctcagtggttaagagcactgactgctcttatagaggacctgagttcaattcccagcaaccacatggtggctcacagccatctgtaataagatctgatgtcctcttctggtgtgtctgaagacagccacagtgtactcatattaaataaataaaaaatctttaaaaaaaaaaagtctcctctcagccgggtagtggtggcagcacacaacttgggaagcagaggcaggcagatttctgagttcgaggccagcttggtctacagagtgagttccaggacagccagggctacacagagaaaccctgtctcgaaaacaaacaaacaaacaaacaaacaaacaaagtctcctctctcctagcacttggcacctggttatatagcacctgggaatttgaatcttgaggttttcctgagcttcacaagtttcatatcgccttcctaagtcttaagagcttccctccttcagaaggaaatgtttcaatctgctggtaccaggcctgtgactgcaaaggtgagtgtggatctgggaagagagttaaggcctggagttgtaccgaaagaaagaaagaaagaaagaaagaaagaaagaaagaaagaaagaaagaaagagtgagtcttggagctgagacgaaaggatggaccatccagagactgccccacccgaggattcatctcataatcaaccactaaacacagacactattgcatatgccagcaagattttgctgaaaggaccctgtctcttgtgaggctgtgccagtgcctggcaaatacagaagtggatggtcattgtcttctattgggtggaacacagggctcccaatggaggagctagagaaagtacccaaggagatgaaggggtctgcaacactataggtggaacaacaatatgaactaaccagtacctccagagctcatgtctctagctgcatatgtagcagaagatggcctagtcagccatcactgggaagagaggccccatggtcttgcaaactttataggtctcagtaaggggaataccagggccaagaagtgggagtgggtgggaaggggagcagggcaaggggggagggtataggggactttcgggatagcatttgaaatataaatgaagaaaatatctaataaaaaattgaaaaaagatagctaatgttgccgggcgtggtggtgcacgcctttaatcctagcactcaggaggcagaggcaggcagatttctgagttcaaggccagcctggtctacaaagtgagttccaggacagccagggctatacagagaaaccctgtcttgaaaaaccaaagaaagaaacaaacaaaaaaagatagctaatgttaaagaaagaaagaaagaaagaaagaaagaaagaaagaaagaaagaaaggaaggaaggaaggaaggaagaaagaaagaaagaaagaaagaaagaaagaaagaaagagaaaggaaggaaggaaggaaggaagggagggagggagggagggagggagggagggagggagggttgcttcctggctaaacttgtcccttcccacttacataatgcctgacccacccttagtgacctttccctccaaggccactgtggcctgactcagatggcctacagcatactgtttaatcactcatacatggtaggaaggcagaacaggatcctgggagctcatgctagtttggttgttgttttgttttgttttgttttgagacagggtttctcattggaaccaaccctggatatcctggactagatttgtagatcaggctggccttgaactcacagagatctgcctctgcctctgcctcttgagtgctgggaataaaggcgtgtgccaccactgcccagcaaggggcaggaaggatcagttgggtcagaatgaagcacagtaagggacggaagcatctaaggtcctgtggaaagcatgcataccacaggagctcccttgtgacaggtcccttacaaataatatgcaaccctaactagctactattaaagcccagtctcatacaaactcaccaatggacaaactcagtctttgcttagataatcattggccagaactagagggcaagacattcattcaatagcagaagcccagggttgggttcggaagccctaagaagggttttcaggtgaccttgttctgaggttagggcatgggcagatgaggtcagggggatggggtggggacagaggtgggagtctagtgatctctatggagtaggaggtgatctcagttgaggaggtggaaagatgtgttgaaggggcagatagcctgttgggggttgggctcaacagtgaagtcttcccaggtgcagtgttcctaggtcctgtgaggatggagccttggtagaatgtcagttgggcagcctgacatctgagggagtgagggatatgggagatcacagctagaaccataagagagatgtcctgggtggagcctccaggccctgactatgcccttttcagaggaagacacgggatatctgaacacagaggagttggtatgaaaatgaagcagagatggagtcacagtcaagtggccaagacagtgatccagcacctttgttttggatttctggtctccagaagtgtaacaaaacaaacttgttttctattaccaagctttgggttaatttgttacagtagccacagagggcacagagaagcaagaagggcaacagtaagggctggggagaaacctcaggggcactggactcagtgaccatagacacgtgggactgggctaaggaaaagaatgtgagtcctgctcagttcaggctgtgtgagacaaagacaccagtgcctctaagggagaaatatagcgaggctggatgctcactcatcaagtattgcctctacgctaaccccagagagagaagccaggacagaggccaaagctaggagagtgtggaaggaccagagtaacgtaggtttctaacacaacacaaaatctaagacctggggctctcaagggccctgataatttggtaataaagataaactcatttgaaaaagccaaaatcagctccaggagcctgcatgtctgaccttaacaggaacccagcctcaacaactgcttgccatggctggagagtccaacttacagggtccagacaatggccagcatcaggcactcaggatctccaggaagcaggtgctcacacaggccaactgcaagcaaagtctcctctcccatctgatggcctctgacctcagtaattagggaaagtgttggtgcatccagagcagcaactcccacaggagggtattaaccagaggccaagaacccttaaatgtcttgttgagcgctgttctctaacgcagcctccctgtggggaaggggaagcaagaagatcaatctagggctgtcatcagtctccctatttcctggttttttgtttgtttatttttcagacagggtttctctgtgtgctgagactaaatgtgtatatgctacgcgatgctttaggaactagttttggccggcgtggtggcgcatgcctttaatcccagcactcaggaggcagaggcaggcagatttctgagttcgaggccagcctggtctacaaagtgagctccaggacaggcagggctatacagagaaaccctgtctcgaaaaaccaaaaaaaaaaaaaaaaaaaagaattaattttgattctttgttttgttttgtttgttttgttttccagacagtttctctcactgtggactagcctctgactctccagtaccaccaccaacaggccccagttgaaatttaagtagctccctggctgtcccaggccctcttccaggggctctccttgagacagggcatgtttagaacagtgttgcactttgatggagagaaagaatcatccacgacctctcctgaacttggacatatggaagatgctcacacccccagctcctctgcccaaaatcccacgaataatctatgggaaaagcaagccaggtatgcagaggctgaggctgtaaaagggagagtctgactcaggtccagtcaaggtcactaccaatgtcagacatccataaccatctgtcaggggctgctcagagtgggtgaggggttggacttcaggactttccccgagtctggactgataacttttcagaggcatttctagagtggccaccctatatctcatccttgggccatgtcactcacatagtttaacagtttgactacactcacacccctggtcactccggctgaatagacacctcaaacacagccccaagcaggagccatgtttaaccctgagctccatgatgtagtatggggcagagtagcccacgcaacctttgaactaactgttggcaatcaagcgtgaacgtctcggacattttctaaaatccagcccctgtgagaaatgaaccacttcaaaccacacaaaggtgagaatcagagaagtacccttgtccgtgcacttgtcgcttcgaatttcatttcaatagtcactgaccgcctcctgctatctatccgtggacctcgagctaatgccagccgtctcagcgtcacacaaagctcatctgagcccaaagtgtcccagacccgaggattcctgcatctgggttccccaagctccattctgttaccgcccatgcccacaaggcttggcttgttgaacctcaggacctgagcgcgacctcaggcttccaagagatcgcgaccgctatggtttccatggcgcagaaccaaatcctgtctataaatctcacggtacccacattttctcctttcccttggacgacagcaacaacactttgggatctggtgggatatgttgttctgcaaacgcttgccaatagagaaacggagcgcaacagaaaagacacaggcataatgctgttacattaacatgcttgcgtcacaattcgtatgccctacggactgcagtctcgctcaacagcgccgctggtgtagtggtatcatgcaagattcccattcttgcgacccgggttcgattcccgggcggcgcatgttctttttattttcccgttcatctctgaaaaggaaggatgccttgcaatcttaaacaccattccaaaaaaggtgaggcgcaaacgcaacaaatgagcttttaaacaaatacagctgaaagactccaggaaaccatagcctctactcgagccttgttccttgtccgaagtcaccgctaaatcccggccgccggaatcagtttcccgcagatgcaaacccttttaggagttgagaggcctcctaacagttatactgttgcaagcggctggccctttcgaccacaactcccgtagtgccccgcgcaggagctggaccacagctcccgtggtgccccgcgcgcattctggctggggctggccgcaccgctgcgatgatgatggctgcggctgctgagagaaacaaggagcccatcctgtccgtactccgccagtatgtggatcctgcccagcgctgtgttcgcgtgctcgaggtggcctcgggctctggacagcacgcggcacactttgcacaggccttcccgaatgccgagtggcagccgtcggacgtggaccaacgctgcctggacaggtgcggcggcgcggtgtctttcccttgcggccgcttggggctgagtgaacggcggggctggcagaccggaaatcaggacaggcctaggtttgggtgccagactgaggtagtagaagcaatgggctgtagggtcgacaaagatacccgcttgctgctcctcaggactttccccccacaccccgatcactgaggggcctcgtcagcccttgcccatgcgctgctgctctccacagcattgccgccaccacccgagcccaagggttgtccaatgtgaaggctccgctgtacctggacgtgacctgggagtgggagcaatggggcggcatcccaccccgatcgctggacctgttgctctgcatcaatatgatccacatcagccccctgaactgcacagaggtggggaccactgtggagcccagctttcacgttgcaaagaggaaagcatgagtctccagctcccggcttactgtgccctacttgccttcctctgcaggggctctttagagcagcaggacacctgctcaaaaccaaggctgtgctgatcacctacggggtgagtgaccctaccttaagacacccctatcagccttgggtgtttccccactcttgaagcccagggcccgggacctagctagcccttttccttcttgagtgcagaaaaaagttattctttctatactcctatggaaagaactccatcctatcctgcaaactagctgtgtgggaacgactgactttgggcctatgtattgtgtcttgttctcacagccctatgccgtcaatgggaagatctctccccagagcaacgtggactttgacctgaccctcagatgcaggtcagatctggctaggaggtagcttggctcagagagagggtaggcgggatcataacctcaactctgcaaatgccttctaccttcctccccaactgcaggaacccagagtgggggcttcgtgacacagtccttctggaggaactaggccaggccagtggcttggtcctggagaggatggtaggcagggcgatgtgggggtggggagcctccctgtgattaagagtcactccagcctggcatggtggcgcacgcctgtaatcccagcacttgggaggcagagtgagttccaggacagccaaggctacacagagaaaccctgtctcgaaaaaaccaaaaacaacaacaacaaaaaaaaaaccaagtcactccagcaaagcgtttttccaggtggacatgccagccaacaacaagtgcctgatttttcggaaagaatagcatctctgtcaaaagttgtcacggtacaagctagacctcagcccctccctcagtccttgggataaattagcccctcctggtctggtggccacagggctgtagagaacctgttctgaaggggccttaaaataaatcctttccagcccactgtgggctatctataccacattgcttgctgggaatacctgggagagggcgaaaggggaccggtctgggagatgattagggcttggggtgggtgtagctgaagcaggactgagctgactttctcctatgtccctggagacaagcttgtatgtctgtctgagggctcccaagagtgagttggtgctacttggtgacctcaactaggaactggaagctccatctactggaaggattccaactgaatagatagggctggtgggggtgcggtggagacagtgctggtgggggtgaggagtggggtggagatagtgttggtgggagtggggtggagatggtgctggtgggggtgggagtggggtggagatggtgctggtgggggtggggagtggggtggagatagtgttggtgggagtggggtggagatggtgctggtgggggtgggggtgggggcgctgcagctagaagggacccagaggctatgactcccacaggcaaggacatttattcagcaggaaggagggcagggatggggatcgtgcataaaactagtcttggaagcggttgagcagttcacaagccttcttctcgagcagttccacaatcttcttgactcgcttctcgctggcagcacggacatagctgttggcgtccaacacagccacaccttcacgaacctcacccatgatgaccagtggcccatcgacagctgtcacgttggggcatgggcaggcccagtccatgccactcaatgtcacctccaggtatttggtgcccaagaacttgaggcccatcttgtcgtcctttagcacatcatccaaggccacacgagctatgccgcctgcagcctcgggctcctccaggacctctgtgagtctccccacgatggcaaagtcactgcggcacaagctcagagccagcttgctcttgaggcggcaggcacgacagggtggtgtgcgtggtacagggcaagcatcctcacagctctcccgggtctcaaagttattgctgtttccttcacagccactgtatacaaaggggtggcactgctgtagcagtgggctgtaggcccagcgtggctcccagccctggcagggcccctgaactgcaggcagtgcacagacatccccggggccacgaacacaggcctgctggcatgcctcataggtctcaaagccccgggcagccccatcacatctgagggctgggaatgtcatgcagctgcctctctgtgggtcaaagcgccaaaggacatgatggggagtaggtggcccaacacaggcttgtgtgtcggcctggcactcagccaaggctgggatacctgggtccctgtcctgagtagttgcccgctgtaaaacggaaaggggaaagtcggcccgcagcaggccggcagcgtttcgtgcagtgcaggtatacaggcccgcatcctccaactgagcattgtagaggactagctgtccgatactggtgacaaccacgttgccatacatttggtcagggcgcatgatcaggttctcccgctgatggctctgcttctcccaggtcacagcaggtggtggacggccactaacatcacagtggaggctggctgtccccccaacatgcactgcctgtggtgaggggctgttgtacagggcaggtggcatgggagcagccccaggggttgggcgagcagtggtctcgggtggtcccgggctgctgggcggccaactgagaatgtgcttacagggtacaacgtgcaggtggagaccccgcaggcaggcttctgcgtccatgtagcagcggttgtaataggtaaggccatcagaagcacatgtgaagctgggttctttttcacagcggtcacggcagcgacaaactggctgcccatcccagatgtcacagtcagaaccctgttgtgggcattggaagccttcacaggaggctgctgtctcaggtacagctgggccaccactgggaaagcgggcagccacgcagctctgcagcccacacacattggtgcagcacttctcggatgccgcacagtcctgagggacagggacagtttagtggagccctgaccccctacccagccttgcctatgcactactctgcctctctatcctgggagaggtagctgcctttttcaaagcttcctcccctgtgaaaaactgtggctgtgcattttgaacagtaggagtactaaggtcacacagtcaccttagtcaaccccagtcaccttagtcaaccccgctgaatcctcaaggcccctgtgcaactctcattagcattcctactgagtaggtggaacagtgtgcaggcaaatgctctgccatcagagggcgcaccaccttgggagctctttgtccccttcccagtctgggatatgaggaaaggactacagacaggccagggctgggaaggtgatgatgccatttgcaggggtaggtcagaggcctgggcccacatgacttaagaaaaaaagtggtgctcaggcacgtgagagacaggattggtgaggttgcagtcagtccgggaattggagatgttcttgttcttcagaggacaaaaaggtaggggtatcctttgagccccatgtacatacaggtcatggccacaaatccaggtaaattgagtgtggaggaaccctggaggaagcagactcctagggttggggtctactccccccactgaggaaagaactagggtggggcccaggatcccatgaaatgccagtgctcacctggtccccggtacactcacgctcacaggtgctctgggcgtcgacccacaggtgggggctgagctcgttggggcacatgccaggatggcttccgggatctggcagcaggttggtctccgaggtcagatggatgagcacgaagacaaagagcagaggcaggaatggctgtggggcaggcatggggaccacagggccagggagtgggagtgtgtggccaccagctgagactccctataggcatccaccctatagggtcctgggcccaggatcactaccccctacctcaaaggaccctctcctgggactcttggaccccgcaaggcttgagctcacaggtgatgctgctcttctctgaaccctgaatagttattctggggcctctcagaacctgtccacaaaatactggctggccctctcccaaccactgtgggtggctcccaggctctggtcagcataggactgggaatagaagaagaggaagggctggggaggggccagaggccctgaagcccagagcaactgaccactagggtcaccaaggggcggagaagggccagctcaatcagggagggggatgctgtaacctgagcccctccctctacaagctggagcccaacagggatcaaagtctccttaaagaccctcccaccctctattcagggaggaggggcagggctggtaaatttcggcttttgtcctctgctcttcagtgtcctattcagtgaggttggatagggacccagtccagccccagctattagactagattttctccaaaggcagccaagggccacacctgtcataactataggtaaggcacctttcccactggcatggagtaagaaacccctagggtacttggcatctgtggtacacacttgtaaccccagcactgggtaggcgggacacaggaggatccagattgaggccagcccatagctacatagcaaattccaggcccgtttggccacataagaacatactgtctcaaaaagaaaaaaaaaaaaaaaggtcttggcatctcaccagctgagggcacaactcggcaggattcatcctcccagatgtaccagtttctctaaaactgggctcctggcttctagctagggtctgtgccactcagttccttcaaatgggcaaggcaggtacaaaataaataaaaaggccatcttatctgggtggaagcaggtgacccatgtgcactggccatagacagtctcatggcaatgactgatacatagtgtaaacaagagcaaagagaagccagccagctggtcacacacaggctgagacacatggggctctctgggatggccaagtgcacctatcaaagagcaagcatcctcggtgttgctcagggaggatctaagtacattcaagccttgccccaaccatccaccatgaaggccagcatccattctttaactgaactaggggcttcactaccgtgggggaggggagggagatcaaagctggtggcaagacaaaggccctgcctggaatctgcttttccaaaccctttctgtggctccagaggtccccagggagtggttttctcagagacaggaaggaaaaagtctgtgtgaccctctgtctgacctcctgacccaggaggcagggtaataagagcctggtctggtcaggagatcaagagatggctaccaggcgccagtgtctgctgccttacaaaagagccgtcgttgaggcagcttgtggtgttgagggggcagggattgccaggccacaggctcagaatgcaactaaggaaaaatgcaggtgacacctgagccagaggccactctaaagtgaactgtccaatcccactcagtgggatttgccttccagtgtatgagctagaaccctgggtgagcatggcctgcagaggccatgacctgctagatgctttcctgctaaaggcaccaacgccaggtcccactcacagatatccttcatgttgtggtaagctatgtgccctgggctatgtatgagtaaaggctctgtctaacctggccaagatctgacctccggaaacagtgtggcttgtaaccaggcctggctactttgtggctgggaatgtgaacccagtggatggatggctgcaggtcagcagggtcagctgcggggaaagttaacaaagcctgggatcattctgtcaggcacaaagccatgctggagcatgtggcagaacacaccgccagacaccccttaccacccccaacaaaccacagtcagatgaagccagacacaagctcactgctgaagtacatttactgtacaaagaagtaagaacaaagaaccaggaatagtggagtccacagcagcaagtgtagtgttgatggtgtgcacgcaggccaatccaggtcctcaaagtctataccattctatcgcgattccagagaaaaggtctctgtcaacagcaacaggactggtggggaaaggtgatgcttgattgtacccagcctctgggtcaggctcccaggtcaggctgctgcttatcaggcagttcccacaaccatagccccgtccctccctacaggcattgactcaatctcccagaacagcaggctggcgcagcgtctaccagtgccctagtaacatccatggtaagatgatcttaggaaacgtgcacttagaggtccccagtcaggggtcatggctcctgttatggccagggccctgagggcaggaggtagagttaagcaccagcgtgcctgagggctgtgtcaccaggcaaggacagggaagcagtcacacaggacatccactggggacagcatccccacaggggagaaggctgcccagcccagactgggagaggaggagcattgtgggggaacagtccatggcttcacaagttgctcaggccagtgagtccctaaggaggggcttggtgttccagagagtgtcactaagaaacaggtcaaagagattctagtgacatgaacttaaaggcagaagggccacaagaggcaagtcgcagctatgaaacacagccgaggttgatgagtacaagctgctagacactggggtcctaggccctgtgcccatgcccagatgcacggagcccgccagaagctctgtagccccggctggagatgtgtatagtaaacatcactgaaagggccagggcacaataggagggattagtggggtttcccaggtgcatcaacggctcttctcctaggtcttaggagctgaaaccttgcctatgcccagcatactgatcacctttgtcagatatggaagccggagccaagcctgctgctagaagcatctgaaatacactgttccccagtggcctctgagcaacacccaggcagggtatttataaatctaaagatctggcttcaacactgaaaccccccaccactgcttcatccctccttccctgacatcctgagcttccccaacggctgatgtggctatgaggggcatccaggcttccctgacagccctttaaaaatgtacaaaacaggtaaaatgttctccatataaataaaggggagcctggctcacttccagtctggagtccaggactggctcacccctggtcccgtagcaccagcagccctgctgcctggtttgcggagcatgttctctcctgcatgcccctccctccactagctcagatgtggaggaaagcctggagagacccaggcagggttgtgtagccaagtcttcctgcacacagcagggcctagcgcatggtcaggagtgctccagcgtaagccccaagtctgaacaggcggaacccatgtgtcccgctaggagatcttgcagttgctccgagagcagttctgaggtgggctctgagggggccggatggacttagacctcttaaggctgttgcccttgctgccactgcccccggccccacttgccagggagtaggagcggccgtgcatcatgacagcgttcatgccgttggccatggaaaaggacttgaggtggcttttgatggtgacaggtagtgggagcttgtcgatgaggtgcacaggggtacaggagacaatggcacggcagcagaggtcctgcaggctgaaaactgtgagcggaaggcaagatgaaggagggaacagataggttttgttaggggagttacatggtcctcagactacctgtaaaacctggctgctgcatctcaccagctcagggctcttggatgcccactatctgaccactgggtggcaaccatctcctgccttagagcagagcagacctcaaagtgctgctggtctgcccagctgctctatgaggctgggggtgggtgaggaggcagactgactttggaatgcagcctttactatagctctggttggaggttaactcagttttttggcccaagagagggacttatttaccccactctcttctgacttcacagggtgaaactgtgacaaacagtgagccctattagaaagtaacccaagtaaagccatcattaggggtttggtgtggacaatggcccagacattgctgagttgcacatcctgcctctgtgaccactcggcggcaaaggtgcatgtgcagagctccacgcttaaagcacagccaggaaagtgattacttcctgtaggtctgagcaggcagtccagatgactgcagctctcaagagaccacctagactctaacttcactgtcaatgcctgcagttccaccatcacaccccatcactccactagctagcatcctatagaaactaagcctcagtcccacctcgattgggtctccagatcttctccatgccatgccgcatgagcacgatacgggagagctcagtgaaggactcaatgacgttgaagttgcacagggggctgacttcaaagaaggtcatgcagttcttctctgcataggctctggcctgctccgttggaacttgccgcttgaaggccaggtgcagccggttcccaaccaggatccggggaacaccaggtgcatgcttaagagatagggggttcagaacttagcagaggcacaaccacatgctacccccagcacttggccatgtgtggggctcccagtgtctgtactctgcaatgcagcgagtctaggaaggcctggatggaaccaggtaaagtgcagagtccagttgtttattgctgaacaacactcccagggtcaggaaagactatagtggcagcactcccaggcataccccaatcacagcttggtcccacagtctcttccggagatgcacagatccatacttacctcatcgatctccttgatccaccggtcaatgccatcaaaggaccaacggttggtgatgtcgtacaccagaaggattccctgtgagtttgaaggaaggagattatccacaggcatgtctggacccgctcccaggagaaacctgctgcatgggagtggtcacaactcctaggcagggctaggagtacggtccagaagactttacagatcactagtatgtccaagaactgaagggggaaatgcacctgccacccaacgggagagcagcaggaagggaccttctgtgagtcaaattggcccagcccacatatgccatcttattcatcccctgagaaaatggctggggcagaaattacttttaacaatattttaaatccaggccagttacagacattactctgaaattactcaaaagtcacacaggctaagcttacgcacacaggtcaaagcttttgtcgggggaggggtatgaagagccatagaactcactagaggggcaagcattctggaagtcagtccatcagcgaactctgccctgggggcacctggggctgaatggaggcagctctgagttttccaactccaaacttgtaccgcaggatgtcagtcactcacagagcagtagtcagtgagagctgctcaagtcaggctaagcagaatttgctacggggcctttcctgccacatccctcagagaccaattactagaagctcagctttgggctatctccatctgcctcaaacatcccagcggggccactatcatggactttccagcaggggcaatgttgagcacactgccaacctgcctctctcctgttctgagatgacttagaatgagattcagcagccagagtccacccactgaactacccactcctctttccacaggttctcagacatggaggacagagaaggaggaatagaagggggttagatcagaacgggaggagggaagcagagttgccatttctaaaaactcaggatagtcccaggtcctacagagacaaaagtacccttacccacaggtaggtagcaggcctggctcaagcaagggcagcaactggggaggaacttctctatcctggaggggccccataccaaccttgaggccagttaccatggagaggagccaaactggagtttgcttgacctcaaggagccaggctggtgggtaaaaaaggctaatgtttacaataactagacatggcagagatggaggtctacattaatcccatcactcaggaaactgaggcaaggggattgctgcaaactcaaggctactcgaggatctagatagctaggtctaggccagcctgagctacatggcaagatcctgcttcaaaaactgtggtggagccaggcggtggtggtgcatgcctttaatcccagcacttgggaggcagaggcaggcggatttctgagttcaaggccagcctggtctacagagtgagtttcaggacagccagggctatacagagaaaccctgtttcgaaaaaccaaaaaacaaactgtggtggtttgaatgacaatggttgccacaggcttctatctgcatgcttcgtccccagctggggagctgacaggaaaggactaggaagcatgtccttgttagaggaccagagttgctggggtggggggtggggctctgaggtttcaaaagttcatgccaggcccaatatttgcctgtcagtctccctttgcctgccactgtagatcaggtatatacagctcctagtttctctagagccatgcctacctgcacagcactatgctcccagccatgatgatggactaagcctctgacactatatacaagctccagtcagatgtgttctttataagaagttgccttgtcatggtgtctcttcacaacaatagaacagtaaccaagtaactaagacaaaagtcaccaacagtaatagcaaagtcccaactgcctcccaaaatcaataaacaaatacatctctgaacctgttgcctgggcacagggaagcaagctctcatctgttgccaagggaaggaggctgagcttcagaggcaatagtaccactatagcatcacactgtagagcatcctggctcctgaggcttattcaatggtatgccaaagaccactctcagaggctgatctcagcatgttccaaaaatgagagttttctcttttcctggggggtgggggtggggggtaggggaggcgcgggaggggcagggctatggtggggtggagagagttcagtggcagagggggagcctccagtacatggggcctggattctaatcttggcacaacagaaataggagggagggagaaaatgtccagaggcaaggaagggggctggggatacagctgagtgcactgtacaacgtgtgatgtgtgacgctctagattctatctggatgtcggaaaccacaaaaggccaaaagttctcagtaagtacagttgtcaatcacagtgaacatgcatagtaagttgtgaagtgcaagttgcagattccctgagttatatatgctaacactgggaagaatggaagcataaacaaatggtgcacagtacaggaagcttccacaaacatagcagatggtacgaggccaggcgccttgaatttcctgtttacgcctgacgtttaccgtaaccagcacttgtgttgtattcaatgacaagtaagcagaaggccggccaacctggaagaggcgctcctatcgaggctgcctgggtaaagcctgcccagctttgctctcacgggcaggcccttgttggcacaggctctgttaagatggcttgtcccactggaggtgactcagggaagcaccatcttgttgctattggccccacccagaatgcacaggggacagggcaggaatggaaccaagggcttgtaccacagatacaaactaagatgtgtgtgcagggcatgctctcagttcctctcagccaggatagccaccagagcttccagaaatgacaggtagaacagaaccagaaccagtggtgctggatgctttgagaatgattcaaaaacaatgatacagaccccgctctctaaagaatttggactggcaaagacagagtcctgaaatgtacgtttttaagttcccatgtactgagcaggtcagtctcttgttatcttcacctccatttctcatggcttcttgatgcacagcaccaaccccagtcaggccgtctctgagccgctgctctcatttctcccaataacgtttagtgttgccaccaaagctattgcccctcacatcctttttgtaaatttattttttggtaacatttttagatttatgtggatgaaattttatctgtgtttatggctgtgcatcaagttcatgcctggtgctcatcaaagtcagaaggcgaccttggatcacttaagagtgtgagttaaggatggcggagtcatcatatggatgctaggaatcaagcccaggtcccctgcaaacaacaagcacttaactactgaagcatctctctgcccttcttttttgtttttaatttcaaaattatatgtatttactgttaaaaaatctaaaagctgggtggttgtggcacacacctttaatctaccctaggaggcagaggcagggagatctctgtgagttcaaggccattgtggtttttcagagagagttccaggacagccatggcttcacagagaaaccctgtcttggaaacaaccacaagaaatctgaaaatggctgggtgtggtggcgcacgcctttaatcccagcactcaggaggcagaggcaggacagccagggctatacagagaaaccttgtctcaaaaaaaaaaaacaaaacaaacaacaacaacaaaacagaaaaaagaaagaaatctgaaaatgctgctaagcaaaaggaaggcaataagctatgtctacaaacggaggacttgggagatggcttagtgtgtaaggggacttgctgccaagcctgcagatctgtgttttgacgcctggaggaagccaactcccacaggctgtgcactgagctctatactcttgccttgttctgtgcttgtgcatggtctcggtctctctctctctctctctctctctctctctctctctctctctctcacacacacacacacacactacaaaaagaaaagaaaaaggaaggaaggaaggaaggaaggaaggaaggaaggaaggaaggaagaaaaagagggagagaaagagagagagagagagagagagagagaagagggcagagaatggtggcttgtgtatataattacagatgttgagaggctggaagaggcggatcctgcagagtttgaggtccacttgggctataatgtgagatcctgtttcaaaaatcaaggagaggagttgtagagatggcttagtgactaatagcactgactgctttttcaaaggacccagatttgattcccagatccacaaagcagcccagaaccacctataactccattctcatgggatctgaagccctcttctccatggctaccaagcatacatgtggtacagtcatacatgcaggcaaaacacccatcacataaatacatcttcaaaaggaaagcgaagggaggaagggcctgcagaatccatccttagcctaatgttcttcaatgcttcattgtgtctgaaaggaactatacttcagaccacgctcctgccttcagggtctgcctctttgttcccaaggctgtccctggctgtccagaggtagggtctgagtcaggggagttctctaggctcttcaaaattctgaggggtgcatcacaatggagatggacttccactcacaccactcatgtggtagcagcacagggtctaaggcagttctatccacacaggtctcgactacttccccatcttctgctttcagagtgataaaaatcatctgaaaacgtgtgggaggctaggaccagctatccacaccatgggtgtcacagtgcatgcatgatgctcttctacaggcaagacaagatcccctccctagtccattcctgtcctgagaatcatctgcagtccatcattagcatttccaatctgcagagttctaacatgtgatacagcccaggtcaccttcacatccagtcacaccccttaggaggtgcacgactctgtgtgtgaaggagatatagggagatacctttgttttttagtgaaacagatagctaagctgcattttaatggcatggagaggtcatttgcagtgactatgctcagagctcatcctgagaacaggaagggctctttcaggaacactagagactcagttgcctcccacataggcagtccagaaatggaggctccaaagctctggattatttttcctattcagatgggctctgggagacccgatgtccagatgtcaaaatacttcagaaaaagggccaaggatgtagctcagccgttgaaccctcatctattaagcacgaggctcagagctaatccccagcgctgtaagaaaataaaacacaagagagtaaagtactcagggaactgtcaggacagaaatctaggttcagaaagaatcaggagaggtacctattggacaacaacataacatggcgctgctggtcttacctgtgcaccccttgagtaggacctgaagatggtacagaaccttccctggcccgatgtgtccctgaaacacacagaagggagatcagtccccataggagaggtcccagccacaatttttttttccattttcttttttcctgttttgaagactgaggcccactgcatagttctgactagaatttactacatagaccaggctgtccttgaactcacagagtttcttgcctgtctctgcctcctaagcactggtattaaaggcacatgtatgcctagctcctttttaaaatttagttttaagtgtatgagcaacacatgcatgcctcatgcccacggccagaaaaaggtgacagatccactggagctggaattagagacggttggttgtgagctgccagatgggaactgaacctgggtcctctggaggagcaggagcaagagctcttagtgacctctgagcacctctctagccccatggaaacaagctgttatgagtaaaattggaggaggctttaaaacaaaacatcctggaccttttgttttgttcattatggagaaaagtcccatttgagcagggtctctttaaatggttattacaaataaggggcttcctgacttggcttccacaccgtcattagaacaccgactcaccatagctccagcttgacacgccgtccatccaggaggatggtggtagtcttatagtctatccctgggaggaagcagaggggtgagagtgtccatcagcaactgcttcactcaggtcctcctgcccagtactcaaatcccacaatgtccccgagggaacagaatgatggtgctcactgccctcggctatggctttctcaggcaccagcctagctcatgctgtatggcagccatgggcaaggcagaagcccaggtcagacagggcatcagatacgctcagaccacaccagtctctctaaaggctctgggctcagaatgcctggagggaaatggttcactctcacagtgacatgtccttcctagattctaagttgaaccctcaaagaataacacacttcctaattcttggatcatcaacggatttacttatttacttagggtttttatttgttttgttttatttccagataaggtttctctgtgtagcctggctgtcctggaacttcctctgtagaccaggctggtccaactctaagagatccgcctgcctctgcctctcaagtgctaacattaaaagtgtctgccatcactgcctggctacttagcttttagaggcagggtccaggctggccttaagctcatgaaatctcctcctaagctcctgaggatgacaagtgaacacttcacacttctacacaggactaaaggaccttttaaatgctgctccctacagcagtccttagagaactaacttacgctttctctgacttcaaagtttgtttgctttatattttcacatttttatgaaaaaaaagtcaccccgacagatgcaggtggtattaagccttttgaggggaaggcaggggcaacgatcttactatgcagcagagactgaccctaaacaatgactctcttctctcatatcccattaacaccttcaaggcatcagcttcttacctttcatatagatactacttgcaatccaggtgtggtgatacacatctgtaattctaccacttaagagatagaagcaggatcaggatttagagctcaaggtcatctttatctgcacagtaaatccaagcctgcctaatctacatgaaaccttgtttgaaatagaataaaactgtggtccaagagagcttggaaatgggtgttttagaatgcatcggtctcattctcacagaatgtggtgtacttgtgaggtatacatcctggtgagcatttactcatgtctgtgtgcccacgtccctgtacaagaacacaatacagcatcctcttcaggcatcaggtgctccttccaaacttaactgcatccaaactaggtcctcatgaattaaaggacactacaatagagtgaaaaactgcaacatacagaataatagaaaatatttgcaaattacacatctttttcttttcttttcttttttttctttttctttttttttttttttttttgagacagggtttctctgtatagtcctggctgtcctggaactcactctgtagaccaggctggcctcgaactcagaaatccgcctgcctctgcctcccgagtgctgggattaaaggcgtgcaccaccacgcccagccaaattacacatcttattaggacagagttctatcaaaaaaactcctttaactcaataataaaacagaattcaaaaatggacaaagctgccgggtggtggtggcacacacctttaatcccagcacttgggaggcagaggcgggcagatttctgagtttgaggcaagcctggtctacagagtgagatccaggacagccaggactacacagagaaaccctgtctcgaaaaacaaacaaacaaaaaaagtggacaaaaccgtatctctgcaaaagacatagatagtaatggtaacaggcacaagaaactgttctgtactactggtagcccatcaggaaaggacatcagagccctgtgctaagcaccgcatgctggattagatggctagattcaaatcagacagtgagatatagagacacagggacccttctactttgccaggtgtgtgtgggggacataaaataatgattgcacaatgtacaaatagataggtgcttctgagctgtgtatttgataaatagggtcaagacatgtttttctgagacagtttctttctttttctttttttcttttgtttttcgagacagtcctataatttgctctgtatacctggtgtcctcaaactcacagagatccacctgcttctgcctcccaagcactgacattacaggcatgcaccactaatgcccagttgagacacggttttctatgaagtctagctggcctggatcttgttacatagctggcttgaatttgtagcaatcctcctgcccctgactcctctatttccatgacatacagtacgggtactgcacgcacacccacaggactgacagcagctatgcctctttccccacctttccctacgctcccctggaaggagttcaactgcaacttccaagcagagcttgtgaggacactattgcagtggttttatttttatttgattgattaattaattaattgattgattgattcattcattcattcgaggcagggcctcactatgtcgctctggatggaactcactctgtagaccaggttgtccttggactaaagagatctttcattagagctccgcctgcctctacttcccaaatgctggggttaaagatgcgcaccaccacactttatactgatttttgattggcttctctgagaaaagatcagcaggacctgcagcatagccttccttgactatgacctagactccccagtcctatccccaggaaagcaactgcctgtctaccaagctacccctagatggtgctgtggccccaggcctgccgagagcagaagctgcaacagaacaatggatgcctgggaagaaccttcagagagacctcaatcactaacacctgtcaccaacagtcatcaactatgttgatgagcctgtcactgttctcagttgggtctgaggtggtccctgccactgacccagcagactgtgtgacactcacaggctcccctagtcaacatacctttcttttagaatgaagtacatttatgaatcacctacaggagtcctagcaccaggagggcctggagaggagctgaccctgaaggtggagggagcagggcctgctctgtggccactggcctgctccataaacatctagctgttccttgttcaggtaggaaatataagacacagccatgagctagccagtgaatcagcctctccattaggtttaaacattcagcagtgttttaaataatgggagcccagagcagagcacaggagtaacacacgatttgcatatacaaggccggtttcatttctagtacccctcccccaaaagggtgggaattttattcaaaataagtcagtgatctgggcatggtggcacacacctttaatcccagcattctggaaacagaggcaagcagagctctaggttcatgaccagcctggtctatataattccagaacaaccacgactacacagagagaccctgtctcaaaaaagcaaaataaacaaaacagaaatcagctatcaagaaccagtgtgacggggctggagagttggctcagtggttaagagcactgactgctcttccagaggtactgagttcaattcccagcaaccacatggtggctcacagccatctattgtgagatctgatgcctgttctggcacataggcatacatgcagatagagcactcatataaagtaaatacatcttaaaaaaaaaaacaaaaacaaaacaacagtgtgatggcacatgcttgtacacaatctccagtgagtccaaaggcagcctgagctacagtatgggtccagctatatgcccagctatgtccaacttttttctcaaaaagaaagaaacagtcgctgggcatggtggcatatgcttttaatcccaacacttgggaggcagaggcaggcagatttctgagttcgaggccagcctggtctacagagtgagttccaggacagccagggctacacagagaaaccctgtctcgaaaaaccaaaagaaagaaagaaagaaagaaagaaggaaggaaggaaaggaaggaaggaaggaaggaaggaaggaaggaaggaaggaaggaagaaagaaagaaagaaaggaagaaagagaaacaaagaaagaaagaaagtcagtcagtcagtcagtctagctatgtggagctgcataactaccagggaacctgcattacactaacccacagatggagccagactttcagctctcccgccagagagcacaagtactgcctggcagacatgggctcgaggtcacaggggtcacagcagtggctttgcatcagtgccttccagcagttccctttcttttttttaagttgggaagtgaaagctttgtctcctcaccctagaaagcatctttacctagacttctagtcttccagcctggctgagcttcaacccaaggccatttgagaaattgagtccccagagcttcacccagaagcttctgggcctttctccccaacaggactgattgcttttagtgtcttagtgctcagttcagtgaggaggacccactaggtccactgctcatcacacagctctgaaggggctccacaccaagcaaccatagcgagcaaagtccagtaggagtgagtgctcgggggtctgatgacagttctcattaacgtgttaagccaagatagcagagaaagagcccttggcttagcaggttctaagaggagcaattatcccaagcttgagggtaagtaggccctgagaaggaggagcacagatgcggaggaatgcgctggaggaggcagagcagtgacctggaaggagtctaaaccagacccaagggagacagcaggcatgtggggcccagtctggcagagccaccggcaagctcaggtctgaacatcactctcacgggtcggcggtgtcggccgccaggacgccatccacactaactctctttcaacatcattcattttcccttctgtctaaaaatatttttcttttttaatcagctaagacaagcccccaaagaggaccagctgtccccctcaggccccagatcatctgctgagccagccactacccactggatctgaaagcctcacctaatagcttagatccatcctcacaggcctcttgcccatttgaacagagcaaagtgctgcccctgatagatctgaacacaattcttaatttcatgggatacatactgaacagaaactgaggcaaggaggtcagaatacttgctctactcacaagaataaaaccattggctgaggtcctggctcggtctaccattcaagtcaagcattttgttcaagtttgtatgagaccagatctcacaaagctacccttgacccctgcccagtgccctgcaactcccaaccttttcctctaactgagctcagggtgtctcctctgcttagagaaggctgtgacctctgtactccgtgctttcatctgctcaccttgctctacgtgctcagatcctgtccttcctgacctgtgctggccagactgactgctaaggtaacagtccagctttcttatctttccccatcagtcttgcctgtatattctattttctgggagatttgcttcattttattttccagccttttccacaatttccattgatctgcaatttttagaagctctttgggggtctagatataccacccaccgggcaggaagctggtctttgttctcagaggtgtggtgagatgtctggagctccctggagctcgcagggtcctcttctaactacttacatcttttttcacacattgatgagtttggttgtccctctgacccctatgaaaacccctgagacactgcgacggctctgtgactctggcttgtggaggagcttctgtgctgtgggtgtctctggaacgaacttccttccttccttccttccttccttccttccttccttccttcctccctcttcctcttcctcctccttcttcttcccctctctctctctctctctctctctctctctctctctctctctctctctctctctttcagttttttcgagacagggtttctctctatagctctggctgtcctggaactcactttgtagaccaggctggcttcgaactcagaaatccacctgcctctgcctcccgagtgctgggattaaaggcgttcgccactactgcccggctctggaacttttcttaaactgacagttgcacaatgaagaccagacacttgcttcaggatcctgtctgccattgctggagccagggggtgccaagtccctctactcagaatgaacttcggctaagaggactctgttattagttccttgcttctctccaccctcatgcacccggtggtgtctggtgtccatgactctattctctaagagaataagcctcctgtgtcccctggtagagagggactttgacatgccagtctctgggcacctgctctgagttcaacagtatccttgtgacccaccctcctcacccaattacggctgcatatcctgcttcctaacccagcagcctcttgtcttacagatctatgactaatgttggggatgaggggtggagcatgagcatgtcatagcatgcacatggaggtaagaagacaacatgggggagtcagttctcgccgtcaaccatatgagttctacagatcaaattcaggttgtcaggtttagtggtaccccacttgctgagccatctggctagtcccagatttatgtgtttattccaagacactttactattacttaggaggcaattctcaggagagtggcaactcatttaacagcagcgtttctaaggcacaccagtcattgttctcaggtactgaaggggcataagccatcacccaactgctgcctggaccatgcactccagtggtgactggaggccaggaggtaggctcagtggggagacgtgtctgacagcctgtgtcaacgtggaaggggagaactgattccacaaagctgttctctgacctccacgtatgtgctgtgtggcacgtgtgcccatacccacaaattaacaataagtaaagtttaaaaattttaaattaaacacacctttaatcccagcacttggaggcagaggcaggtgcctctatgagttcaaggccaacctgatctatacagtgagttctaggctagccagggctacacagtgagaccctatctccaaacaaaacagaagaggaaggagaatgaatgaatgaatgaatgaatgagtaaataaatgtgtagagcaatccaggtaagactttttttgtttttgtttttgtttttttgagacagggtttctctgtgtagccctggctgtcctggaactcactctgtagacaaggctggcctcgaactcagaaatccacctgcctctgcctcccgagtgctgggattaaaggtgtgcgccactactgcccggctcaggtaagacatttgatgtccacctctggcatatacatatgaatgtacacatatgcacatattactaacacaaacacatacattgcccacaaagattctaaacattcccttgagggcatgtggcccagcaatttggctaggctgttaagccaaggagcttcaggaatccacctgtcttggctgccctgactcccctacccccagttctggagttaaaggcctatgctgccatacctgtctttttatgtggattttcaagatccaaacttaggtcttcatgtttgtgtagtaggccttaacctacagagccatctccccagtccttggggaggacatgggggcaaagtcaccactatcctaacatgactgttctgaagcttggggaatgtactgatgcccacaaccaggcaagtgcctggctaggctgccctcctcttcctcttcctcttcttcttcctccccctcccccccctcctcctttctgagacagggtcttactatatagcccaggctagctttaaacacttcatcctcctacctcaatggcaggcatgtgccaccacacttgactctaggtgactattcacacagctaagactgctacaatctgaaccaaggcaaaactgcacgtacgtcagtcctgtctgtcatgacactgccttacagacacagaagaacaatcctgttttcttaggattttaccaagagttgctagccatgctgggaaaggtcattctgcccctgtaaccctagcacagacctgcttcacctgccccccctcaggcctgtaacaactggaccttagtacttaattttaataactgctttcttcaccaactgcccttttctttgtgaactcttttgtttgtttggtttggcttttcaagacaggtttctctgtatattcctggctgtcctgaaactcgcttgaagaccaggctggcctcaaactcagtgatctgccagcctctgcctcccacatgtggcaattcaggaactgttctgtacatctgtatttaggaacagttaagcacaagagtacacaatgcactgtttgaatattgtttcttttcaacatagtaaatgagatactacaaagcacggttgaggagcagccctgggccaggtggaactgagggccacatctatgtgttctagcgtatagtgaggtcctgagcctcccaaatcccattcccccacagttggtctatgtccagcccttcaggatggctgaggataaatggaaacaagtgtcagtcctgggcttggaggtgtgaagtctgtttcaggagtccagataaacagtagactgaaattacctggctgctgacccagttgcttctcaaagggttacttcatatacttcatataagaaagccatacaagaggaagcaggcaaaaccaagtcaccaattggacaagtgatatatgcctatacagtaatcctagtaacagcccagccaggaactactgggaattctaggccagcctggctacacagtgagacactatcttgaaaaaccaaacaaaacaaaaaaggggctggagacatggctcatgagttaaaagcactggctgttcttctggaggacctgggttctgcacaccaggatagctcacagcagggtgtaaacccagttccagagaggccgaacaccctcttttggcctttagaggaactgcacacacatagtacacattcattcaggcaaaacatctagacacatgcaattttttttttttttatttaaagtaagtcactaaagtgtcaaatatctgtaatgagacaattttaaatagtgatgtgtaggtttgatcttgttcttggagaccattgcccaggacctgtaaaacactgaagactcacagcagaaggcaaggtactgtgaacagtttctgggtgacacagctgctggccatgggatggccatctgagtatcgttcctctgctcacacagccagtctgtcaagaacaaccttcagcaagcagccactgtcctgcagggtataatcacctgacacatcaaagcaaactggaagtcacatcgttgacccccgtttgcttccactgccatcagtaagaaaggtaagcttgtgtgaactggattcacccccaggaaatcacagaatgctcaggaggaacaatgtacggaaaagagaaagctaagaactctggtgcctgtgtggttctgactgggtcacacggcttcacttcattgttccacaggagcagagattggccagagtgaagaagagccactccattatgcactgctggctggcagctccaacctgagagtcccagctagggtgtgaggtgggttactctcccacacatctgggccagatttaatgtagtcatatgaagtgagcataccagtgcaagggccccgcaggcaatgtatgtgtgctgtcttcttctgtcacagcagcagaagaatatggatgcacacatataaatattttatatatattttaaatttttgagttgtgaaaattaacaatttcattatattttcacactcaatattgtaatatttcacttttcagattataagattcaaatccttatggagaaatggtcatactaaacttgtagttatctagtttccaatttggcaaaaagccacaagacctacaagactcatgacaagctgccacagagtggtggtgcacgcctttgattctcccagtgcttgtgaggcagaggcagccagatctctgagttcgagaccagcctggcctacagaatgagttccaggacagccaggggtgcacagagaaaccctgtttggcaaaacacattcattctcattctcattctctccccccccccaaaaaaatcagtcattaaaattatcacaaaagggctggtgagatggctcagtggataaataagagccccgactgctcttccaaaggtccggagttcaaatcccagcaaccacatggtggctcacaaccatctgtaacaagatctgacgccctcttctagagtgtctgaagacagctagagtgtacttacatataataaataaataaatcttaaaaaaaattacatttcttccgccttccgtgtctgtggccctcgcagaacttccagcagcgacatgttgggccagagtatccggaggttcaccacctccgtggtccgtcgcagccactatgaggagggtccggggaagaatttgccattttcagtggaaaacaagtggcagttgctggctatgatgaccgtgtactttggatctgggtttgccgcacctttctttatagtaagacaccagctacttaaaaaataaggatatttaattcatccctttaacagaatgaagaaagtttaagagatgatctgaaaattggattaaactcttgaactcttatactagaaaaaattgtaaataaactaatgacataaaaaaaattatcacaaaaaagacatttgttttttagttgttatttggttggttgggtttttggtccccaccaccaccacctgccccaatggcacacagattttttttttccacttaaagcaaatttagctaggaataatggctcatgcatgtaaaatacagcacttaggaggttgaggccacaggatgacaattttgaggccagcctaggttacacagtaagaacttataaagcacacaaaagcacaaaagcaaattcattggacaaggactaggacttatgaaaatatgttgtcagaagagttcccaaggattaagcatcctaactactggtgtcttcacggggcaaaagggacacaacagctgggattgaggtccaatacagtaccgtcctgacactgaagactgccctagatctcctggatgggcttcattacatacaagactacctagaagccttatatagctgatttagggagaaaaggaatgatcaaaacctgagaggggcttgacccacccttgctagctctgaagatggaggaagggtgccctctataacttagaaatcagaaaaagacagaaactttagtcttacaagcataaagaacccaattctgctaataacccagtgagcaatgtaatgaaacctccagaacttgcccatcaatgctagctgccaacagcttagcttttgttttgtgtgtgtgtgtgtgtgtgtgtgtgtgtgtgtgtgttgtgttcagtaagtactttcttaccaaggcacactccattccccgacaacacactgatttcagctgatggggtagggtagccctgttgtgacctccagctgggtaggatagtgttacagcagaaagaagagctatagctgcataacaattagtaatggcaactcagcattgtgcttcataatcaaagtagatacaaactaaaaactacacagtcagagaaggctagatagcataagctgactccacaggataggacctgttctctggcagctgcacagaaacaggaccccagccattagcagggctgaactgaaagcaggatgcagaggaaccaccccctggcggaagaggcactatgggaaattattcagtagtcactctgcaggttaagtccacgcttgacctgtaacccagcacttccctaacagaaacccacacacatggtcaccaaaaccacaaatgaactctatttttactttttaaaattgtgttcgtatatggtatgtacacttgagtgggtacattcagaggccagaggcattggattcccttggagtttatagatggttgtgagacacttaacatgggtactgagaattgaactcgggtcctctggaagagcagtacacattggtttttttctgagacagggtttctctgtgtagctctggctgttctggaacttgctttgtagaccaagctggcttgggagatccacctgtctctgcctcctgagtgcatgtcccgcatggtacacactcttaacaagtgagctaactctccagtcacttgtgaaaattttataggagtactcttcaaaattcaaatatgagaactatccagacacttactgtctacagaagagacaggcttgccgggcatggtagcgcacgcctttaatcccagcactcgggaggcagaggcaggcagatttctgagttcaaggccagcctggtctacaaagtgagttccaggacagccagggctacacagagaaaccctgtctcaaaaaacaaaacaaaacaaaacacccaaaacccacaaaaacacaaaaactagtccatagtaacgtcaggactgaccagcaattgctagggctggaggcatggggctgcacatggttctggtccatcaacactcaacaaatttttctgtatgcaaatttacctcagtgaagttgactaggaaataaagaagctgacatcgtcgaatgctggaccagagcttacatgtattggtaatgagaacagactgccatgaactgtcagttgctctaaaatgacctacctgcaaccccaaataaagacaatattcacttctaggcatctatccaagggaaccaaaacattctcacaaaggatctatgtgctgtggttgtacttaatacctttaaattcagaatgaaagacagctcagatgcatatagcagaaaaatggataaacaaacgggtgttctcacataaaacactactactcaggggcagaagctcctctgaagggatcagaagagcaagcaagcattgtggagtctgagacagaagcactgtaagtttgaggccagcctaactacaaaatggaatgctgttgttttttgtttgtttgaatatgtttagaaacacattccatttgtggcattctggagcaggaaaagaaacctgtcgtggcctgcagactggtaggagcagtaactaacctctcattgacaggagatgactttctgaatacagacactgtgtcttgacacagggaatggctaccctgatgtctacatccaccacagctcctagagcagtggctctcaaccttcctaacgtgtggtggccctcagccataaaattatctcattgccatttcataacagtaattttactgctgttatgaattgtaatgtaaatatttttggagatagagttttgtcaaaggggccttaacccacaggttgtgaaccactccaagattagtacattttattaaatgtaaactcaaatatctcaataaaatcaaattaagagctggcctagtgggcaagtctttaatttcacaactcaagagatctcaatggaactacctacagagtgagttgcaggccagccaggactacacagtgagagactctggctcaaacagacaaacaaaagaaaagagagagggaaagggaggggaggcagagaggagaaagaaaaaccaaattaaaaaaaaaatttaacccagccaggcagtggtggcacacatctttaatcccagcacttgggaggcagaggcaggcagatttctaagttcgaggccagcctggtctacacaatgagttccaggatagccagggttacacagagaaaccctgccttgaaaaaccagaaagaaagaaagaaagaaagaaagaaagaaaggaaggaaggaaggaaggaaggaaggaaggaaaattaagcccaaagctgggtgtcgtagtgcacaccttcaatcccagcactcaggaggcagaggcaggaaaacttctgtgggttcaatgccagcctgatctataaagcaagttttagaacagctgggactgttacacagagaaaccatgcctggggagggcgggggcagggaattacacccatataggatatcaatttgcctttaaattaggtctcctttcaaacgagaggactgaactgtctgccacgatggcagaatgcagagcagaaacagacagagcagctagcacacagagcctgactacagaggaaggaacctgctgtaccgaggaaaggggacactcagcacgggcaacacctcagaaacagggacatgtgcatctgctgtcacaggcaaaccaatgcctgcacaagtacaggacaggaggaagatgctaatagacacagagatgctacgccaacgccaacgccaacgccagacagcagaagtcacgccaggggagtcgtatacagggactccttggtgtcaaaacttttacttactgttctagagccaacagcaaagcatatctcttctgtctactgagagcaagcacactcggcatggaagctcggggagatccagcttctgtctactgagagcaagcacactcggcatggaagctcggggagatccaggacactcagaacccggagagtcaccactaacttttcattaaatgtgctttttcatttcacatctgcatattatatagtcataattagctcactagatctctgatctctaagttccacatccacagatttaacaactgcaaaaaagtactaaaagaaaaatttccaggacagccagaactctacacagaaaccatgtctcgaaaaaacaaaaaacaaaacaaatattcatttgtactgaacacatgtagctcttttttgttttcttaaaaatagtttttgttttgttttctgttattttgttgttattttttaaacagtctcactgggtagttctggaacttgatatgtagaccaggctggcctcaaactcataagaagagatccaccagcatctgcctcctgagtgctgggattaaagctgtgtgtcaccgtagctgggccagacatttatttatttatgtatttatttatttatttatttatttattatatgcaagtacactgtagtgtgtcttcagacactccagaagagagcatcaaatttcgttatggatggttgtgagccaccatgtggttgctgggatttgaactcaggacctttggaagagcagttggtgctcttaaccactgagacagctcaccagcccctgggtcagacttttaaagatttatctgtgatacctgcatgtatgtctgtgtgctgggtgtgggcaggcctgtcgaagtcagaaaagtgctggatcttctgaagttatagttacagatggtgtgagccaccatgtgaaccttgtgcaagagcgacaagtgctgctaactgcttagccatctcctcaaccctcatatttggacttaaaaaaacattattatatgtgagtgtgtatatgattatctgtggcagagggagggaggcaagaaagccagagcatgtgtcctggaggccagtcagagaacaactctatggagtcagttatcttgttccacttttaagtggttttgagggactgcacccaggtcaccaggcttgcgaaacaagcaccattacctgctgagctgtcttgccagcccatgattttttttttagtatcattatttcttcagcaatatagattttatcgttatttttcagcaatatgaattgtttactactttttgagacagggtttctctgtgtagccttggctgttctagaactcactctgtagaccaggttgaccttaaactcagagatctgcttgcctccacctcctaagtacaggataaagacattcaccactatgcctggcttctttctttttgtttttgacagagtcattctatgtagccctagctatcctggaactttctatgtagaccaagctggcctacaactcgcagagcttgcctctgcctcctgagtgctgggatgaagggtgtgggccaatactcctggctgtgtgccattttatataagggatttgagcatctatggatctggacatctgacaggctcctgatattactctctgatggacacccacaggtgattgcatccccctccacttaagcaggtgttagggaccacgcacgatgttacagtgagtgtccattagctgttcctctgagaaggaacaggcacaggctgcacagtttaagtacagtacaagtacaagtacaccatgttgccatggagggactaggctatttattttccacttttatttaaaaatgaaaagtcttggttccctttattgtatctatcatctctgtagggcagaatcctaattacttggtgaagaagaaggatttctaggatgctgatacacagctgcctttaaaaggcgtacacccacatacctctgttctgtgagtcactgctttagtcttatgggtaagtgcacccttccagctgagtttaaggttccacctcttctacccctctattcttctctgtacaatggacacgtggacctgaacagctgacctggaacaggaaaatacttccaatgaccaaactgttctatccaggaagctgctgtgggggctaacacagatctgagacatacctgagtgcatgtacactctcattttggctcctaggagttccaagacctttcccagtgtgtgggagcctgtgtaagaaagctgtgaacttactgtgaactaagatggggaaggatgcacatgttgtaccacaaggtggccttccagagagaatggcatcaactatgacaagtgaatgcagttgagagcagggacatgaaggggatgccacggagcactgaggagcccgggcaaaggcacatcgtctctgtgggaaaggcagaggcctgacgatgaatattcgtggctcttttcacatgagcaaagatgaggacacacaacaccaggtgtattccctcgctattcttgtgtttgcttaagctaactgtaaatgtcactcatgctttacttgcttcaataatacaattgagaagtactttgttgggccgggcatggtgacgcacgcctttaatcccagcactcgggaggcagaggcaggcagatttctgagttcgaggccagcctggtctacagagtgagttccaggacagccagggctatacagagaaaccctgtctcgaaaaaccaaaaaaatactttgtttaatatactcttgaactcaaaagcctaatgtcccttggttcccccacatgggtctttagaatatatcctctgatccttgagatttagcctcactgaccacagggcaggttgataactgcgttctgaacagttttgctactgaacagatttatttttgcctatttgtaactaatttgatgcctttaataaaagcctaggcagacaaagttgtcaaatttttttcatgtcacatcagaaaggatggataacttttttttttgttttttgtttttgtttgtttgtttgtttcaagacagggtttctctgtatagccctggctgtcctggaactcactttgtagaccaggctggcctcgaactcagaaatccacctgcctctgcctccccagtgctgggattaaaggcgtgcaccaccaccgctcggcaggatggataacttctaaagcgagctgttttctaggacaggttgcttttgtttgtttggctttgtattttgttgtggtttttctatgtgagcccaggctgtcctggaactcgctcacagaccaggctggcctcaaactcacaaagatctacctgcctctgcctcttgagtgctgtgctaccactacccagctttttattttattttattttattttattttattttattttgagcagggtaacctggctagcctgggacttactatttagggaccaggctagccccaaaatgcctctgtcctagaagtgctgaaactacaggcatgtgctagttgatcatggtgatgcacacctttaatcttagcactcgagagacagaggcaagcggaggagtttcaggctagttagggcaacagaatgagaccttgtctcaaaaacaaagcaaaactacaacaacaacaacaacaacaacaacaggcaaagcaaacagtttcagaggttaagagcactgaaggttgcttttccaaatgagccaggttcaattcccagcacctacacagggttgttcacaaccgtctgtaatttcagttgtaggggatccaacacccttttctggccttcacagatactacatggatgtgatgaatagacatacatgcagataaaacacacatacacatgagataacaataaagacaagaatttattttttaatttttttattttttatttttttcaagacagagtttttctatgtaaacctggctggctgtcctgatcactaacacactggcctcgaactcagagatctgcctgcctctgcctcctcagtgctgggactaaaggcgtgagctgccaccaccagttaaaaacatttttttttaaaagacatgtaacgggctggtgagatggctcagtgggtaagagcacccgactgctcttccaaaggttccgagttcaaatcccagcaaccacatggtggctcacaaccatccgtaacgagatctgactctcttctgaagtgtctgaagacagttacagtgtacttacatataaccaataaataaatctaaaaaaaaaaaaaaaaaaaaaaaaagacatgtaacaatggcgcaagcctttaattctgcctctggaggcagaggtaggcagatctaatgagtttacagccagctctaggacagccagggctccagagctacataatgagactatgtcttggaaaaaaaaaaaaaaagaaagaaagaaaggcatatgtaccatacctggtgaatgtgtccatatatcattatattatccatataacatataaatatgaaaagaacaatcaggttgtatgttaggcctagtatcacacaactgtaaccccagtaccagggacactgaggaaggagtactgtgatttcgaggccaacctaggctacatactgaatctaaggccagcccaggctacatatcaagatcctgtctctaaaacaacaaagtttccaacgctgagagttgggttttattgtttatgtgtgtgttgatgctggtacacaaaggctaagtactggctgccccagagttggagcacacacagttgtgagctacctgatttgtacactgagaactgaacttggcttttctagggatgagcactcctaaccactgagccatctctccagtttcatgattctatgagttctaaatgccaatccagccccacacacatgtggaaggtgctgtctcccatataagcagtaagtaaatgtttattaacaatgagaattgtaaagaaagacaccttcccacaaagcctcaactcaaggtccagaaatactacaagctacaggcgctggagagatggctcagggttaagggcactgactgctcttccagaggtcatgagtttaattcccagcaaccacatggtagctcacaaccatgcacaactgtaatccccacagggtcccatgctctcttctggtgtgtaaacatatataaaagcaaaatatacatatacataacataaacaaatattttttttaaaaaaatgctacaggcttctgcctggggttatagcccttatgttcacacaggcaacactctcagcattacacacttgcttatggtgaactatgtgtttaactacctgcaataaacttaggcatcaaagtccttccagaaggttcatggaataaggtcttcaaatggacattagattttaccttgccatttctatgctttgtactgtatttgctgttacgaacatgtagtatttttttctaagtattctctacttaataaaattcatctaggaaagtagcataagctagctgtagttgcacaagcccataaccccagcatttgggatgtggaagtcataccaactgggaaccaagagctcaaggccaaacatggtagcacaggcttttaatccccagcatttaggaggcagaggcaacatctctgtgagttcaaggccagcctggtctataaagctagttccaggacttccaggctgttacatagagaaaccctaactggaaaaaacaacaaaaagcattcaaggccacttttatcagtgctacatgaacctttgtaaaaggcatactacctgtccccagagaagaaaaaccaggctctctgaagaaactagtcagttccagactaagcaaggtcagcacatatcttaaacatcaactgccaaagcagaagatggtcagcctctcaggatatggcgcagaactgcctgaagaggcttcatatgcagcacgatatgtgagcaccaccagcaagacggcagtgagggatacagggtgggaaccagtggatgcgggagacactgaagaatccagaatggaccaccattcaatgtcttcccttctgcagggttctactgttcctggccctgctcagccagaggatgcttcagggacacaaagactcatagcctaggcaagactgctgactcaccctctttgaacaaagtgttggcatggggcagggcagggcaggcaggcagcctgggcagtgacctagttcccttggtcgtgcttcactcttaggcagagattttctgaacctaaagaagaggccctcagcaaccctggtaagtgtcactgcacctgttcagtacctcacacgggcttcaagcaccttgaaccctgatccatttaccctaataactaggtcttatgcagattcaaatggttaatagtgtgcacagctgaaaggcaccaggtccacttcagctacagctcccaagctaacccacataccctcacctcactggctcagagcttctggcacttggctgtcaactcttcgaaatgcttcacaaattatgagattacctgtgcctgtccagtactcagttcttctatcctctgcttttcctagatgctggcatggatagccctctcaggacagagatgtccttcactgaagttgttcaagcacttgttataaaccccacctgaaagccctgtctatctctcttgcctctatgccctctgcaggcctggaccctttgagtacttcgcgtcttgcctcctcttcccagctgtattggctagttttgtgtcaacttgacacagctggagttatcacagagaaaggagcttcagttgaggaaatgcctccatgagatccaactgtaaggcattttctcaattagtgatcaagggggcaaggccccttgtgggtgggaccatctctgggctggttgtcttgggttctataagagagcaggctgagccgggcgtggtggcacacgcctttaatcccagcactcgggaggcagaggcaggtggatttctgagttcaaggccagcctggtctacaaagtgagttccaggacagccagggctatagagaaaccctgtctcgaaaaaccacaaaaaaaaaaaaaaaaaaaaaaaaaaaaaagagagcaggctgagcaagccagaaaagaacatccctccatggcctctgcatcagctcctgctttctgacctgcttgagttccagtcctgcatcctttggtgatcaacagcagtatggaaatgtaagccgaataaaccctttcctccccaacttgcttcttggtcatgatgtttgtgcaggaatagaaaccctgactaagacaccagcagacagttatttcatgtgtctgcgccactgtgcctgcatgtgtgtatgtgcaccacttgcagacttggtgtcctcagacatcaaaaggaggaaatcggaaccggagttatagacgactgagcctccttgtaggtgctggaaagtaaactagggttctctgcaagaacaagtgttcttaactgttctccagcgctgtccccacccccagcttccagatttaaatgtctggcaccttgacaggcaggtagtgttctacttcagttcatctggtgtgtgccccactgcttgtcaggttcgcctttctctactattcccatccttctactttctgaaggacaaatgtgtaaagatatatgctgtgttcgggatcctggttttagcaaaagagccacagacatgagaatcacccgtcactacacggactcagagggactacttttccacctacctcccacgcaagcacagtctcctagacaccgtccttggcccagtcagcctctctgtggatgctccgcccccgccaacctcatactgctggtccccaacacctgctttactggcatgtagctaatcagcctggccacctacctcccgttccttgtcttcttcaggtttctctcaaccagcatgctaaatgctaaaggctgtttgttccctgcattcttagatagcagagacgttctggtcaatgtacaactccacagcttcctgttaaatgtgtcctagtttcaggctccacacctcagtgaggcagctttgtagggatcaagcaattttatacctttccagttatcatcttcaaaaagaacaggcagcaaaaggacctgccaagggccagttccctcccttcatgtccttcccaccccctgctcagctcctgatactgcttccttcctgaaatgctgctgttaaatttagatcacccccaagccacaaacaatcacgctgatggaaaagatgacattatctatgcaacttaacaatcccaagtgtgaccacacaatcctcccagaaagctgacagtcttgctgggcttgccatctgagcctttgctatgtcacttggtattgtttatactaccaaaaacaaatattctagttaaatgtggtaatcttactacttggggagcagaggcagaagcaggaggatcactttaagttcatggccagcctggtctaaatattgagttctaggccagtcagagttatataatgagaccttgtcccaaaaagtctgtaaaagcaaactgtcctctaatcggctctggcttgtagcctgcacttctggccggcaggtgggatgcacttaagacatccacaaatacatgactgaacagatgaatgaaatgctgagggtgaggtgcaggcactgtgagaaagacggacctagtcagagccaacaaacagaaggtaaccaacccccagagggtggcttacatgcccaggcacaataggaaccaatgtccaggtgaatgcttctctgggaatggagcagacaagccagcatttgcagggcccgtgtcaaactataatggcctgtcaagaagtaacaaggatgatatggcttttcagaaaatagctgggtcaggtaggagctgggacagatctcctaaggtgcggatagcgaatcaagtgtacagaagcagcgagtgtctagcaaccctacacctactgagggttaagagagtaaaaccaggaagtgccactgctgcactgtttgaagtctgcctagctccctctcaatgaaggctagaacagagccacccaggaccccagtgaccataccacccaggctctctgagcctcttccatgataggaatcatgggtactggtgaagattaaatgacgaatagatacgcactcagcaacatgcttggaacaaaccacacactggaggaattagctgttaccacagtggccattcctgttcctcctggagccaacaatttgccagaaaacctggcatctaacatagggaaagccaacagaatcctccaataaattaccccacagtatatacagtaaaattgagacctaagtgcctggcttcagatagagtagagaaaggaatgtgaagagttaccatagtgatcatgtggactagcaccaagggaagctgtatagaggcctttcattcactcagaaatatacatttagatcaggcacagtggatctggagttctagactagggaggccaaggcaggaggataacaagtacagtttaggtatacagcaagaccctgtctcaaaagcatatgactaaaaaaagggggtctaggcaagactcgtgatagtgctggagataatgcaatgattgagacatatggagtgtatgatttaaagacaggtccaataatggaaaatacatgcaaaagtgggttttaagtttcccttgagccgggcgatggtggcacacacctttaatcccagcactcaggaagcagaggcaagcggattttttgagttcgaggacagcctggtctacagagtgagttccaagagagccagggctacacagaaaaaccctgtctcggaaaaaaaaatttttttcccttgagtggggctggaaagtttgctcagcaattaagagtaccgttgctcttgaggaagacctaggtttgagtcccagcacccacatggtatctcacaactgtctattataactgcataaggacatctgatgcccttgtttggtaccaggtctggcacatggtacacagacatacactcaggcaaaataccaatgtggtacctgctccttagacctgttctgagttcaatccctaaatgctccacaagggtgagagagaaaaccaactcccaaagctgtctttttttccccttatttacttatgttttttttctttctttctttcttttttttggtttttcgaaacagggtttctctgtgtagccctggttgtcctggaactcactgtctagaccaggctagccttgaactcagaaatctgcctgcctctgcctcccaagtgctgggattaaaggcgtgcaccaccacacagctctatttaggtatttttgagacagagaatcactatgtaactctgactatcctaaaactcactgtgtagaccaggctggctagaactcaagagatccacctgcctctgcctcctaagtactgggattaaagatgtgtgccaccatgtccggtaaaaagctgtcttttgacctctgtatgaggacatacacacaccattaataaataaagtacttaaaaactccccctggctgggcagtgatggtgcatgcctttaataccagcacttggaaggcagaggcaggcagatttctgagttcaaggctagcctggtctacagagtgagttccaggacaaccagggctacacagagaaaccctgtctcaaaaagccaaaacataaataaaaaaataaaaataaaaaactccccctgactctgtcacttagagaaatggaattcaaccccaatgagaggcagcatggagtaagattcccataaatggtgttgaccagtgggtcactaatctgacaccacagccctgcctgtagcagggtcttcacagcatgctgggacacaggcacattatcctcactctctcaggtgaatgcatcatctgatgccacagacatctctgtaaccatcaaatcccaacattctcggcaatgcccatcgtcagcatcactccacagcttccttcataaacactaactcccaaaggaacagagaaatgaaggagcacccatggacccattaacaggccatgagcatataaaccacaatggattttcctgaaggatccaacacttaggagtctttgtatgagctaggacgagatataactgtcttacaatgcccatatcacaaacaaggacagtcttgtgtgctgtagtaataatgtttcctgggttcaagggtaactacccagttggctggcttgaggccaacagggacctatcatcccaatgccacatatcagaaccagaggcaaatttatttgttttatgcttgtgtgtaaaggctgttccccacccccgccacaccccgccctgtcctctcccacagctgagactccacaacgccttttctctggagcataattccaccatgcatgcccagatgaagctctctgaaaatgtcctgttccatccagagaggagatcactgctgctgggcacaatcactgttgtgtcttcaatgccctgatgtttctaactccacagagaccctaaccacaagtatttaaagcaccagaccagaggactcctgcagacgctgggcatgtggccacagtactgtcactgtttcaggtgtcagtgctaatcaaagaaaaaaaaaagtcgttttgatgactcacatgtttgtaaagtcagagagagcgatgttcacacccaaggaacaagctagaccagacgttgagacaggtaaataacccagctgggatcaagaaggagatcaggggccaatatggagcagcagactccttcccaggtggggactaccctgctcagaggagccctggaccttgaaaaaaacctaaaagtgaaaatgaacgttctctttctgttttccagacatggtttctctgggtagtcacggctgtcatggaacttgctctatagaacagactggcctccaactcagaggtctgcctgcctctgctccccagcacagggactaaaggactacaccaccagcacttggctgacatgcagaggatgtttaataatggtgagagaaaggaatcatgcgcttatctacttagagaacgagaagtccagctctttcaaacagtaaatacacactgtgcgcacactccagaaccagctgctttaccactgctaatctcttctctgaggaggcccaatgctctgacccaaaggcctgatatctgtgctgtatgcatgtcaacccagcatgagaaccatgctgttgaggctgtttgcctctgtgcttcacactgctggacccacacgggccgtacagcttgtgcatcgtgaaagcactgggtgggtgaacagtgcccatggtaagtctcacacctctgtactctttatgtgctagtggccccacttcgggtagcacgtcataggaaatctggcaagactccgttgacagaggagaggaggaaagaggatccagcaggaggctgtgtggatatgtggttgaagctgatggggaaaggaagagtggagcagggacaagcagtctctccaaagcacaagttaacactaagcatttctgaagccaagcccagcccttcccacactcccccattggaaaggtaaccccccaaagcctttctgagcagggctgtcaccctgggacgcccagttaaataccagtcaaggctgcctggctgtgcagaggtcttttcacataccctgcaaagtaaaaccatgactcttcctttcctgcgctgaagatgcctgctgtgaactgaagctgagaggtgcttggggaggacttacagagaagatccagcgctactgttcaaaaggaagggtcctccactgatgtcctggcagtcatcacccttgacaagtcctaactgctaagagtggtagatgtcttacctacacactcagctgttatttaccagaccgccagtactcagagcagtaagacagggctaacaagaccccagagaatgaagtaaaaaagcagagtaaaagggactcgggaagcgaccaggaaggtagaattagtccagtgatataagatgacaggcccactgcacattaattcctccggagtcagcagcccctgtgatccaatcccacccactgttagctacgattttaccttaaatatctaaattaagaggcaagctcaggcaagtgccagtgatgcaatctaccttgtgtattttttgccatgcacccggaagttaacaaaaatcacatcgcagcagacctattttctccctgcacagggtgcggtgtctctgagcaaacccctccggcggcagtgcggtgagcaccgggcccgtcgtgcggtatctgccgcgcggcccattccaggccctaatggactccaaagacctgctgctgtgacttcttagtagccaccaggacccgcgcccgcttgccgacggctcctcaaggcagggccagaggataccgcagcgacacgcgcagaggccgcccgctcccgcgacaggccgctcccacctcgcgcgcccacagccaaccccggcctaccgttgctgtaggcgtacggggattcagctgcgccgtcctgaaggctctccaggatctcgcctttgcccacgtcgctgtcgcccaccagcaggaacttgagcaggtaatcgtagctcttcactggactgccctgggtgcccatcctcccgcccgccgcaccgcggcccacggcaccgccgccagacctgcgggcgaaggctggtgagcggccgtgcggtcaggacgctgatgctcccgcccgctggccaccgcccccagtgcacccgccccgctgccgccagcttcacctcagcctcctagccgccgccgccgccgctgccgccgccgccacccgccgcttcccgcacggcaccgcgcagccccgcagccccgcccccggatgcgccgccgccattggccaccctccgccggccctctccgggccattggcctggcagcctggccgtcacggtcgccccgcccccacgtcgccccacacaaggtgccgcccagcccacggtcgccccgccctgcccactcgccactgctactggcccgctgccaccctctttctcacttctgttggtctacatgcttgtctatcactgaagtcccgtccccgctatttcgtacacagtgttgctgaggctggcgtttttccccgcctcctcgctgtgaccattggctacttcccactgattttccgaaatcattggttgctcttgcatgtccatcccaacccctactgcttcctgcaggatgcctcagagccatagtagccgggcaccgacctgcaacatcctggcctcccgccccctcgtcatcaccattggctactactgctaaggcatttgtgccatctaacatcgatcataacctcctaggcccacccctttcctaattcgggccaatcaagagtcaaacattacacaagtctacccttcccccctcgtggacaagcggaagggtagagataactcctgcttcagctgagtcccgggaggagggtgttggaagggggcaggttatctatcaagctgcgttggccggccgctctcacagagacccagaagggaagtaacaaagttcgtcgtacactgtggggctcgccttccctgagggcagggcggggacagccacttagtgttcgccctggaggggcaagcctctctcccttgtgggctgttccaaggggtgggacttcctcctggctgcggagtgggcggggccgctactgagtgttttggcacaaggatggcggctgaagtccacctctgagctgtctcttgtgggggacatccttcccaaagcggatcctgagggcttggaccagcgactgagcagcgttggcccggtgaactccaggatgggcaacgcattgcatgtgcacactcggtcggccagctccaaggctggagggccacggacagcgttcttggttaagagtgcattcacaagtcacataaatagcaaaaaatttaaaacgtaaaacataagccgggcgtggtggcgctcgcctttaattccagcactcggaaggcagaggcaggcgaatttctgagttcgaagccagcctggtctacagggtgagttccaggacagccagggctatacagagaaaccctgtctcaaaaacccaaaaccaaaccaaaccaaacaaaaaacaaaaaaaaccgtaaacatagattgggaccaacgctcttgcactgtaagcctaacagtatgagttcgatctccctccggtgactgaccatctgtaatctccatctagctccggctcctataataagaaagaaaggaagtaaagataggagaatttgtccagcagttcaagagctacctggcctggtgtaagcccattttaacagggggaaaggctgcaatgacttctgaaagttatcctctgacctccacatacctccacatgctgcagtcacacatatactgtaccttggaacagtttttacacaaacttcctgaacattgtcagataatagataaagtgtgtgtgtgtgtgtgtgtgtgtgtgtgtgcatgtgtgtgtgcatgtgtgcacgcagaggacccgggttcaattcacacatggcaactcacaactgaattcacacatggcagctcacaactgtctgtaactagttccagatctgacaccctcacacagacaaatgtgcaggcaaaacaccaatgcacatttaaaaacaagtataagaaactgataaaatgagggattggatgaagagttggtttagaagttcagagcactcgttgctctagtagaggatcagggttcagttcccagcaccaacttgttagctcacagtcatgactccagttccaggcagggatctgatgcctacttctaacttctccaggaccaggcacattcttggcacacttacatacatgcaggcaaaacaatgagacacatatatcattagaaaacagatggcaagcaggtgtgttgatatggtgaaaagtattacccataaaaaggtatgaagactggcacaagaatgaattttttaaaggactttatttattatatggaagtacactgttgctgtcttcagacacaccagaagagggcatcgtatcccattacagatggttgtgagccaccaggaggttgctcaggaccttcggaagaacagtcagtgctcttaaccactaaaccatctctccagccccaagaatgaatttggacagggcatgtaaatcccagtactgggaaagcagaggcaggccaatctctgagtttgagaccaacctggtttacaaaatgacagtcaatcagagcttgttacacagaggaaccctgtctcaaaaacaaaatgaaacaaaaaaaccaaaaccaaaaaccccaaaactctgtgatggcagaagtttataagcccagctgcttgggatgttgagacaggaggccaagaaaggataacatcagtgccgactcggtgctgctccttcacatgaccactgaacacaagtctgggcagtgtgccaccagtgatgaggtgcccgctgagcacagatgtgtccacagctgacagctctcctggctgctgggaaggcaaggacctcctcctaagcaggttaggtgggtgacacacgcctatagtcctaatactcgggcaggaggattgccatgagttcaagaccaacttgagctacatgacaaatccaggtttactgaaggtactggatagatggctcagcagttaggaatggttgctgtacttgggcgggattggaatttggctctcagtaccacagcacatgaccacctatacaactccatggtcaggggatccaatgccctcttctgcccatctgagcacctgtactcactcacagtcatgtcaacaatagacaagcagggtgaagctgagttgccatgtgtggtggccacagaacttgagggagctgtgactggacaagcatgtggaaaggccaagaagtccatttgactcacatactgaaaactgtctctttagctgtgtgaccacttcagtgacactattcagttggttttcccagattgtacagaatgggagtcattggacaatccctcaggagaaaacagactgaattaatcaatcagtggatgtcaggttagcacagactgactaatcaattggtggatgtcaagtttgtgtcaggcagttaacaagtctgctgatgctaaaaactaacattaaatgttcaaaggtgaaattagaattcagtaattccaggttatatcccaccagctacttaagaaatgtgaaaaacatacacacacacacaaccagccaggtatggtggctcacacctctaatcccagcacacttgggattctgatgcaagttcaagactgggcctacagaggcccagtctccaagaaagaaagaattaagaaaaaaacctacaaggggtgttttctccaagggactgttagatccaggcctcctctccagcagcaggtacccttccttcattccagcagccccacactaagtgactacctccctcctaagctgaagacagagcctttactgagcgtcttggccctgtgaacactgccacttggtttgacacaatattcaggaaatatttgtgaggggatggtgcctgagaaatggcatcagagctctcctcacctgccttcagggacaggttttcctgctattctcttggtcaagggtgtgtagggtggaggctcctgagtcctggaaggcagaaccaccctaaggccttccaacagaacttctcagctcattctgactctccaaaggatcccagaggtagtacctgtatctttttcttttcttttttttcctggctacattttgtccaggagtggccaatccctgagctctggatcacatagatttcataataagattagttaaaattaattaataataaagtcctgccgggcatggtggcgcacgcctttaatcccagcactcgagaggcagaggcaggcggatttctgagttcgaggccagcctggtctacaaagtgagttccaggacagccagggatatacagagaaaccctgtcttgaaaaacgaaaaaaaaaaaaaaaaaaagtcctgatcctcagctaatgagtagttgagaacagagtcctggagggccacaacctggttaccagggagatcctcccttatagaggccactctgcccagacacgtgagctttgcctctgttctgatagctctcaccccctgtgctggctgtaatgatggtgagagtctttctttagaggtgtgaggtttgaaatagggatgttcacccatgggggctgagactaacctacccccccccttccagagacacacactggctgtgacaattgaagtcagctgttagcctgactatacttaaagcacaccgagaaaactgatcacactttatctctaggctatccatcagaatatttccagaaacagagatgggcctttgagtctgagtggactgagcagcatggtggcccacaccttatttcacaatttgtcaggcaggactcatgggaggtaattagtagatgaagtcatgagggtcgctcccatggtggcattagtggccttaaaggaaaaatgagctagcacacttgctttgtttctcacaatgtgatgcctggaaccatgttgtttggcaaaaatgcccacagccagatgctgtgccaatggccttagattctcagcctctagaacaagacaatgaacctctattgataacacatctgggctcttgcattttgttataattaaaaagagcaaactaagaccaacttccccactctgggtgggaccctaagtcctctgagaattctgggaatcatacaaggggacagaccctaggcccaaaaaaccatgtgtccaggaagcttaggaagtaaccacaaaacatttcagtttggctggaaattggcagttgacagttggcctagcattcatgacatcctgggtttgatccttagcactccataaattgtgttatgtaactgtaatcccaatactcaggaagtagaggcaggaagatcagcagttcaaggtcatccttagctacgtagcaagttgagaccagcctgaaacacatgatacatatttcaaaaaagaaatgtttccgccaggcatggtggcgcatgcctttaatcccagcacttgggaggcagaggcaagtggatttctgagttcgaggccagcctggtctacagagtgagttccaggacagccaaggcaacacagagaaacaaaacaaacaaaccaaacaaaaaacaaacaaacaaaccaaacaaaaaaggcaatgtttcaattactcagaggtcctggccttaagactggaaacaagaagccctagaacctctcataagtagacagattcagacatagtgacggacatggcagctagtggagacagaatgaagtcgggccatgttcatgtcccaagtacctgcagacaagcttctttcagttacaaaggagggcagattgtgataggaaccctgacagctcctgggaaaggcacctgtccatcaaagtaatgcccacccaaacatcagcccttgttgttagacatacatgagctatgtctgagaatcatcagaaaaacctccatgggcacagctctctgcaagaggcaactgttttggctccaatggccagtgttcatttggccagctctggtgccaggccctgactggtcctcagaagggcagacagcccagtactctgctgcacacgaggacagctgccagactaatctcatgacagggccagctgggctgaggtcagaagctctgcctgatgtgagtacaggagtgaaaggatgagagcaggaagctaaaggatgggtaagggtggccaggcagagtagggaaaaatgcatgcacagaagtagtaatccgtgtgctgctgagtccaaagggaccaagagacaagtggaaggcctgcctagagtggagcacctagtattgcatgtgacagccattttcagcaggctctctctgggcacagggtcacacagggccctatggcactccccagttggcttatactgatcctttgtggagtcccaggctagaaagcaactgagggacccttcttcataaccaggatgacaggcctggaggcatctgaagactgcagatgctaagagtcagttgaagatgtgtggtattggcacactccttcagtcccagcactagggaggcagaggcaggctgatctgtgtgtgagccagcctggtctacagagtgagttctgggatagccaagactacatagagaaacttgtcagtccagggcagagctctgctttgtttggaatccacatagtcaaagcccagattagacaaccccagcccttccagactgtatcccagctcccggaatctgggtgaaactatggccagaggcactgaggctctagctctgttcacctatctatgacgtcttcaagtacctagggctgcaactcagcagagcctctgcagaggccttaggcaggaaatgatgatagtcacctggggtaacccagtgccccacctagcccacccacctagagcctggccagacgagcaggacacccaagctggtactccagattcatgagatttttattgtcatcacaggatcaggattcatcttcaccaaaaccctccactggctgcttaagagtggctgtgacctatagcaagaggaagcaggcacagacagaccaatgtcaatagtcccaagtgcccctgaaagacaggctgggccggctgtcccctcctgcccacagtagacaattcaggcagtgaggtttcctgccccctagggactagctcacatggggtcccactaagtgttagggaaccaaccctggccatttcaccaccccaagatcattcacacaatgagccatgaagtgcctgtccagaaggaagctatctggtcccataaggagtctataagagaacatagaatattttgccaaagggcctattcatacatggagcactagccaggttggcaggtatccaatcacctcagttgatataacttcaagcaaagggtacccaaaggcctattaacagcaacttcacaaagcaatctccagagtagcaagtaagcccaatgaagtacagggtgagggattagttcgaggggctaagggatcagcagctgcctgtttcccaatggaaatgttctgcggaggcttatgaagtacaccaggtgcccaggagtgctcccacccaataaagcagccaagagcacctgccagcatatcccacggggtccgggaactcctaggaatcaggctcactgtaatgactacaaaaaccatgtgggtccctacataggtgatactagagcagtggttctcaaccctttggggtgggtgtcatatgacactttcacagggttcacctatgactgtcagaaaacacagatatttatattatatcatgattcatagcagtagcaaaattaacagtaatgaagtagtaatgaatataattttatggttggggtcaccacaacatgaggaactgtattaaagggtcagctttgggacggttgagaaccactgtgctagatagagtgcaggactgaagctggcagggtccgagagcaaagtagtaactcaagggtaaggcctgcctacattcagcacacagagtgtttggttggcccttgtgggacctgagatgaccccgtggtcagtgctgtcctggcagagaggaggcgtgatggttgtgcagtagctatgggtaggctgtgtccagctcctcagtcctgtttgtcctctctctgcctccaggggtagatgagctctccgaagaccagctttcggcacagggtaccccaggagtgcttgggatggcagccacagcgaggcagacggtagatgtgcatcacatggttataggacagggggtttatctgcaagggcaggggagatatcagtagggtagtggtcctgggtgcttcagctgtgtctacagaagaagctcttgagggctggcaccctgggcctgactggctctctagagaatctttagcaagacaaatgtagggcaaacccagacaaatgtttgcctatggaatagccatgctatctatccttagagaagcaaccatatagcactttggtcccctaaggagggaatgatggcaggggagttcagtgtctgccctatcctagaatctattctgtttctaggcttctgggaggaggaagaagaggaggaggaggaggaggaggaggaggaggaggaggaggaggaggaagaggaggaggaggaggaggaggaggaggaggaggaagaggaggaagaggaggaagaggaggaagaggaggaagagggggaggaggaggaagaagaggaggaggaggaggaagaagaagaggaagaggaggaggaggaagaggaggaggaggaagaggaggaggagatcatgccagatgcttctgcatctaagagtcttggacttggaccaaggtacaactcaatacctggcaagtcaccccaaaacatgttctgctcccttcacggggactggaatctgtgactgaaagagtcaagggttcaagaccaacaggaaatgactacttgtcatgaggcctttgtaaagtcatttctgttttatcacaatcttgagcactatgggactcagggcagcttcatgatgtctctagccaagtatgggcactccacccacaggctggactagatatcaactatgtagatcacaataagtagccataactctgctggggaggctccagacagtgagttatagtgctcagatgccagggaacctatcccttagctccactgggtccttctacctctatgtgacctctggctgctctaacaccacagtatcacaccagctgtcccaggacactggggagtctgatggaaggtggggatcccgggtccgagtagcagtgaagcatagagagttcttacctgcatcaggaggcggaggggtctgcctgcctccttttccagaactctgaacttcacaccagctataggaaagcaaaggatttaggaaggaaggtggcaatacccaatcagctttcactggtcccacagaacgctatgggtcagcagaggctgctgtagatggcaatttcggatgcttctagcccctttgagcacacccaggaggcagcagacctgcctgggaacacagggttctctcctcctctactttcccagctgcctctatgctgggtggcagatgccctgttaatagttcagtgccctacagcttctgtgtctgtgacttaggaacccatagcacccctggcctgtattttgagttccaggtctaggaaatgcccaggaaggttcctttttttttttttttttttggtttttcgagacagggtttctctgtatggccctggctgtcctggaacttactttgtagatcaggctggcctcgaactcagaaatccgcctgcctctgcctcccaagtgctgggattaaaggcgtgcaccaccacgcccggcaggaaggttcttaaaagagcaggaaatgggacagttgtggtggtgcatgtctttaatcccagcactcaggaggcaaaggtaggtagaactctgttgaattcaaagctagcctggtctacagagtatgttctaggaccaacagggctacacagagaaaccctgtcttgaaataaatgagctggaaatgaagcttacttaaagccagtaagtgggaagggtcagaaccatggccttccaagcaaagtaactgctctgccccatttactggctccaaacttaggaggaagaggttctgcatcccaggctatgtctggggctactgtggcccacctgcttttgtgttctgaagtgaagaagtgggggcagagggtaagtgagtagcattgcaaatgagactctgacctgggtcccctgaggtcaatggagaaattagctagaaggatgttcacaaaatgttttataggcattcagcagcagggagatgcctgaaggcagactttgaaattggttcaaagccatggaatctgcatatccctatcaaaagggtctgagctggctggaagagtcaaatgggtctactggtcaccttagaaatcagctgaactggtgttgaacattggctatgccaggcgatcctaaagtccctggtgtatccaaagccctagggacaaatgggttgctcatgataacctcaggcctaaaggagataaagtcccctcagggacatgggaccaggatgtagagattcagagagacagctcgggtgataggcgatgattacacacagtgcaggatgctcctgctgcagtctagcagccctcattccggcctgtccctccaagagtaagggtcatcaaaaagcagacataacatagaatcacatggaggcagacttctctaagtctgatctatatcctacacagactctgcagcaagcctcacgtattacagaaagggtgatgccttgggtctttatgtctctgaactttactctccagggagagagaaaagatagcatgtgcccaggaccaagcctgtcttcatggccctgcctattatgccacacataccaattctttcaggaaggagacacatgaagttggcacaagtgttttataagtcctatggatacattgtatcatctgtcagaagccagaccaccagcacccaacacttacctgccagcctgtagggtcggcagagtcgaaggccaagggagtatagtggcagggaattgatgaggtctacaagtagatggattaagccttgcacagtgatcaccaggagccggagctgtagcaaaggtgacattcagggctgagggcacacattaaacgggcctaggaggagagcagcccaataggctcacctctagaggagggctcctctatgaccccatccacttactatgggtcccaacctcccctgtagccagtcttctccaggacggaacccccaactgctttaagaccagtacatagtttccagagagttcagaacagccatgctgatgtgaacccaagaggtagatagcctgtttcctgtgtgcctggctcaggcagtgaccaatcccaagttgttctgtaggccccagggcaggaggtactgggctcaccagggtgaataccaggtagtacagagcggtggtgggtagcaagaagaccaggatggtgaagagcaaggtcccaatgaagagctgcagggaaaaaggaccagcacacctggcaccacaagatccaggccagggaggcaactccatcactgcccacacacatcttaaactgcagttgaattttttggtctcctgagctagcaagggtcagcatgttccctttaccatgaggagtgtgtgtctacataccctgtggacctggggaaacaggcagtagggtacataggtaaaaatgatgttaggggaaacttcatgtatcacatctgggtaagcaaatggaataagccaaagcaggtcctatgcccaccttggtaaagtctgtaggtctgcaggtacctccccctaggccaactgctggaagctagctgcaggataggagtaggttggtccttggtagggtctaagtagctgccctggcagggtcagcaggctcaaagctgtaggtacctggtcaaggtcataggaacaagaatccactcgctggcgcagaacattccacttcttcccccggaacagacgccagagagaggaaaggccatagatcttcaggcagtacagcctgtaggtcacatgctcatgaggccacacttcacccatgagggccacacctcacctattcgctcaaaccctgttgagcgcccacttgcacttacacatacctggcaccgtagacatagaagcaatagatgtggaaggtgagaagggcgatgatatccgaaaagatggacagagcaacagtcagtccaaggcaggctgagagtcccacatgccacaggatatgctcaataaagggggacataaggtggatatagcctgcaggatggggttcagccataagtagtgcccaccaaggcactgggagcccatgcttctgagaatggctacctaatactgctggatatgggtgagcacaagcccagccactggacctagacttcagcttgagacttcaactggcctgacacagttggcttcatacaaacaggaggccagcaaatggaagcaggaggagaatggggcctgactagggttgcctgctctcctcaacctgccctgctgggctgcccaaccctgcccagcaggcactcacttatccacagatggatgtggtacaggaaaaagcggcctagcacctgatccagtgcccgattcatcttgagcccagcaggagcacccatcagccactgcagcagatgctggagctcctcagccacgcgctgcagggacagggagcagggggggatgacacggtcacagaggcagatgagtaggcagggatgacatggtcacagaggcagatgagtgggcagcagggacatggagcaggggggatgacacggtcacagaggtagaagagtgggaagcagggacatagagcaggggggatgacacggtcacagaggcagatgagtgggcagcagggacatagagcaggggggatgacacggtcacagaggcagatgagtgggcagcagggacatggagcaggggggatgacacggtcacagaggcagatgagtgggcagcagggacatggagcagggggggatgacacggtcacagaggcagatgagtgggcagcagggacatggagcagggggggatgacacggtcacagaggcagatgagtgggcagcagggacatagagcaggggggatgacacagtcacagaggtagatgagtgggcagcagggacatggagcagggggcgatgacacggtcacagaggcagatgagtgggcagcagggacatggagtagggggggatgacacggtcacagaggcagatgagtgggcagcagggacatggagcagggggggaatgacacggtcacagaggcagatgagtgggcaggttgaggattgtctagagtggactcccaccctagccagtctctctgggcagaacagaggcagcctgcacttccttccaaggttcaaaatcattgtctatttatttaaacagggtctccctatatagttctggctatcttagaactcgctgtgtagactcggatgcctcaaactcatagagatccacctgcctttgcctctaaagtgccaggattaagttaaaggtgtgcaccaaagtcttctaactttggacagaaactgtttcccaaatttgtctggccactggacccctgacccctgaccacagatgacttccaagatcctggtttgaggaatcttctaacaggctggaatacataaaccaattccttgagcgagcgtgtgtccccatgagacatctacctcaacctgagaactcccgtcatcctcttatactgctacattagccctggacccatagggtcctaagtctatgaaacctggatattgctgaggtgggacagaccatggctcaattcaaaccatacttgggaaatactgaaggcccccattaaagacttcactgtaccacttgctaccagaggttagggctacccagcaatgggtagcaatcttgggtgagtgagaaggtgttgggcttatcagagacttggcaagcaggggagagtgccggagggcaggggcccaaagaaaagacgaaactgagtgcagtgaacccatggggacgtcagcgacgagcagggtaagggacgggatgtctggctaagggacgctctactctgtcaccaaggtgaggccatagcagtaatcctgtctgtctgtctgtctgtatgtatgtatgtttttgagacagtttctttatatagccctggctgtcctggaattcactgtatagaccaggctggcctcaaactcatagagatctgcctgtttctgccttccaagtgctgggattaaaggtctgcaccaccactgtctagtcctcaagagtaactcttatatccctacatgctcttctcaaagcctcttgcaatcctgtgcaagagcctcaggaccaccagggaggagagcaaaaccttctttataaataggtcttatttaatatttaaaggataaaagcctggcagcagaaaaagactccattttttaattaaatatttatgggtgcttttttttttccccagacaaagctggccaagaaacagaatatagaaacagcctcacccgttcacccagctccagctcctctttcctactgggatgacctccacagatctcacaaagctgagaggagcccactgctgccccagattcctggcctggcaacaaacagacccagcaggcatccgcactgacggagcagaagagagcccacaagacttccacggagacactgctttgactctactgagatgagatggagaaccgagacgttccatggccaggtagaaatgaggtgaaggaaccagcatgaatgtgctgtacataccgtgtacgagagcatggggagtagagaggacagcctgtgcctcttgtctccagtgtaagagcaatctggcaatagtgtggacagcccagcaacagccccgagccagagttgtgctaaggttggctttcatctggtatataagcttagcatggaaagggggcccatgaaagcctcaaccaaagtggccctcagacactgccaccttcaggaaggggcagcaggcaattcaccaatgctgccctgagagacataggtcccaagagctaagaaatatctcaggctggggccaaaggctgggtctctagggtgaggacagggaagagctgttcctgccagctgaaggactgcccaagaggattcccaaccctcaggaagctgggctccacccaatccactcacatcagccacagggaccagggcattggccagctgtccaattcggttattgctgtggagccaagagagcagcagcaagccaagggccacatccagtagcacagaaaccagcatgttggccttcctggaaggaaagtcagggaaagcacagctacagacacagcctgaaaggcctggctgcaggcacaatgcaaagcggagaggaagaagaggatgggccgcccccttccttgtataggaaaccatacctcatcagctgcatgggattctgggctttctccgtgctgaagatgaaggagaggtgcttcagccggtgatggagctgctcacaagtggagagcttgcttctgatgaaggaaagtggccacagcttccatagcctggggggaatataagggctgagactgacacctccagccttaggttccttggtttcccagcctaggtttctcactctagaaagaagacccggagtcactcaccctgagccctttggttccacttgaaggctcagcagggcccaggcaaatgtgaagaccaacacagccaagcacggatgcatagatgtgaaaagcacagcaccttcctgcccccaacccccagccgtgcttactgctactacagagctggacccctcgcagagcctcaggcatacctgagctccccagccaatgcaaagatgagtgtcaagatagctgaaaagatagccagtcgtggtagcacgtgcctttaatcccaggactcaggaggctgaggcaaatagatcagcttagtaagggctaccctttccccgaaagatggccaaaaaagtagagggggagggggggactaggtcatctctcatccacccaagacttgccctgcctactacacggtaacccagctcagcaaggttctcctgggctttccagtaagactgaattcctcacaaaggaagcattgagacatttccacagatgctcacatagtaagagatgtcttcaagccaaggaagaagaaaatacctgatagcaattggcttgtgtgaaacagagcagggtcaaggaaagagcagcagcgccgggcgtggtggcacacgcctttaatcccagcacttgggaggcagaggcaggcggatttctaagttcgaggccagcctggtctaccaagtgagttccaggacagccagggctacacagagaaaccctgtctcgaaaaaccaaaacaaacaacaaaaaaagagcctagtgttactcagcattctgaggacttaaggacttttccattttgcattattacctgaagccagctgtgggaaaaacagaaaagaaggggaatgggcagctctgtgtcctcatgggtcaacccaggtggggcagatattggcctttaatcccagcactccgacatagagtttgaggctagcctagaccacatagtgagttccaggccagctaaggctatacagctgagaccctgtcccaagcacacaacaatcgtaagctaagctgaagagatgatgatctggagcacttgctgctcttataaagactcagggttaattcccagcactcacatgacggcttaggaccatctataaccccagtccaggagatctgtcttggacttaatttgtggaccaggctggcctcgaactcagaaacccaactgcctctgcctcccaagtgctgggattaaaggtgtgcacctccactgtctggctatttgtaattttttttttaagtgcaataacccagttttgtgttcaccagatttcttctcggtgcttgaactgtctgcgacccatagtatacccaagtggatgggcctcacacagtcttcaggaatagcagcctctactaggacatcctctgagatgcaaagggagggaggtaagaggagagctgagtcccaggaacatgagcctcaggatggaccctctggctctcaatgccactacactgaagggagagcctgtggttctcaagggtccaatttcttgtcctacctttcccatctgaggcacctaccggcaagcactagctgctgagatcagggacaacagagaagccagcagcaggcagacaggcccagaggcccgctttgccaactccacaagtatgctggcctccactccctctgattgccagtggctcaggcgtacgggtctctcatcaaattggtcatttcggaagagcacctcgctgcgtgccactgtgtcaaagatgtcagctaggcctccggtgctggctgtggtgtctcccatctggcaggcaggcaggactggaggcggatgcaaccaggagagcagcagcttgcgctgatcatagaagatgagcatgacctgctcttcggggtgcatgtccagagggttagacatctgcgggtaagtggccttgcagctccagagtctggtacccctctcccggcagagctgcaaccaggggtcatgggagaagatggtgcccaggccctccaggaaattccccaggctctcctgcggttcctgctgacggtggcaccaggtccctagcacagccactggtacttgactggccttctgcacctgggccaggagctccttgacttggatggggatgaagggaaagtgcaccacggccaggatcacagcactgctctgtcctggaacccatcgtcccactaacaggccactgtctgccgaggcacagcacgtggggaagaagaccttgagcaccatgctgggggccctgcaagagacgagaaagggttggtttagagctgctgtggctggcagcatagtgcctgcaagatgctgtaccctgcttacgaaccattcacccagccacacattgggaaagcacagttctggattcggtgggtcatggctgtgcatctcccagggactgaactcttcccatcactgccccaggaagcagcagctgtatgtgtgatggcagggcagtgcttccacacgttctaaggccagcagcctgaagcagggcagagtgaggtactggacagatgctgttgactgacagcagtgtggggctgagcctgagggctttaatgagaaaggcctccttatgagtgtcatatgagcatgtacacaaatgataactttagcaaaccagaagccagccagctgtgtaatgtacacctgtgattccagcagtggagaggtggaggaaggagtgccagttcaagaccagccttcaaaggaaggggttgggggagatggcttttgactatagtctcagtacttaggaggctaaagcagggagaccactgggttcaagattcaagacaaggctaggcctacacatgaatttcagggaatcctggcatacaaaataaggccctgtctcaaacagcaataaactagatttacacaagcaagagttaagataaaatttaaacctgggactgcagagccactcagagctttagagttctcgtcgctcttgcagaagacctgagtttgattcccagcacccaaatggtggttcacaaccattcatacctccagttccagcagacctagcacatgtgtggttacatacgtgcaggcaaaacctcatatacgtaaagtaaatttaaaaggtattaagcctgttttggagggccagggatggttttcaatgacagagtgcttgcctagcatggccaacattctgaatttaatctcaaacaccaccaaatgaccaaaaataaaaataaaagcgaggggctggagagatggctcagcaaataagagcactgactgctcttccagaggtcctgagttcaaatcccagcaactacacggtggctcacaaccgcccgtaatgaaatctgatgctctcttctggtgtgtctgaagtcagctacagtgtacttaagatataataaataaatattttttaaaaaataaaaaaataaaagcgaaccaaacaaacttgtttcggggctcaggaaaactggatgcacacctagatcactggtcctaaggctgcgggtaaggcctgcttaaaggagccgctcctcctgtgacacggaccatgtcctcctgttgctgctgccacaaactcatcaatcccgagctccgcctaagtcaggatttgaaactccaccagttcccatcctggaaaacttggtcctccaacctccaagaaatcctatataagtttgcttctcactcagttttctgctacttctagcccaagcagaggtagctgccatcttgtgtctttcccaataaatctcttgtatgaggcttgttgtgtggtgtgactttgtgcttgctattccttggctccagactgccaggacacctttgccttcagagctgtaacacagagactcagtctcagaaagtaagtagagaagaggctggaggtgtagctcagtggtagcggctctgctctgccctctgctcacctgaggtacctctgggtagtactcctctttctctggaatccttggcagacaccccaagatggggctcccagcagagcagtatttctctccatgagagaatgtcaacgcattttctgtgagggaacagcagccctcctgacctctcaggctcttggtgtgagcattaagaaccaccacaggggcaccaccacaggggctggagagatggctcagcggttaagagcactgactgctcttccaaaggtcctgagttcaaatcccagcaaccacaaggtggctcacaaccacctctaatgagtgagatctgatctgatctgatgccctcttctggtgtgcctggtgtgcttacatgtaataaataaataaatctttaaaaaaaaaaaaaccaccatagtagctacaaatcctttactctgtggaccccactctgttccttccacagaaaaggtgctgtttggagattgtgggtgtcctccacttgtgcctgctgatctgaactgctggaatggttggcaaggttcaagtgcctacatatgcctttctttagtcaataccgcatcttgcccatgtgaagtgaaggacacagcaaccatgaacaaagaccccatttttggatcctttcctgagggaggcccagatcttgggctgaagcctagtttcctggtctagtgtctgcacaaaacaattggagtcgaggggatagacagtgacacaagtggtggtggtagctggcccatagacaaatggccagagcttgaaggatccaggtgcagctgctcccttcctgtccagcccaaagccgtcacatggacaatgtggcaaagctttttggttttgatattgaggactagacctagggtctcatatgaactataacccagcccaatgctgagaggactaatgggacccagcactgtaggacttccaaatgctggtgctgattaaaagaacagtccaagcctgaaaaagccgttaaagaagtctcgggaagcctttccatagaactctgagtcagaagtctccaggaaaacaaaactccaaagaacccggaggaagcaggcaattggtaggtgtccatagggaaaacctgacgcccaacactagggcaggctaaatccccatagccagtgtcaagaaccaatttctcttgtcccttcagtaggaactgactccagaaggccatgacatgaggcacggctaaaaatactagagccattccgcctgtaagagccccggcgggtcactgtcatagggaacccttcagcccagcccaaactcttgttcaacaactttgtaaggacacaccagctcagtgaaatatcatttgactctctgggggaacacttcacatgaactaaggaaaaatgctcacaaccgtgtaggaagagaaatgcccttgatctaattataaacagatgtttcaaaggttggtttggagtctgctcacaactcgtgaatccactgtgctatatacacactgtgtctatgcacatcctccttgtggagtatgcttcatttacagtttaccttaaagcaaaaaagctcgggtcaaaggaaagaaggtgcaaggcagagagaggttggagctctgatctgtggggtactgagagaactcaagttgaggcaaatccccaccctcactcccatctcagcctccggatgcactgaagtgtaagaaggagtgtgcttacactgggctgctgggatcccagcagcagaaaatgatgatgaaagagcaggcgatcgatacaagaggtgagaggctggagcgagaaggcaaaaacctgggatgcgtgaaggcctttaaagatgctgattaaaagaacagcccaagcctggaaaagctacctttgctaagaaggagtcagttccctccccgacagcccattcccaggagggttaaataagaggccccaggaagtctcttcacagaactccaagtcagacttcagcagcagagctactgcttacttcccctgcaaggaacaggcttgagggatggccagcccagttaagagagacctgggacacatcatagctgaaacattactttgtgaatctttgagagggttcatatttaccccacgttcaaacaacaacaacaacaacaaaaccacttttctgactagggatgtagtcagttggtatggagcctacctagcctgcaccagaccctgtgttgagtccccagaacctcatagaccagtagtagcagtgcatatctgtaatcaggaggtggccaaaggacaatcaaaaattcaaggtcatcctttgctacactaggattttgaggccaacctagcctaaaagagaacctgcacagaaacacattttccgcctctgtaaatgctttcctttttcatttcaaaaggagggggtaatctgtttctgatctttactggagtggataaatatgagcctctcagccagtgccccaggaatcttccagccagttcccggcctggaggggaggaggggcctctcggtgccctcaagttccggagagcaggcccagacccacaacgggtgccgctgagcctggaggtcagctgcgtgggtggccgcctctccctctatcccggcctcaggtttcccatctcagagtctttaggaccaagaggcctgcgctacctcgggatttcctcctcttcctctcccggccccgccacccgctagtgctcaccagctggtccccggggccgcgtccccgagcggtagggaaggaactgggttgggcactgcgttcggcgggcccgggaggacgaccgtgcttgcggctcccaggcccgccgcgggacatcagcaccatttccgccggctccgcggcgttgtcgcgcgacggtccggtccccaaacatgcccgggctgtccatcgcctgagcccgagagttccgcgcgcgcggctcctgtcatcaaagctaccctcgctgtaaatatcctgaaaggtccggtggatccagcctttgaggaccatggtagccgctttgttcttaccgcctggcctcctaaacccaggcccttccatctgtttctatccattgcgagtagggtgcatgcagacccgtgtgggccgcatagtctgaaagcaatacccctaacaacgcagtaactagtgtttattgagcatctacttacaagcaaagtttctttcattgtccattaatcccccacaacataatgaacagggcatattgatttagcctgcaggagtgacatgtgtgttgacctcaacgtccagatgacaggctgggtgccaccccacaccctaaaggagcaaaagcaaggagctttttcttgcttcttcccacatgaagaacatgggtgagaccagattctcaatgagtaagctcttcaaacacacacacacacacacacacacacacacacacacacacacacccctccccttccagatctcatctgtaacatgggaggaaaggctactgttttcctgtcttgaatggaagggtatgaaagaacctgtgctacccagaaccgtcccagcaccccacctaagtgctcaaaagtggtttggacctggattgaagggaaaactgaaggtatctttcaaaacagggagtgtccagtagaggacctgcccttgctatgtgccctaccaggacacatgttggccttacccctctgatttgcctactccttacctctctgttgggcccagagtgctgttggaggctcaagaatgggaatatttttgaagctggggggaacactaagggaccacacccttcccctaaactgcccaacccagcctagccacaccctccctgcctgcctgcctgcctgcctctgattaggatgtaggggttggacacctggcaggagatcttgcctagctatctgctggcagacagcctcagcacccaggatctatagcttcaagtgttgcctcaaagctcaggcctcccgagacccaagctagcagagccagggactgagtggcccttgggttttaggggcatgaaaacctatgagcatacttaatagggaagtggagatggcccagtttagaacctcatcaagaaatggtgattcatggtttctgtgtagacaggggcacttgccaagaggaaatcacaaagccagctaagaccaggtatcaggaagacggctcagcaggccccaaggagcctaccaaccttccatgatagtacaaaggactcaggcccggccagtcctagcaaggggcaatttcccccagagcctacccctcaggccatctcccccagatactggtacaacttgatgcagttgtcccctgcatctgccaccactagttggccctggggtgcacaggccatacccaagggcctctttagtccctccaactgcaaacagatgggtggcccaacccggggaaacaaagtcacttggtgcctctgctcatcagccacaataatgctaccctctgcatcagagcacacacctgctgggtggccaaagttatgcccagtcagggttcctagggagcccagaggctggtgggcactgccaaacagctgtacatccccaaactcttcactcacagcaaagcccccatcaggccctggacctacccaacaagggccctccagacctagcatggaggttggagcaaggggctcccaggttggtcctaacatgaagctgtgaacagttccaggcaagtagtctgtcaccaggaagtgtccaagagcatccacagccagccctcggggggacaggaatgtgcctacagtcacccagcggccctggggttcccgggaagtgtactggagagcatacacagccccgtgaatgaggtcactgaccaccacaagccctgcagctgtcaccgccacatcctctgggacaaaggctccagttctaggaatgcagcagggtagttgacaaatggagcgtccctcaagatccagcacatggacacaggatgcaacaccagccgtcaagaagagcagaccatctggggagcagtgcaggcctcgggggctccctgcagcccctgctggcaccaggatttgtcccagcaggcgaggctgccgagagcaattggcatctctaagttggtccagcctgagatcaagatgtcaggggtaggtggctggggtaggggcagcccaggaggtcaaggtgtcaggatagatgggaggccaggggcagcaagcagtcgcggccttggcttctttgcagctgcaaaagagttggaacatccatgcatgcagatggtggctcatgggcactagcaccctcccgttgtagatgaagagctggggagtgggggtgggggagggggagggggaaggggaaggctgctgcattgtatctgagtgctcacctggttcccaagagcagcaaccacacaggtgtctgggtgtctgcagcaggggtctgagagacaccacacactcaagaggggcggaggtttacctctaaggctcaaatcgcatgcagagctgtgtcctgcctagggaaggaggaggcagataagctgcattccccagccctgggatgactccttcactgaatggcctaagctcctgttagtcccccactaccatcaccactaccactaccaccaccaccaccaccaccaccaccaccaccaccacacacacacacacacacacacacacacacacacacacagcccctctgcttcagccagggagacatctaaaccccaacctcccagggctctccaccagctcctcatcccttccacagagatcaggatatgatacttcttacctggggctaactggcctcagggctttaggtcaggcctctgttgttggagacagcctgggtgtttggggaggggcgggaatggggaggacggctaggggaggagtcatcagacaagtttcctgcagggacaaattgagctgtttgggctgagtccccagtctccaggcctgcaccctctggcttgggtctactgctttgacatagctccatcgggcaagacaggaggcacctcagtcctctacaactataggccacccctccaagtaggacatttgtgtcaggaccacatcatttttgtttgtttgtttgttttgttttgtttttcgaggcagggtttctctgtgtggccctggctgtcctggaactcattctgtagacaggctggcctcaaactcagaaatccacctgcctctgcttcccaagtgctgggattaaaggcgtgcgccaacactgtccaacccaggaccacatcgtggtcgccctcttgtcagctccaccaagaagctgaagtcaagctggtcctgcctcttcctgtgagtctagtgctgctgctgcttcccaggatcagaaagcagggtggcaggtacagggggcgctgagaggacggtgcctcagacttaagacctgaggtaccttggacccctggctctgccctcagcggtgccccaggaagcctccaggtcaatggtgcccagctagcttttgtcagccttggcctaaagccccacagcaccctgggctggccagccagaactctagccccaacaccacctgtaatgcctcacagtggggtggcttcctgatgctatcacaggtatatggttaatggggcagctgaaggtcctgttcggactggccctagcctggccagtccagccccagtgagaacagtacctcctctgagggcagcttgtacttcagggcattcctgggtgggctacagcccagctccccagggagaaaagttatttgctatggctggggggccccagcagccctccctggctgtctcccaccctggcccgtggaaggccaagcagggctgtactgggaaggaagcagtgagctgtgaaggccaccgatgcctatcgtggctgcaggggctggcggggggcccaggaaggccacacggggtgagcagcctggagccatagaaggcaggaggctttggctaccacaggcaaagctggcattacactgcttggatggattcaggcccaaggacgcgtgcagggtccttgcccatccccagtgagctgaaacaggccaggtcatcctgctatgtcggcctctctgccactcttccctgcatcccctaattgagtgtacccaggccactccttgaccccaggctctttggaagaacaataaggatttctgaggtcaaaggtgaaccccagcatggtgtccaggacatttgctccctgggacactcaggccagggacatttcctggagtgtgccaggtgcttatacagggacagaaaaggaaagagatccaagtaggggtgtttgaaggtggtttctattttaatgtccacaactctgttcaataaataaatcatgaccttgctatgtccatgtgaacacataggtaagtctctaccacgggctggtgggggagtctgggtgggcggcggttatctgttcagaacacatgcatactgacactggacaggcccagacaacggggcccaggtcagggagaggaacccatactctatggtggctgtgaacagaagtcagcacttgggaggatctgtaagctcggggtatctttaggggtctgggagctgccagctccaagccgattaccccagccactaccaggaatgacagggtcctcgggggcctggagggggaggacaggaggagggacactggagtcagcctcacacttggtggtgcggctcgagaaagactcaagtactggacccagtatgctggagggctctgaggtccccctggccagcacagggcctggatcatgcagcctccaggattctgagggtgcctcagttcccttggtaggtacccgcttcactgagaggtccaagggtgtgtccagtggacgagcagcccgggccagcgcctgatggatagtgaacagctcccggcgaatcttgccaagctgctcccgaagaggtctgggggctagacccccagctggtgccagctgccccaagcactgctccactctggcatagtcaccaaaggcctgggtcaggtcctctcccactgggactgtacttcctagcccttggccttgtggatgctgcagaaggtggaactcaggacctgaggcctcagggtcacctggctccttgtcctcaggccagagtaagagggaggagcctgtcggcaggctgagaagaagaagccagttagaaggctatccttgcccttagtgtctgtccctctagccctagagtatcttctgctcagttttacccataccccagggaaaataagagctccagtgtaaacagggctatctggtatcaggtccctctgcctgaagtctctactctagtgagttaggtgaagatggcctagcctcccacccagcccacccctaacacccccaggctaggacccaaaactcctgatactcacctgctctgacagccaaattttgccaggttcaagggggcctttgggagctcaggcatgttgcccgtgggcagcctcttctgcgggttgctctgagtcactctccccagctctccttcatgccctgggtctctggaagtaccatggggccagggtcccccgggccctggcacaggcaccttcagcagcccaggagcagacagagccccaggaggccccttgaggggcacagaggacttggcaggggcagccctgcctgatgattgtcctaggctgtgttctagtagtagtgggtagtacaggcggggggccaggcctggacgctcgggtgtctgtggggctgggaaggctgtggggggcagcaaagggcttgctgaggccaagaagggcatgtgggctgcagcagcagccagtgagggccccagataggaaaagaggcctgggccaagagggtagttgacacccagcaatgataagtggaggctctgggcttcagggaactcaccctgggcaggtggtgggtagcaggggacactactctcagagcctggggttgaagctatagtccctaaagtcccactcagcatgccaccactcagtcctggcttccatgactctgccaaaaggccactggtgcctggacccttccggatgggtctagccagtgggggcagtgaccctggcgactcctctggtccaggtttggggcccctgccagaacgacgctgggaaaagctgtcagtgacaatgagatctggctcagttggcttgctactagggtctgagaagtctgtggagcagttgggggtgggcacccgaggcctgggtgaggggggcgcacggcggcatgcccagtcaggggagtctaacagtagagagagggagtctttgcagaggctgtacttcatgtggttataaagatgtgacttctccaggcaggtgaaggggcactggaagcacttatagttgtagggtttgccccagggccgtgggatataatgtggcttcttgggcttccgtgaccgtgcccttgtccccgtgcccactcggcatgaacctgcctctcgagacatggcagcctgctagcaggcaagcccaggtatcatggccacctgcagataggaaagacaaagacccagttaacaccaagccctggcactctctgctcttcgttgctaggggtccctgcatcagaacccatgaagccacagtccgccctgccccaaggcctctgacctttgttctttagcctctgacctttgttctttagcctctgatctttgttctttagttgtttttttttttagatgtttatttattgttatacataagtacactgtagctgtcttcagacaccagaagagggcatcagatctcattacgggtagttgtgagccaccatgtggttgctgggatttgaactcaggacctttggaagagcaatcagtgctcttatccactgagccatctcaccagcccgacctttgttctttagacctttcattcttttgagaggggatatggtggcactagtctgtgattccataatttgggaagctgaggcaggggggttgctgtgagatccaggccatccagagctacacagtgagattctgtaaaaagaaaaggaatcaggaggcagaggcaggcagatttctgaatttgaggccagcctggtctacaaagtgagttctaggacagtcagggctatacagagaaaccctgtctcgacccccccccccaaaaaaaaagaaagaaagaaaagggggggagaaaatagaggcagctaggcattctgatccaggtagacatagataagcttgcaaggtaaggatggtcttgggaggacctagaggtcattgctaagaaagtatagtttagggctggagagatggctcagaggttaaaagcactgattgctcttccagaggtcctgagttcaaatcccagcaaccacatggtggctcacaaccgcccgtaatgaaatctgatgccctcttctggtgtgtctgaagtcagctatggtgtacttaagatataataaataaatatttttttaaaaaagtatagtttatctgaaattaagttttgttttgttttttgagacagggtttctctgtatagccctggctgtcctggaactcactttgtagaccaggctggcctcaaactcagaaatccacctgcctctgccttctgagtgctgggattaaaggtgtgtgtcactacgcccagctccaaaattaagtttaactggatgtattttatttaccaagtgaccctgtacaaatccccactgctggggcccagttggccctgcaggccagtttctgggataactggtctccatttagtctctactctttgcaccaggcagtacccgctgagcatttggtaagagaatgagagcagccatgtgtagcaagagccaccagtctgatggccctctagaaacacttccttggttgagccacctgcccctaccagaaactgaagcaaatcaccgagattagaaaccaacagaaactttgagatctgactaacactacatgtgcacaaatgtgtgtgaaagtgcatgtgtgtaacccgagccggctagtgaagtgccaagttcacactggaggtctcttagggggttcagccacacatgaggcaaatccaggctggggggagtggatgtcacagcatggccccatggcacagccacctgctcaacccagctccatctgggtggcttcaggcaggtcagtgactgagcctgcagtgaccgtgctcagccaagaccctcttctcctcacgtcctgcacactggctcagaaacttctcccttcactccatctgggccaccacctgggctgtccactctcccagcactcaagcttgtgtatggtgggtgtgcacataggctttgggtgtgtgcatacaagcgtgcaagattcccaaggaatccttgttctacacctaaaggaacagctcctgcatggttgagctaaccaggcacagggtgtgccacaaaggacacgcacatccacaccacttcccactcaggatggatgtgcctcttcacgacagtatacctacattacagactatgcccgaaaacacatgaagacatgactggtaactcacacttggtcacaaactcatcatggatgcagacatacatgtgccgcatgatttgaacagcagggacgggagcggaaggcagttgctgaactcagctctcttgcatgctggccattacactttgcccatgatagatattcacctttagtcccacctaagatcaggtgggcaccccttaggtagacagctagatgggtggaaagcagtgcatgccagaaggctgggaatcacacagagttcacatggccagcctgggctctagagatgactgagcaaacatacattgagggagactcaaaggttgggtggtggatgctggctcaggaaagggtcaggggccccctggagggttgcagatctagcctggacttggcatgtatacaagcagtctcttctgcctgcatcccgccccccccccccgccacctcacccccgccccccttctgcaagatgtgatgacagataggcatgtgtgctcaggcaacagaggcgtctgtgcaggggccatcgatcacccagccctgggagccacacagctgtgcggattggtgctaccgcttaaactaacctcccagcccggactaggtggtccttctggggccttggatccaggggttggggctcctcctgtgcctccctccagaccaggcacccgaggtgctgacctctccaagacccagaggatgctgggcactggtccaacacagggcacatccctacactagcccccacatacacaaaggcacactcatcctgcccggccccagccccaaccccaactaatgacctggcatgggttccctggctgcgtgcctggtctggaaaactaatagctggaagggccagcccacctatccgttgaccctcttgagactcagtgtcctacagggatgagcgcgggagctgaagaggatagctgggaccccaacacctttcttttgcctccccgctgcgggcgccgccctgacgagccctcacggtgctgggatcacaagcagccctttctatgcatccgtccagagccggagccccaacttcgcgggaagtgccgcccgctcaccttaccgcgtccgccgaaccgagcctgcggcgtctgctaaatgtgcgccaggcaaagggtcaaacttcctacttgcgaacaccgcggggtaaccgaggtccagagctagaagcggcggcaactccacggcgccgccgcctcctcccgcgttccccgacgccgactcgcaggcgcccaccaaagttggcagagaagcgcgtgcgccacggcgcgagcttccaaacgcagcgacctccgaccgggctgggcgcgggaggcgggacactctcagccgcagacgactcccacctcttagcacactgccctgcgcactcaccggacgcgctgggactgctcctggagggagcgaggccggacccgccacagtgccgcaagagattggagtggcgcgcaggtgcggggccgagtgaggggcgcctggcaccgtccccgcccccgacgcctgcaggctgccgcgggggtgcgtagaggcagccaagtctcccgggtccccgcagcggcaagagggggcgtcagcacgcatcagtcagggctctggcccctgacagccgcctgcccacccaaatcagggccttggggctgaaccctaggacagggagcctccagagcggactaggagaggccaaagcccggagctcaggcggtggagtctatatctccttgccagcttccactgggcaagccagggagcctatgtagttcttttactccaaacaggaggcgtctcccacaccccttgctctacccgctgatggtcactatgcactgacacccctacccctggatacatcctgccattcccagcccccactcttcacgtcctaagaggttcctccctgctttaggagatccagtgccagtgcccactatcggaagggcctcatccccactggtggcttctcctggaagggctatggggtgacaaaggacccaggagggtttggaatgccgagcacacagtgaatgctggaactcccttccctgtaatgtcttcatggccagaactgctcctgggttgtcaaaacttaaaatctgggctcacacttctagccagatcccagggaaatttgcgtaattgtaattggtgagttccaggggtgcatgtgggcatggctccctccctccctccctcctgctctctctgtctctgtgtgtctgtctgtctctgtccgtctctctggagtcagcctgtgactggggaggataacttagcccagaggtgtgctgcatggtttttcaagcatagaagggtgattgttgccccaggcttgccctgtggaggctgaggtccaaagactcttgggaccctaaggctcgtccaggctcactactggttcctaggatttccccagttgagatttgtggaagaagtgaaatctctctagggattctgggttggtacacagggcagtcatagggttcagggcaacaagcatcagtacttctggtcccatgtctgtgtggcagacataatggccagggctcagctgttggccaacgctcaaaggttactgccggttaaggagcagggcctctccagtctagtttccttctgtctccatgccaccttcctcaaaggcagcccactcccaactgagggacatccagagctggaagtggtgttacgtatgaattgtacagcatgctcctttctgcctgcctggctcagctaatcagctgaccatgcaggtggcctggggccgggagacagcttgaatggccactgtgccagtagtcctagggccagaagaccagctcctcatgggcactaactagaaatgagtgcagagtcaggtcactgtgagacaaggagagtagggacactaggcatggccctttttcttttctcaaggacacctctgtactctagcgatcctctttttgggaattagggaataggctgtctgccaataggggcaggctggaggatgtgaccactgtccagaggaggcctggctctggcatccagggagtaaagcccggtgtagctcaggtgactgagcctgtggcctgtggaagaaaccaagaggtctgccatgtggcatctcacttatgaggttgacagccctagggatgatcactgcctaggccagctctatggaggcccggagaagtgagacagatagatatccagaatgggaaaagtgggagggaagtggagggcccacatgccccgcagtaccaccttttataggcctttttagaaatttgagtgagaggagaggaagagacctaatcaaacaaagccaaaaccaaaaacccaaaacaacctcaaggtatttttctattcttttttttaaagaataatttattaattttatgcatatgagtacacactgtagctgtctgtagctgtctttagacacatcaggagaggacattagatgccatcacagatggttgtgagtcaccatgtggttgctaggaattgaactcaggacctctggaagagcagtcagtgctcttaaccactgagccatctctccaggcagatatctttcccctggagatatatttgtgcttcctagactcctgagctctgggcttgctcatgtaggtctggagagcttgacagtgtgtgtctgacagtcgtccacctcctgcctaaggggcttgcaggcacatacagcctttcgtgattgccctttcctctccttcctcacacgaggactcttcttgggccttctatccaaccctttgggagttggggaccataagctctaggagatggccatacctcctgatgggtggctgaggccccatagctttgtgtttgtgtttctgcttgtcagtctgttatctttttttttttttttttggtttttcgagacagggtttctctgtgtagccctggctgtcctggaacttactttgtagaccaggctgacctcgaactcagaaatccgcctgcctctgcctcccgagtgctgggattaaaggcgtgtgccacccggcctctgcttgtcagtctgaacctgagaccctgcccacattccctaagcagcagccctctctgctcaagagtagagagcaccccccgccccccccccccccagtcttaggccactcttaggtccttcactaggacagggaccaggtattctttcctggtgtgggctttgcctttaccctcagctggagacttacttatttcagtcactaacctcagcttgatctgcccatggctgcccacctgtcacctctgttagcattggccctgtgtgtgctgggagcctgtgtgtgctgggggcttgtgtgtgctgtgtgcctgtgtgtgttgggggcctgtgtgtgctgtgtgctgtatatgctgggggcctgtgtgtgccgggggcctgtgtgtgctggggacctgtgtgtgcagggggctgtatatgctgggggcctgtgtgtgctgtgtgctgggggcctgtgtgtgctggggacccgtgtgtgctgggggcctgtgtgtgctgtgtgttgggggcctgtgtgtgctggggacccgtgtgtgctgggggctgtatatgctgggggcctgtgtgtgctgtgtgctgggggcctgtgtgtgctgggggcgtgtgtgtgctgggggcgtgtgtgtgctgggggcctgtgtgtgctgtgtgctgggggcctgtgtgtgttggggggcctgtgtgtgttaggggcctgtgtgtgctgggggcctgtgtgtgctgtgtgctgggggcttttgtgtgctgggggcctgtgtgtgctgtgtgctgggggcttttgtgtgctgggggcctgtgtgtgctgggggctgtgagctggaccctgcactgtctcagacactccctcagcaaaacatgtaggggctggactggctagtatttcaccatgggcagagggacagtggattgagctaaacagggtctaaagcctgtgcacagaggactccatggactgacagctaacgtgaagctctagaggaggtcagtgtcacagagcgccacaccacggctcattttgtaccctatgagcacaagacatctagagtccatgtgaaatcgcccttccagagagaaagatatctttggggtttcatctctcttgtacattcaaagtgtccttggggactgtaggcaggctgaggacttgactgcagagatgggatcatgcctgaagttctgtaccagctggagattgcaggttttgatggccccagaaagctgcagtgtaggagtacacagtataggagaggcagcaggatctggagactacatagggctgtggaggggacgacgtgggtggggccaataaaggggccatagagaaacctaggaagtcttctcccggaggtctgagtcatctattcctggacatgctggcttattcaacaacctggattagaaaagggctaccactatgtcctgggaaactggatgggtgacactccaatattccctggaggatctgagccaggtgtcttgtgtgtgtgtgtgatgtttgtaaactccctatgtgtgttgggggcctgtgtgtgctgtgtgctgggggctgtatatgctgggggcctgtgtgtgctggggacctgtgtcatgggagcatgggaacattccagctggacaggggcttcttcctttagaggtagcagccggcctgtccaggtggatgggacaagctcaggctgccaaggcccccacccggtctctgagcctggcactggttgagcagtgcctggggccgacagcagccatatgttgggaagtggagctgtgtgcggtgctctgcggcccccggggccagccttcctgggcctgtcacagatgattttccctgcctgaatggcaggcaggatggcgggtggggcagtggggggcctgtgagctgtccctatgtttaggccctctactgctctcaacactagggtttttactactcctggagtaatccaagagctgggcctcagctttgaagtccccacaatttcactgaatgaaccctgtggtgggcaccccttttaacttggggttcaggaaatttctggttggtcatcaggaacctcctgattgattgtgggtggtggccaggggtccacaccaggctgttgtgcgccccaggcaggtagaagagggctgggagctgaagccctgtcagcccagcgctcagagctctgcgcagggaggcagggaggccatggctaatttgtacactaagtgcttctgacagggatgcctcgcaagtgagaacatgccattgcccgccctgggaaggccacaacggctagcaatgaagacagtaggcccaagagaaaggaccagagggacacagggccaatgaggactagggatttgagggaaaccaagaacaggttgatggcttctagaactgtcgacatagaagcatgggaaatgctgtgaagatgaggtggtcacagacaaggcccgtgagccttacaacccctgtgtccactgtgctagtcactaatcctgttgctctcttgggctttgtgacgtcctgcacaggacacaggacaatctaccaaagtctagcctagcctgctgagactggagtgtaaagtctgctttgaccagtcagcactacctcccttctctaggccttttaccctaaccagaatcaagtagccttttgaggaggcccagccccctcccaatactagtccaagagttttacttatgtgtacaactcccctctgaatgccccccagctccccctcccccatatgctggggtccacatggaggggaaagggaaggtaaacgtttgctgagactaaccagagtggatgaacatgcagtggctggacctccatcttgccctgagaaaatcctggcctttctcttgagttgttttgggggctggagttgcacaggccagtgtggtgggtaccaggtgagtagggcagaggaaaggggtctctagaggagctggtctttggctgccaaagatgcccagaactggctcctgccaaaagtgcccctccactgtaagaggtccagcctggtgcgcagccgcataggggcagggaaggcgctgtgggcggcgaggtgagatgtgttgtggcagctgccccgctgcccgaggcccgcctggagcgaacactgctggtggctttaattgctttcacattcgatgggttggcctgtgacaggcctcttacgcagtgcactctggacgtgaacccccagcccccgcttgcccaggggcatcctccagctcctgaaggggcctgggctgctggccagagatgggctgagcagcttagcgtcacctgtgatatgagatgtgcccagcctgaaccaagctgggaggggacacagcacaccagccaagaagagagcagcagctacagcctcactcaccctctggctccatctgctccttcttggtgactgatggatttagacagccttcatcccccccagtgcagggaggaaaaaaaatactcacatacacattgtcctgcctactatgttggtccttcctggctgtggggctcaaaccctggagatgggctccagcctctgttacacctgtatgttcactaatgcttgaggagtctggctgggtcatggctcacctgacccttaggcagaagcaagaactgtcaccttacaacccctggtattcctctggagtttatccaggtttatccaccctggcctttggaggaacctgtttctgtgtgtgtaggtactggaagggtgacaacagaatgcaagcttcttacaaaacaaaacacttttatttggtccgtggagcctgagtggaaatggcctatggggtgcatcatcgaacaaggaagggactgacagctgataaaatagtctctgtgttcgaagagctggtcctatttacagggttaaaaatattcacagctcagagtaaaaggaggcccagagggaaggggaatgtttctctaggtataaaaaccctagcaagccccatggaggcagggacagtgggcttgggagctgcccctacctagggggctgcacaacagtggcccaggaaatgactcaggcgtccatgtggcaggtaagggctctgattttgacaagcagctgagggaatgctgggcaggtgggcagcttggctccctcatctaggggagggagtagtcagtcacaccttacatgtgcctgtgataggaccggagtagggggtatccctctttgtggacagactgaggccatgggcagagctgactgtggccagggaaactaaggacaaagcacttctccagacagcagggctgggactggctcctgtcctgtggctccatcatggcttcgatcctggcaggtgctccaggaattgcatagtgttgcaggaggtgtagctgtccccaagccctggccgatggccaccaggcatctgcttcctgcaatgcactgctcatatgccagggctatcaggaccctgatcattagggcagggagctgggcttgggaacaaacaaggggagcagcagcagatctgagccccacaaagggttgcccaggttctcacggcgagcagggcatggcctctaaaacccggactggttctgcgaacatttatctgggctgcctctccataataagtgaccccatattcacagggccgccccctttgggccttggccatctgaagctgtccccagggctcaagacagaagtactggaatgaagcccacccggttcgaggtattctgcatggcagctgggaggcctggtggggtactgagggtacttggggtgggataggaggggagggaggcccaagggaggctgcaccctgtggctggcggctccctgggcagggtcctgagattctggttcaagcatcctccattgggggtctccctcataaagtgcatgtaggggggcaggtgggtagatctgcacacagcccttgccctagggaactgcagtcacagtggccggggtccatgtaggccggccacatcaggtgtgagtggggggctgtgggtacccctagaggctgtccagtcactgaggaaggcctgggctgccttgcgatgtgccaggcgatgggtgatagagaatccagcattgccttccagctgagacaagatcaccaggacctgcctgcaggagagggctgatgaggaccagtggaagagcagggcctagggtaggcaagaaaacagcaggtacccacctgtgcaggggtggtacactgtcctgggtgcgcaggctgccacgtgtggacaccacattgaagctgtcggtgcagtcacattgcacatgcaggtaggacttggggtgccggttctccactaccacgatgagtcccgcccagccatgagtcaggtaatagcaggtcatgccctctcgaccctgggcacaggcacagggtgggtgggccagggctggtggttgcccaccctctgccctcccccatcaggaccccacccacctcatgccgctcgccccggctctcagtgagcaggatgatggcatcggccagtgtggttggctgcgcctccaccggctccaccatgaccagcctggagctgtacactgcgagtacgtggccgggtggctcgggggcacctcgggggacccctgctgaggggctggaggctgtggggggtgtggataagggagccagcagctttcccgtgggtgggctttggggctcggaggttgggaaggagggtgtgggcctcatctggctggggcccttaccctgggcagggggccctggtggagcagggttccagtggttgaaggcacagcataccacagcatactccccaggctccagcatgacatcacagttcacaaacttcttaacagcacgtttgctgtgggccaagaggcggcccaggctcaggcggccaccagtgccaaaagtggcccggaacactaggatgcacagatccaggaggtggctgtctactgaatccgagcgcctgagggccagaaacaataggctgggtgctcatgtggccacagccatggactcctagcttggtatagtggccatcctgttacctacctgctgccctcctggaagagggcaaactccagtgaggcacgctccagcactgtgagtgctgtcacacccacaggcccaccggcagtgcttgggaaacagccctgaacccgtgcctcttgccagtctgagtgcaccttgcagatgtccacagagtcgaagtacctaaacagtgagggaaagagtgactgagcagagcacaacccaatggggctgctctggggtgccctgctcactcacaccagggcccttggtgctcagcttctagcactcatagcaggctgtctcctaccactccctccctgccccaggagccccagcatctttccagaaaaggttctctggccaggaggcaagcctctaggctgctgctctgttgtggtttgtatgtgaagtgtctgctccccagctgctggggctactgcagccaggagggaattaacctcattggtgggtgaagccatcagtgagttcatagttgaatggaaaagctatcgagaggtggtgcctggttgaagcaagcaggaaacagagggtatacatggctcttcctgtctgtctctgcttcttggaggcgatgggatgagcaactttgctctgccacatccttctgcctcaccatatctaaagcaatggagttagctgatcatgtgctgaaacttggaagccacgagtgaaatacacacacacacacacacacacacacacacacacacacacacacatatatatataaataaagatgggaattcataaagcccaggctggcctggaactcactaagtccttcaggaacaacttgggatcctcctgcctcagcctcaggcattggaacactaggattacagtggtgtgctactagttttaaattgttcctctccagtgtgtgtcacagtgaagcaaactgactcattttctggacaccacaagaagcagaatgacttacacagagctccttgggtagaccaggagctgccattcagaggcctgcaggagctgggacccagacaagctgcttatctagaccagctcccagatgctctagccacaggatgggtgaggcatgcaggtacctgataaagtcactatactccatccagaagacaccctcactgctgccgtgtggcatgagctcagctcgcaggtgccctggccagtgtggccactcatctgaccaactgccattccaggagaaacggccccatgggttccggagtcgcaggagcctgtggatcacaggactgagaaccaaagctgtgtgccttgtgccaacacacttatccaccctcagccaattgggcccctacctggagccctgaacatcacgaacatccaagacagagtaagcatggcgggggcgcagacccaggctctcgtaagcagcatcatctaccttcatgttacctcccccgcaggacgcacccatgaggaacctgtgtgggcagagtaacccctggctgatgaaatggatggacagcaggggagaccgccctccttgaatatgcggtgtgctgtgacccacatgacacatgctttcaggaagtactggcccactctggatgaggtgagaaggcatgggctggagcaacttgggcttctgaaggcttaggcctgaagcggtgggcaggagtactgcccaagttcagctgtaggtatggattttagaatcctctctcaggcccagggcttctgtaagtctttggatctatactctcctaggccttgggagagggatgtcaaggttcacaaagctgcccaggatattgtgtctcagaacacctcttcccactccttagggtccctctgtggactcttgcctgtcttttcctaagtgggaggtaatgagatctagactcatcccagtgtggctacctagaaaaatgtactagctctgctttctggctatggccagctgcacaagagcaccttgttagatgcagatacagtgaaagggcacccactcctcccacagctccgcctctcctcccaatgccacagacaatggcagtgcctgcccttcttacccagcctctttagaactcagcattttggcccagatgagatcagtgtcaacaggctcctctcgggggttagtggagctgacctgcagcgccaggctctcacagggggctccggttagtgtggccagaccttcaatggcacgccctgcctggagggcaaagtaggagccgtgcagcttggccagtgccttctcaatgagggccacccataactgcttccgctgtgcctggggaaggatgagagtcatagatggcctggtttctctaaccctacctcccaccttgctgtcctacctgtgagaagagcaaaaacccagcctcatcacagggcagcatgtcatccaccagcactgttgtccacgtgccatctttgcacagccgcacctggtaggcaccctctgcacataggctacgtgtgaccatcaccctctccacgaggtcgggacgttcagccagtactgccaacgcactcaggaacctggagggagccaggcaacttcacaacatgcccacaactggaccagcagcctccatcctcccctgagcctgtctggccctgacgggaacctggagcctcaccagcagttccccagcagcccctgtaggatgtcagagggcctcagggtgtggaagactgaccacggagtgccgtggtccctgaagacagagcagttgatttcgtggggcctcagccactgtttcactcgctgctggacgctgtcgcccactgggaagccgacagatgcaggcccgggggggaagctgtcatccacaaagttcacactattctgcagggaccatggccagacactcaggctgggcaggacagcctcaggcccagaataatcccactctaccttttgggggaagacccaccctcccaagggagcggcagaaggttggggtggggcccttgcacattaaaccaaccttggggctaggcaactttggaggtttgaagggctcaccatcaggatgatcctgagtgggcaaggggacacctgtactccctgactatgacactgcaggccagtggcaagcaggccacagtgagcatggtagcctggtatggcatggctccagctgctctttcagctgacccaatggtgatgtcacctaggtcccaggctctgcagcttaaacagaacacagggtgccccagccttgagctttaacagggtctccatgctgccctgtgtagaacagcctcactgtatcctcatctctgtgagcttacacatgggagctctgggacgctcctaggcacgtgagctgaggggaagtgacatgagtagtggagataaacgtaagttaccttgggcaaagctggttctcagcctcaaaaacaaagctacttacctctctgcagaaagccactatgttctcccagagtgccttggcctcgccctcatctgtctgcctccgcttctccacatgcatactctccctgcgcctcaggggggtagccccccggcactgggtcaccagaagctgtggtgtatggcaggctgcacagtgcttggcccgaggtgtgttgatcagagtacaggccgggcaggcccactgacccgggcgatcgggcaagagacggacagccttgtgtgctgagggagctcgtccacaggagccaacacaggggccaggcttgttggcaccacagtcagggcagtgggtagggggttcactgtgctcctggaaaccatgcagcttggagccaccacacactgaacacctgggggctgttgtggggttcctaagtgtacacctggcacatgaccaggtggtgaagtcagggctggagggactggcaggtgtgtagcgcacaatgtccccagctaggtcaatgacatcactgcacgactcacagcgggcagggctgctctctgggacctcctcctccaacacactcagtcgcttgcctggcagcagctccttgcctgagagtagctcagcgaggcgggaggccccagctgcagctcttccagggccctgctggggccctttggagcttgtggaggctgaggactgaacagcctcaggcacaggtggctgaagctgaggggggacctcccggcggcttctgggtacagggttgttctgtagggtgggtgagaagg
